United States Patent 7,745,391 (HUMAN THROMBOSPONDIN POLYPEPTIDE) - sequence listing, part 216

SEQ ID NO: 542927 - DNA, 502 bp, Homo sapiens
gcagacgggaaccggcaaggcgcccggtcagaagccataagggcggtctgtccgtatggagcgtaaaggacatgggcgataagaaggaaggactgtgttcccaggggaaggagtgaatacatcgggagaggggccgtggaggtatgattagtggctgcttgatcaaaggaatccgttatgacagcaagaatgaaaccttgggtggctcatggtctgtaatcctagcactttgggaggccgaggtgggcagattgcctgagctcaggagttggagaccatcctggggcaaacacagtgaaaccccatctctactaagatacataagtaaataaataaataaaataaaccattagccaggcgtggcagcgtgtgcctgtagtcccagctactcgggaggctgaggcaggagaattgctcaaacctgggaggcggcaggttgcagtgagcacaagatcgtgccactggaccccagcctgggtgacagagcgagactccgtttctt

SEQ ID NO: 542928 - DNA, 177 bp, Homo sapiens
taaaattatagatataactagcacatcatagaaagcccagctcaaagaaaaggtacaaatagtatacagctttaccttcataaagagaagcccacactactacagactaaacatatacacccccaccacatgccagggcacgtgtgatgtaagcacgtacatataattggcccatgc

SEQ ID NO: 542929 - DNA, 496 bp, Homo sapiens
  misc_feature (1)..(1): n is a, c, g, or t
nttgccccctctcttctccccacacagttggtgggaactaccacaaacgtggttttctccttctgctcgcacaagtcacttgctcccacgccctcccgcatcagggtgtgccccacgcttctagaccatgcgggcggtgcgtgctctccccttcgctgcctggcaaaacagtggttcgcacccacgcgcgcggtggggtcttcccacggcacggacactatgcgttggtcgtgcgtaccgctccacgcccgcgtgcgcgtggttgtgttttaaagattggcgcatctttatctcgcgcgcatctagcggcgcatcgctagcgagcgcacaaacacccacggtgtgtttgtcatctcgcctcagtttgggaggaccgcgcgtgtttctcgccgatgttcgctctctctggcccccctcgcgtgtttgtctccactgaccctcctaggccacacatacaggtggcagacccctcccccgctcctaccatgtacccaac

SEQ ID NO: 542930 - DNA, 1373 bp, Homo sapiens
tgggacaggaagtaaaatttattgggtgagtattaaaaggggggcagcactttggaacgcccttctatggattgcagggccccgccatcttgtccccagaagggccacgaacggggggtatgtatcttgaaccccaaagccattctgggtatgagcccgtcttttacagccaccatgttcttcaatattctatcagcctattgagacatcttgtgtgtgagagagccccatcttctctttgagagagatgtgtggagattcttctctggcggggccaggagaaatcttgagagatcttgtggcctctgtgggcagggtggctctccaatccacctatgtgctccctgtgtgtgtcctgtgcgacgcttgtggtgtcgcgggatgtggcactatgtgtatatacactgtgtgcgcccagatgtgtgtgttacaccctgtgtgcccacaggtgtgcccctgtggcggctttctccaaagggccacctctctgacatgtgccctgtgtgtgtgtgagagcgcctgtgtgtcaagtcgccacagagcaaacaggggaacacacacaatctctgtgtgtgtgagaaagtcgcccgagaatatgaccccgtgtgagacatcgcgggcgtgttatgagcgccccgggaaacccccggggtatatagttgtggaaagcgcaatctcttgtgtgccccacacaaagctttttatataccccatgtgtgtaccttatattgtgtgggccgcacccaaaatttctgcggcgacaagacctctcacgaggggggctttgtcgaagaaagtggaacaagggtgatgtccctccaaaattatattctccgagctctgttgagtagcacacgctatgttgttgttgcgctcccacacaataaaggggcggggaaaaagtgttctatgttccccacactttttgtggtgggccccttattatatactccgcgacgcccccccgaggggtttccaaaaaaaaatgtgtggcgaaaaatattcctttgggcggcgacacttcaagcgggggacaccaacccctttctggcgcacagagaaaaccgctggaaagaacctttcggcgggggggtaaaacaggggcatttgagtaattctctttaccaaaagatacccccggtggtttacacccaccaagccgcggggcccggggagggcgagagggtgtgccccccaaattgtggtgatgagcgccccgcagggggaattctctaaaagggcccgggacacccccttttgggggggcctcataattggggggaaagaggacccccacctcctggtgaggagggcactcccccctctttggttgggcacactcgttgtcgacatacgtccgcggggcattgttg

SEQ ID NO: 542931 - DNA, 579 bp, Homo sapiens
ggggttctccgaacggtcttctttccgacagcttgctgccctagaaccagagttggtggctggacctcctgcgtactatccgagtgtgcgaatgcatgtacttctcatttgtttgtctgggcggctcggcctctgcgagagcatgtgggcgagcgtgggtcagtgatggccacttcggggctcagcacagactagcgctatgcccagacttcagactggggaagcaccgcttgggggctgtgacagggccagggaggagcccatgtgcggacagttgatcctgagtatgtgggagctgtgcatgcagacgggagagaggacaggcagtgtcggggccgtggaggcgtcatgtgccatcaagagaacgttctgcagccgaagcctgcgctggaggccctggggtcctgtcctgaacagagaaagtactcggagggtaatcctggtaagcagatactcatggggggagcagaggttggttgaatgaacagtcgaggcttgctgtgccaaggcgccggggcctgtgggcaagccctttgaaccgtggatccttgcacaggtggggaggtcagatggtccatc

SEQ ID NO: 542932 - DNA, 275 bp, Homo sapiens
  misc_feature (44)..(44): n is a, c, g, or t
tgtctttgaaaccccctgacctcaggtgatctgcccaccctcgngcctcccaaagtgttgggattacaggcgtgagccaccggcgcctggccaattattattattttttaagagatagggtctcatcctgtcacccaggctggaatgagtgatatgaatgtagctcactgcagcctcaaactcctgggcttgagtgactgcctgcctgcctcagccttccaagtagccgagactactggtatgagccagtgcaactcagctgattttttaaaaat

SEQ ID NO: 542933 - DNA, 129 bp, Homo sapiens
gaagtgctggcttcctgaaatagatggtccaagatttccttatgttgatttttttaatgctctatctctctctcctgccttcttcttttcctccctacacctttttctcacacacacacacacacacac

SEQ ID NO: 542934 - DNA, 128 bp, Homo sapiens
gggatggaaatgcaggggctgtaggcaggcagccagaggcttatatcgtatatggaaatccatccttaaaaccatcacctctcaatgctctgtctgccatgccaccaaccccagagtgtctggtcttg

SEQ ID NO: 542935 - DNA, 490 bp, Homo sapiens
ccttaccctggcctgtgcctatgggtttgggacagacgtggttgtagcaagggatgcagagggagctggtcaccaggccatggttgggagagtccaccctcgtgtcggaatcagcaatctggggccaaggtaagccacggttgcaggtgggctgggcagggtacatatctttttcccattcttctcatgcactgactctttgcctttccacatagctgtttcctaatggccctgatcctgtattgcttcttctccttccgagattttttgcaggggggaccagaatctccccagttgtgaggagagacgcctccattgaaggaagtagaagagaccatgcctgctccattctctaagacagtgatgaagggctcctctgatagcttcctggaacaggaaatgtccgtctccacagaggaaggggtatccaggagcaaaagtttcaatctctagctcaaagagctgagacacagagctatcttcctccagg

SEQ ID NO: 542936 - DNA, 169 bp, Homo sapiens
aatcgtagcgcaatacgcattcccggactgttggcaggagaagagggttactttgaagatcgtcgccctctcccaactgcgacccttttcggtgacagaggcctcatccgacgtgtcttcttaatgaaaccggcgatgagccttccagtacaaaaattaagtcgactag

SEQ ID NO: 542937 - DNA, 420 bp, Homo sapiens
ttttttttttaaaatgaaaaaagtgcttttttatttgtttgtttgaattcccaggaatcaatcacccaatcagtcaacaaggaagtgatgttcagtctcgtgaatagctccaactcttcagctctccagattttcccaacctccctggccctggatgaactcccggatggcttggttcccattgatcatacccgtcatggggatagccaccttgtcccaatactttcagggcaattgtggccctggtccccaagatttcccagtaacactgcaaaaaaagctctctaataagctaagcgggacatcctgagcacaccaggtcttgctgagagattccacagtgttctggagtaaagcccctgtctgaatctacttcatctacacagcataggttccggctggcaacctgcaatgttgggc

SEQ ID NO: 542938 - DNA, 323 bp, Homo sapiens
  misc_feature (177)..(177): n is a, c, g, or t
  misc_feature (198)..(198): n is a, c, g, or t
  misc_feature (205)..(205): n is a, c, g, or t
  misc_feature (213)..(213): n is a, c, g, or t
  misc_feature (232)..(232): n is a, c, g, or t
  misc_feature (259)..(259): n is a, c, g, or t
  misc_feature (271)..(271): n is a, c, g, or t
tggtggctgtcatgtactctaagtttgagtgtagcccttaggctctttgtgtcctcccctagtcccaagggcaggagggatagcactgttactgtggcagtggccaaggggtctgtccgtatgccctttgggagcctcttcctcagggaaactctgtgtcactaacagtgggtatgnctcagccatggtctggggtgnactgttnctgcattncatgagccatgggccctgncctagtgaagagtaggggtgggggttncctagggtaggnaggggtctgtcactcctgtttgtatggtggttgtggtgtgcctaaaaaaaaa

SEQ ID NO: 542939 - DNA, 1324 bp, Homo sapiens
gctcggctcttcccagtcctctggactaaaatggggaacacattgggcctgtgcaccaagtgggtgactttgcccctgcctgtgagccccctgccgagagtgaacccctgcccaaccctgtgtgagcttcgactgatgcgtgcacctgtctctgcaaagacgcagcagtgccaagttcctgacatggcatgtttgcttggcgagtatcaggggagatgactacacagccactctgaccctagtgaaatcctgacctgatttggggagtcggtgatcatggtttgctcacttcctgcacgagtcctcatcgtcatctggctgggtgctggcgagtgagaggctaggtttatcacctggcgagccagtgcgaagacgtgtgtggcccatcttatgcagcaacatgtgctggtcaactcgtacctcgtgctggaacaccttggcgtacggcagtacagattatgcaaatcgtatggtggtcaatccccgtcggcctgcggggcgcgccccacagtgttcagccacgttacggccaaccgctgcacctagtgtcgcgcgtcacgtgtcgactaccagggtgtatctccagtgagctcttctgcgacgctcgggagaagttagaatggtcgcgcgtgtacgagatggcgggctagctcgcatcgttaccgctgcgtcgtcacgtcgtgcggcgcgccgacacatacaaagttatggggccgcatccgcaggcttagatgccgcgcagacctacctcctgtctacgcgcacgggtggtcgcgctatagttcccgccggcacgtactgagatgtgcgcgcgcgccctggtgccgctctgcccggagtctcgtgtgccctgcgggcggatcgaagagcccagcgccgacgcgagcccgtccgaggacacgcacccctctcgctccctcacgcgagagcggcagcgggcagagcggccgacgggcgcaactcggcccggcaggcccaccgcgaacgcagcccgacacgcggcgacgaccgagacggcggcgagctcacaggcccccccgcggcagccggacgacgccgcgcgcgggcacgacggcgcgcggcagcgggagagccggcaaggctgcgcgacgccgggagcgccggcgcgcgagagtgcggagcgcacggacgcgcgggggacggcgggaagggggagagccgcgcccagcaccacgcgctgacaccagcaaggcggcgcgacggcggaccgggccggagcaggagcggaggaggaggagacggcgccacgcacgcgaggcgacggagacgagggacgagagggggggcgtggcgccggcggcag

SEQ ID NO: 542940 - DNA, 1881 bp, Homo sapiens
ggctcgtctgggagcctggcctgggccgaggtcggtgcgcgcgtgtgcgcgctggggctgtgcggtgtgtgcccgcgccgtgccccccgtgtgtgctgcctgggtggggcgccgggggtgaggtcaccggggggcataagcccttaataacgggcccgggaggctactgcggtggaagcccggccggcagccccgtccgggcccgggccaggttacccgggcgactacacaaaccacaaagggtgcaaccccgggtgggaccccggagacgaccacaccagaaaatatgtgctctacccggggagtgagacccggccacacaaggtcaccccagaaggggagacgcccacaatatgaagcggacacccctatgggagcataggacagcccccccaacaactttaccttggagggagaacacccttaataatagaggctaaggattagagcccacgggcaccgaagtttaggttttagtgtcacaccaatctagcacccccaatgagatccaacctgtggggaggaaaacacggcactaggacccggggtggaatctccacaccgcggtgagcgtacctcttctggtgtaccaaccaacagggcggggcaccttcaccccccaaatttagttctggcgttcatgcaacacgtccacatattgaggctcggttataggagcacgtattatgtgggccacaagcggaaacatttccaggggcgggattccaccaaacgacggccgcgcccaattaaaacaggggcgagaatttatggctgagccagcagacccccttcatatgttgatcgcgcaccacaacgaccgttgttaggcacgaaacgaacaccagaggtcgttgtggtaccatcattcacacaagatcgttgagacctctctcggtaaaacacggggatcccacattgttatgatatggtgggcggcagagcacgagaacaatcgcctttacagcacatttttggcccccccatgagtgtctttggtggccagcaaggcggcactgggggccccccgtctggttatcaaacgacggcgacccgctcgacactttatacaaccgcccggcgcgttgtaattagttgctgtagtgaggcgccccaaaaagaacagtgatacagaaaccggcgctacgccggtgcaagcgactacgaaataccacccaaatgtgttgttgtcaatacttgccgcgcaccactattattaacccctgtgtgacaacaggcgctactaaaccgtggttagacattgtggtggctcccacaacacaaacaagacgttgttggccgcgacacaaagcagcaaaggtcgccagtgtgagcatcccccacacagccgatcgcccagcggcacaccacgcatcacacatcatgcagagctcggacaacgagaaccatagccacaaagcataactccacagcagaggcagacactaccatcgtgcgcacaaacaactactaacgcgcagccgtcacaacgacacgcgaggtagtatacaccgcgactggagcagcgcgcacagacggcggacacactaataagacgacaaggactagtcgcacgcagcaagagaggcagcgcagccactgtcatggcgtgcacactattttttaatcaccaccccgccaggctagaccacaataagattgctgtctcacctcagacctactgttttattttttatctgttttactatttttatttttaatatttatcgtaagagctatgactagcagtgacagccgtaagcgtacgaagacatgctcaccacaactcgacaatagacaccacgcaaacagcgtcagcacgtccagacacgcagagcataccgacgacaccatacacacacgcccaccagaccagaccca

SEQ ID NO: 542941 - DNA, 387 bp, Homo sapiens
  misc_feature (18)..(18): n is a, c, g, or t
  misc_feature (145)..(145): n is a, c, g, or t
  misc_feature (341)..(341): n is a, c, g, or t
  misc_feature (349)..(349): n is a, c, g, or t
  misc_feature (362)..(362): n is a, c, g, or t
taaaaacaaagttgtccnattccgtttttaagtttacttctctttaatcggtctcactttattgaccaggctggtttcgaactcctgggcttaagtgatttctcctgtctcagcttctcaaagtgctgggattacaggcgtgacncttgacacccagcccagaatccagttttaaagagtttattcaagccaaaagctggggaatgggccatctgaggaaacacagactctagggaaaatgggggccagggcctggaagtttaaaagtttaaagtcttgcttacatagggcagaaaggcaaagacattagtaaccttgtaggaacatttcttgtattaacnttttcctntttttaaccttcnttgttttaacatttccatggcaggg

SEQ ID NO: 542942 - DNA, 1683 bp, Homo sapiens
agatgcagcagttgattgatgattagttgtttacatcttctctggacaccaacctcgtgggttgcttctagaatgaaaactcggcggtgcatctctctccctcgcgattgttacaatttacacgggggaggaataataactttcttcaaccacgggagatccactgttgtatactcgcttatggcgctattttttggaggggcactcacctatatagagcacaggtgttgtatactaaaaaaatcaaccggtgggttagatcaccggtgtctccgggaactttttctcccgggggattgtttccgtgtgagatacacaacagagcgtccgtttccgttggtcttggtgatgatgatatactcttgggagactgtctcttccctcatatgatgggagtatactctggggggccctcaccttctaagatgttggccacaaatgaatgtgggctcgttatataagagacacacaccaccacagcggggggggcttccgcccgagataatatagtgaatttgatgcttgctccatatagacacacacggggggtttccttctgggtacatataaaaataaataggggtgatagtatcctcattcgggtggggcaaccctctattgttaagtttgttttcgtataacacaacagcactgttgtagatccttatatgtgtgcccgccgcaaacgaagatttttgtcccttggaggagtttctgtataatttaataattttggcgcccaaacaaaaggggttggtgttgctcaacccggcgagtatttatatacccactagaatccccctcgtctctcatatagtaggtttctcggggggaggcctcttcctgaaatctcactaaaatttgtgagatggagcgccccttctttatagagatgagggtcttctctcgataagatttccctgggaggtctactcgttcgcctcacagtttattcgcctgggggaacaccccgggacctcccgagattcccctagatatgtccccacgtgattttttgtgctggcacaacgagacaccacacggttggtaaaacccacgatattttttctgggagaaaaagtcttttttctctaaaaagaatctcattgtcgagtgagaattttcgtagaaagaagagtttcctcgacactactctttgtttttttttaatatctcgcgtttcttggtgttataaaaacggcccaacactgttcctctctggcgtttacacaaaggtggttttctccgcaaactttggagagggtgtaaagtggaaaatatcttgtgctgtgtgtgcacccacagaagtgtaatatgttttaattcccctataaacacacgggtttggggggggagaaaggcgcctcgcacaaaaactcaaccactctgagaatttgtggaaaacacagcacgccacgaggtggagagtgggagttttattttttcgtgtatttgttgtgtggtttaaaaaaattccccccactgtgaattattgtgaacaccctgtgctttgtggtcacctgtaaacacatttgggcgggtgggaacacgggagggagaaaagtaacacaataagtccacacacatgtccctggcaatctgtttcagagcagtgtgcagaaagtaaagcttttttgtaagaaacgttttatgatttttaaaataaatttaggtgaaccctta

SEQ ID NO: 542943 - DNA, 951 bp, Homo sapiens
ccatactagatcttgccgccgcgaggcacgggggcctagccctactagtctcaatctccaacacatatggcctagactacgtacgataacctaaacctactccaagctaagacttaatcgtcccaacaattatattactaccacggacatgactttccaaaaaacgacataatgtgaatcaacacaaccacccacagccgtaattattagcatcatccctctactattttattaaccaaatcaacaacaacctatttagctgttccggccaaacttttcctccgacgcgcataataaacccccttcctaatactaactaactgatccgtacgccctcacggatcaatggcaagccaacgccacgttatccagtgaaccagtatcacgaaaaaaaatctactctctatactaatctccctacgaaatctccttaattataacattgacagccagcagaactaatcagtatgttgatatcttcttcgaaaccacaccttatccccacttggctatcatcacccgatgaggcaacaggcagaagcctgaaacgcaggcacatacttcctattctacagcctagtaggtcccttccgcctactcatcgcactgatttacactcacaagccctaggtcataaagattctatatcactctcactgccgaagaagtatcaaaaatcctgagcaagcaattaatatgatagcttaacaatagtttatagtaagatactcttggaggacttcagtatgagtcctaaggcatgttggaagccccatggtggtaaagtctgcgggggatcttaaaaggggaggttaataggcaagtcatttacccgaaaaaatggtaccttttggatctagggatataaggctggtggaaagacaagggggtttaaaatacgcgaaggttaaccggaagggagtaaagaaaatagagaaaaagggtcggaag

SEQ ID NO: 542944 - DNA, 137 bp, Homo sapiens
acatatgacgccggtggggatagcgatgattctggtcgcggcggtgcaatatgcacgtgtgtctacgtctattcctcactgtaaatcatcatggtgtgctcacacgcatcacacaccactaggcacgccaattgcat

SEQ ID NO: 542945 - DNA, 284 bp, Homo sapiens
ccctaggcgcacttctggatgtcggttatggtttctgttagagcacaggactctcgcgcctgctgtccccggcctgcagtttcagtgaagggatctctgcaccgtcaacttccctggctatcaagccatcctcccacctcagcctccccggcagctgggaccacatgcgcccgccatcacgtccggccgatttgtaaaatttccttccgtagagaccgtgaccctgccccgtggcccaggccggtctcgaactcctggaccctagcgatcctcctgcctgggtc

SEQ ID NO: 542946 - DNA, 142 bp, Homo sapiens
gcccatgctgcccaactcatgtgacttcacacctatgtatcatcttggcacagagacccaacaataaatacacattaactgcttatacaaggcctcctcaataactccaggatcatatcacacttgagccttcccactatct

SEQ ID NO: 542947 - DNA, 129 bp, Homo sapiens
  misc_feature (7)..(7): n is a, c, g, or t
ctcctgnggcggtggcgtccaacccgatgacgagtacctgactgcccaacggagcactggtggcaaacctgtgccccgggccgtccccgtcgtggcaggcgacatcaatgacgatgccgttctctatca

SEQ ID NO: 542948 - DNA, 713 bp, Homo sapiens
atcaaagtagcttactatatctaaactgtaaaaccatatagtttctcctgaacacctgctttccttctgggagtctggaattttggtatgtgccaggcagagactacctttgtgaccagctcccagtaaaaaccccaggcactcagtctctaacaagcttttgctggttgacagtgtttcacaagtgctgttacaactggttgctgggagaattaagctcatcctctgtgattccactggcggaggattcttggaagcttgcacttagtttcccctgacttcaccccatgtgtcttttttcctttgctgattttgttttgtatcctttcactgtaataaatcatggccgtgagcagaactgtaaaaaaaaacacaaaaacaaaaaaaaaaaaagggggggctccaaaaattatcccccgggggccccacaaaagcgtaccacgactgtttcttttgtacacaaagtgtgcccctattgatgaagagactcgtatttaaaacatatttgcaacagctatccgtgctgtcaaaagcaaagccttggccgcggcaaaacaatgtacgacgctcgactcttcatagtagcagcgaccaccattattcatgcggggtctgcgacaatacttggccaaccctcaccatcactacatgttaaacgctccattgatgaactataatgtcagagcgttctgcttgtgttcacaacgccaata

SEQ ID NO: 542949 - DNA, 341 bp, Homo sapiens
gcgtcgacatgtgatgaggattcgctcgttctttaaggaaatttaaattttctttttacggccaggcgcagtggctcacgcctgtaatcccagcactttgggaggctgagacaggcagatcacaaggtcaggagatcaagaccatcctggctaacacggtgaaaccccgtctctactaaaaaaacaaaaaataagccgggcatggtggtgggcacctgtagtcccagctactccggaggctgaggcaggagaatggcaggaacccaggaggtggagctggcagtgagctgagatcacgccactgcactgtagcctgggcgacagagcgagactctgtctca

SEQ ID NO: 542950 - DNA, 345 bp, Homo sapiens
gggattctgaggcagcgataggaggacagagcgcctcccgaagcgcgccaggtgagcgggcacggaggacggcgaggaggacgaggagatgattgagagcatcgagaacctggaggatctcaaaggccactctgtgcgcgagtgggtgagcatggggggcccccgggctgaagatccaccaccgcttcaagaacttcctgcgcactcacgtcgacagccacggccacaaacgtcttcaaggagcgcatcagcgaacatgtgcaaagagcaaccgtgagagccctggtggtgaactaatgaggaacttggcagccaggggagcacgcggctggcttacagcacatg

SEQ ID NO: 542951 - DNA, 263 bp, Homo sapiens
aatcagctcgcccaattacggatgcactggcactgtgggtgtgcgattattccatcctgttcctgagacaatacagcacgaccgctggcgggtttccccttgattgtccagcctcgcatatcgggaagcacacccgatggatacgcgacagcaagttttgggtaggctgatttgtcaaacgcctgcccctgcatcaggacgtagccagacggaacgatatctgatggccacgggatcggcgcacctgccggaaaggccgaatt

SEQ ID NO: 542952 - DNA, 429 bp, Homo sapiens
  misc_feature (13)..(13): n is a, c, g, or t
  misc_feature (22)..(23): n is a, c, g, or t
  misc_feature (25)..(25): n is a, c, g, or t
  misc_feature (27)..(27): n is a, c, g, or t
  misc_feature (41)..(41): n is a, c, g, or t
  misc_feature (233)..(233): n is a, c, g, or t
  misc_feature (235)..(236): n is a, c, g, or t
tgtttcggaggcnagcggggcnngncntgtgacaactgccngtagacctggggctgctgaacccagtcccgatggcaccaccggccacacctacaaccagtatacacagagatacaatcagagaacaaacactaacgtaaattgccccattgagtgcttcatgccgctagatgtgcaagctgacagagacgattctcgagagtaatctttccagccccacccgtacaagtgtntnnctaccaaggtcaatccacaccccagtgatgttagcagaccctccatctttgagtggtcctttcacccttaagccttttgctctggagccatgttctcagcttcagacaatttacagcttctccaagcatcgcccgtggattgttttgagacttctctcctcaatggtgacagttggtcacctgttctgcttca

SEQ ID NO: 542953 - DNA, 333 bp, Homo sapiens
ttttgcgggttaataaggacttaaactggtacccaagtcagaaagactctgcctctaattttttggggcttggggatgaaaataaagtgttacacccagtgtttgtcccccacagtttgtggggcaaaaagacccttcctgggactgaattttcaatttgaagcactgttgttcaaagatttcccttttgggtttgacaaaaaaaaacaaaacccttatttattgcatttttttgggttacaaacattgccctcactaatcaatggacatttcagcatttcattactaattttgagaaaaggcccccatggaatttaataaaaatattattga

SEQ ID NO: 542954 - DNA, 1753 bp, Homo sapiens
agcgggggcgagcgctgcggcagcggtgcgtgcgcggaccgcggtcagtcccgaacaaacggagcaggggcgccgccgcagggacccgccacccacctcccgggggcccgcgcagcggcctctcgctctactgccacccatgaccgccaacggcacagcccgacggcggctgcacgactccacgctctcgggccctccactcacacctggcgcgccaagcacacgctagccgtggatcgcgccccgcacggccaagctctcctgcgcggctctcccacacggcggctgcacagctgccaggtctcaggccctaggtcgacgcgcccctgccacaccgcactacgcacacgtccacgcaactccttgcgccactgccctgcgcacggcctacgctctcctccctcgtaccgcgcacgtggcctgagtgccactgccacgccagtgctcttgctcgcttagctcctctagtcccgtcctatcgcctctatccccctcgtcgcgtccctggcgttatcccctagacgcccgcgcacgcgcatcatacgcgacagcagcgtcacagcggctgcaacccatgcccgcagcccgccgcagggccttgcccccgatgactccgcgccgacacccgtgagcccggcttctcttcccccttcctactttccgcctgggctcggtcctaccgctacccggctacccgtgcctccgctctatggggattccggctcttgtcgccaggtgttccccctgtcacgcggtcaccgctcctctactccgtgtcgccacggcccgtttcaaccgctctctccgcactgactcggctgacacgagtctccgggaaggcggacagccccgcgccccgttgttctcgccgttgtactcttcttcctgtcctggtccgaatggcgcacccgtgtcgtcttgtgtccttcacgcggcaccacctcggagccctgcgccgggcacaatgtcataaataataggtgcacttgagcacggacacagtgacacacgggaatatgtgtcgcaaccgcccagaccgtttacacaggaccctacccatagtgtggtacctaaatcccccaccccccattatctatacggcggggcgcttccagatggaatcccgagaacctatcgccgttctaactcccagatcgtggtacgctggaagatctacccaataacccgctcccacccagggtacttcttacaataaccggggccgcaggggccgccatgtacagctccggtagtcccggcgtccctaaattcccacccgctttgggcatacgagcacgcccaggctccctggcgactcgcgtgtgggctcgctccagggagcggccacccccccgcggcccaacactcgccgtgtactaccctcgcctaaacgcgtcaccgcggaccaccgccagggaccatgtggttcggcaacatgccccccacgggcgtcgccgcggatacaaacccccggggcctttggggccacccccctcctcccacttggagcgtcgatgcggtcgcgtacctcgccggtgcatttttcccaggatcactaacctccctgtttttccggcgacgacgacttcttcctcacgttctgtacccgctaaccccgccgccctttatccgcggacacgccacccgcatttatttactcctcgcagtaaggctcggacgacaacactcctcccgaccaatggtcgactcgtggtctgccctcgtattcaagccaactcgcgctcctgcgcga

SEQ ID NO: 542955 - DNA, 498 bp, Homo sapiens
  misc_feature (344)..(344): n is a, c, g, or t
  misc_feature (356)..(356): n is a, c, g, or t
  misc_feature (407)..(407): n is a, c, g, or t
  misc_feature (418)..(418): n is a, c, g, or t
  misc_feature (438)..(438): n is a, c, g, or t
  misc_feature (450)..(450): n is a, c, g, or t
  misc_feature (472)..(472): n is a, c, g, or t
  misc_feature (497)..(497): n is a, c, g, or t
agagagctaaccatgagcttcaataccctgccatagataaataaataaataaataaattcttttccccgctctccaacaggggttctgccttctaaacactacattttgaagcatatgcttcccaagcttttctcatagcttcacatgacgataacaacaaaggaaatttaatataaatatcaaagtctccctgtaggtttcctttctcttctagtgaacaggtcccactcccatgacaagctcccaaagggaaaaaattgtccaaggctagagaaaagtaacttgcatagctgttccaacacaagctcccagggccttcccagagtccacggtttgagtcttncaaaattgctgntggaaaggcttgcaggatgagtccaacttggacttgggggttacaggtatncttaccaattnccaacctttttgttaacctnttattatattcnacaattcaagggccatgggggnaggcccatttatcaatttccatggnc

SEQ ID NO: 542956 - DNA, 173 bp, Homo sapiens
taatacaggcgtatattgggacttgtctaggttcttaacatgttcatatacattatagaaacaattggtcagtttccataaaaacaaaaaaatagatccgggaaattggactaggatggcctgaatttatagagcaattgggagagacggacattttaacgacatggtgatta

SEQ ID NO: 542957 - DNA, 575 bp, Homo sapiens
aacatggagaaaccccgtctccactaaaatacaaaattagctgggcgtgggggcgcatgcctgtaatcacagctgcaggagaatcgcttgaacctgggaggtggaggttgtggtgaaccaagactgcaccattgcactgcagcctgggcaacgagagtgaaactctgtctcaaaaaaaaaaaaccaaaaaacaaaaaacaataacaaatatgggccaagatgtttacaaactgggaacccttaggacaccgtgggtagaaatggtaaaacaattcagccaccgtgaaacagttctggggggctcctccaaaagttaaagagaatggtcatatgatcaagcaactggcacttctaagaagacacccaaaagaactcaaagcaggtattcaaacaattattggtacacaagtgttcacagaactattcatggtagccaaaatgtgtcaacaacccaaatatttatcacctgatgaataaccaaatggtgggtgtattcacatctgggctgactgaaatattattcagccataaaaaagaatgaagtgctgtacatgcaccacttaatgaaccttgaa

SEQ ID NO: 542958 - DNA, 286 bp, Homo sapiens
aaagccctccttgaccccaaccccagccccttccccagggggtggtagcccagggaggcttttggttttattcaggagagcctcatttgatatgcttttaaagtaatgagttaaaatgttagcccatatgaaccttttttatgtgaaatattagatttccggtccttcccttgttttttattatatttttaggggggatgctatgtgccataggatgcgatgtttttttccctcccctgcccctttgttacccggggttggattaaaagcctgggtttttggctta

SEQ ID NO: 542959 - DNA, 628 bp, Homo sapiens
ttagagttggccttccaacacagtggcaaaactggtccaagagccgtacaagctggccattcgaactcaacctcgggtgaccaagtccgcctgagcctaaggccatttgccaagccctggccaccggcctcacttgtttgccttgcttctcctaccagaaggcccagcatccccaaaggatttcttagaagcactgcccaagccaaagagcctcctttcctttgtccaaacagccctgcaaagccccaacaagccgaaagattgtcatgtgtcccctcaaaagatcggaagattgcgagtatctcggagcacacgctctactccaggttccttcatgagagccccataccccccatgctgatggcggcctctatctgaaagtccgtggctccctggtccatgttagcactcaccatgtaagccatggactcagttacatactgcagcataaccatccgtgccagcttctcctggatcagcccaaagttgtgaattttctccccaatctgggtacgattagtggcatgatctacctggaagagggtccacacatcccgctgtggttcagtgtggttctgcagtctccctaggagagggtctgggcttgcgccagaggtatgggttttgc

SEQ ID NO: 542960 - DNA, 319 bp, Homo sapiens
  misc_feature (78)..(78): n is a, c, g, or t
  misc_feature (107)..(107): n is a, c, g, or t
  misc_feature (111)..(111): n is a, c, g, or t
  misc_feature (129)..(129): n is a, c, g, or t
gtatgaagaagagtaagggagcagagggttaggacttcaggaacttagtattctggaataaggaatgaatcaactganctgggccagcaggtttgtaactaaatgtnactngcctttctcacccagttnatcagtctcggtacttgtttccctttttgaaacaagtgtctgggttaactaattctgtatatggttgtgctaaattcatagcaggtgccttattcttggcttttagtcaaaccattccatatcagaattttccttggtttaccatagatctttggcttcaagttgttgttggtgttttttaatgtacaat

SEQ ID NO: 542961 - DNA, 302 bp, Homo sapiens
taattgtgaaataataattttaaggatcttacaggtattacattaaaaagatactatgactgccacctgccatttaccttctaataaccctgccatgtggttggcagaacagagatggatatagtacgcctcagcaagaaatattttagtgtgggtttttggttttttcggttactagaatttcagtggatagaggggatagtggttcgaccttttatctttttaatgggacgtcagccagtttttggtaaagttacttcactgtgtaattggttgagatcctcgatttccacctttgccga

SEQ ID NO: 542962 - DNA, 412 bp, Homo sapiens
  misc_feature (73)..(73): n is a, c, g, or t
  misc_feature (128)..(128): n is a, c, g, or t
  misc_feature (134)..(134): n is a, c, g, or t
  misc_feature (152)..(152): n is a, c, g, or t
  misc_feature (167)..(167): n is a, c, g, or t
  misc_feature (209)..(210): n is a, c, g, or t
  misc_feature (214)..(214): n is a, c, g, or t
  misc_feature (218)..(220): n is a, c, g, or t
  misc_feature (226)..(226): n is a, c, g, or t
  misc_feature (228)..(228): n is a, c, g, or t
  misc_feature (234)..(234): n is a, c, g, or t
  misc_feature (246)..(246): n is a, c, g, or t
  misc_feature (288)..(288): n is a, c, g, or t
  misc_feature (301)..(301): n is a, c, g, or t
  misc_feature (311)..(311): n is a, c, g, or t
  misc_feature (323)..(323): n is a, c, g, or t
  misc_feature (331)..(331): n is a, c, g, or t
  misc_feature (335)..(335): n is a, c, g, or t
  misc_feature (339)..(339): n is a, c, g, or t
  misc_feature (343)..(343): n is a, c, g, or t
  misc_feature (351)..(351): n is a, c, g, or t
  misc_feature (355)..(355): n is a, c, g, or t
  misc_feature (361)..(361): n is a, c, g, or t
  misc_feature (375)..(375): n is a, c, g, or t
  misc_feature (397)..(397): n is a, c, g, or t
ccccgctttcttgctgttaattcaacagtgacacaaataagtttatgtgcccttaataccaggtgggcaccanacgctacatgctcccgaagtgctggacgatagcctgaacaaaaaccacttccagncctacntcatggctgacatctacngcttcggcctaatcntttgggagatggctcgtcgttgtatcacatgagggatcgtgnnagantacnnnttgccntnttacancatggtaccgantgatccgtcatacgaagatatgcgtgaggttgtgtgtgtcanacgtttgcggccnattgtgtctnatcggtggaacngtgatgantgtntacnagcngttttgangctnatgtcngaatgctgggcccncaatccagcctccagactcacngcattgagaattaag

SEQ ID NO: 542963 - DNA, 629 bp, Homo sapiens
  misc_feature (551)..(551): n is a, c, g, or t
taccggtaattggcctaaatatatggttttaatcctttaataaaggtttatcccattaatcctaggggttcatttaattagttaacagaccagactttcttctagggctttcaggaggcattccagttttaatattttccaggaggcaaatgggccacttaaatccatcttggtacccataggcttaatagggccatattaatcaacacctttttaccatcattccttcctttaatatttaatggaaaggattttcttagccggaattggcataaatattcaccttgggttttctctggccatgagtttggaggtttggtttggataatttcctttaaaggaatcgtgaattaatcttcatatataaggttggcggaatccatggggttcctctttggaagggtttaatcatacctaagggcctgatatccagtggcctcttcctagaatatattaataccattaattaaatttttaaattttatgggcagctggaatatcttaaataatacctctggcctaaatcctatcattaagtggaaatccttggnagcacttaataatttggttatggcaacttttcgggttgctggaacattgtagccgagctcttgccgtcccttctttgg

SEQ ID NO: 542964 - DNA, 285 bp, Homo sapiens
  misc_feature (1)..(1): n is a, c, g, or t
  misc_feature (42)..(42): n is a, c, g, or t
  misc_feature (52)..(52): n is a, c, g, or t
  misc_feature (54)..(54): n is a, c, g, or t
  misc_feature (136)..(136): n is a, c, g, or t
  misc_feature (172)..(172): n is a, c, g, or t
  misc_feature (207)..(207): n is a, c, g, or t
  misc_feature (240)..(240): n is a, c, g, or t
  misc_feature (261)..(261): n is a, c, g, or t
  misc_feature (268)..(268): n is a, c, g, or t
ntgccggcagttccatcggtggaacgcacaagattgggagantcacagggcngnatgcgcgggacctttgtttgagggaagtgccccagcaatcgtctttctccagatgatgccagttttgtggatgcattcatanctttaccgggagcacatgggcctgagcgtgggcatnaacagccataggacactatgacttctatcccaacnggggctccttccagctggctgcacttcctaganctctacagacatatttccaanacggctnaatggcaatcacccaga

SEQ ID NO: 542965 - DNA, 605 bp, Homo sapiens
ctgaagattcagtttaatgagttttcctagggagcaactaagtaagaaacataatgccaacagctggccagtaattagtgttgtgcacttcatgtccattaatcaatgttctcaatagtactttataaattagtgaggattaagagaaatctaggagaattttgcatttcatgctatcagcaaacagatattttcttgccaaagtcaaaagtaaagagaaatagtgatgagagcgttgaacgacaggcttatttttaagaaataaagactatttttaacatgggtttccttattgaaaaatcagtgtatttagtcataaaacaccatcgagttaagaataattgaacaataaagtttgcttgcagatgcacgttttcaaattataatctcatttcaatttactaacgttctcagtccgtttgttataattgttccttgtttgcagtgtaacgtttaattatctgcatttatcttttttcctagttttactaatactaatgttgatttcttaaaattcagtgagatataggataaaataatgctttgagaagaatgtttaatacgaaaattaaaataactttttctggcaagaaaaaataaacagg

SEQ ID NO: 542966 - DNA, 1093 bp, Homo sapiens
tgggccagtttttttttaattggtaaagctctgccataaatcttctagccgtgtgccaaggtgtcaccgtggccaaatctccgcaccaggtgtgtggtccggtgtgtacgccaggcaaaccaagatgttctgggccatcaggacaagaccagggccaggggagggtggcactggggtgtgggtttctggctctggctggctgggtatctggataatctttctgggtcttacagagttcaactctctcacaagagtggtctctttctcccctctctataaaactcgccagagaactctgtgtgagagtgcggtggggcgcctgtgtgtggcacgagcccaacacacaaagccagagtgttagcgggttatgaggcgctgtgtacacgccacagaggggggcgtgtgtgaatgtgaagtgtcgtccccacaccaactcttgagcgcgtgtgtataagaggtgtgttgtgtcggcttctgcgtgtgtgagagactactcccaatacacgtgtggccgcgtgtgccaatctctcttggcgcctctccgagaagagccccacgagagaggtgtactcccactctgtgtgagagagagaaacagagtcgtcacccgcggtgtgtgtctcagagaaagtagaccctgtgtgtgtgtgtcgccccagagtgtgtggtgtggtggctctcttcagaacctgtgtggcgaaagtgattagagacccaggagggtgtctcccatttactctgttgtgatcaccagcagtcttttgggtctcccccagaaggcccccacggagggggaagacacggacagtgaaaaagaggggggtctgtgcctgtgcggtggtgaggtgcccgaaaaaaacgcgggtcacacccaagagacaaaaccccccgacctttcgggaaaagtggtgggcactccactaaaaactcgcgggggaaaacgaggggggatattttgggcgaccacacaccgccacgaggggataatctcccaagatacaggccgtggaaagggggagtaaaaaacatctcggagagaaccccaatggagaaaccacacttttgcgcaggtttggtcacagaaagggagaag

SEQ ID NO: 542967 - DNA, 113 bp, Homo sapiens
ccaatgctagcactagagggtagatttagccacaaaagtccatccatctatgctgcttccacagagaaaacattttctcctttcctcctcttgaacttttacataatatcctc

SEQ ID NO: 542968 - DNA, 418 bp, Homo sapiens
  misc_feature (416)..(416): n is a, c, g, or t
ttcttgggcacctgctgggatcagcccccatctgactggatggtgatacttgctttagcagacatgaccccagggaaaggcccatttttgcccagaatttacacaggtcacaaagagcagctgtagaatgcatagcctattgtgataccatgagggactaagtaccaaccccatgaagtcctcaagcaggggccttcacccctttcccaggaccttcacgttctcctttctttctccaatggtgatttacagatgtgtttttctgtatttgggaaaaagtctcagaattagcttaaatgagccagggacaatggctcatgtctaaatcccagaactttgggaggccgaggtgggtggatcacttggatccaggagtacaggaccagcctgggcaacatggtaaaaccccatctctntg

SEQ ID NO: 542969 - DNA, 123 bp, Homo sapiens
cggacactaacattaagaaaggtctactttactagaaatttggtttaaaacatacaagttaaaatcagcggcggagcaggggggtcacgcctataatcttagctactcgggagggggggggaa

SEQ ID NO: 542970 - DNA, 1646 bp, Homo sapiens
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaa

SEQ ID NO: 542971 - DNA, 394 bp, Homo sapiens
  misc_feature (173)..(173): n is a, c, g, or t
  misc_feature (185)..(185): n is a, c, g, or t
  misc_feature (223)..(223): n is a, c, g, or t
  misc_feature (288)..(289): n is a, c, g, or t
gcactctgaggatcgcgttagtgacacaggtgagggcaccatcaatttcctgcaagattcctgacagtcaaggtgaggagatgcctgaaggacaggagacactcacaggaggccctggagacagatgtgcctcacaggcattcctgaggaccctgtggcctggcagcacagangactgggtgaanaacagaaccttgtgaaatctgcaagttctgcgcgctgnccgttgtctggtgtctgtgaaagcaaaagttgtccaagaaggggcccgctgtggaagccttctgnnagagcggttaggggaacggggggccccaacggtcctccccggaggggctggaagacagaaggcaaggcccgtgccccccacggcccaagagtaaggcgaggaagg

SEQ ID NO: 542972 - DNA, 870 bp, Homo sapiens
gtaaatatgttctatggaatgtggtggttccgtttcaaggatccagagaggaatgcttgtcagtatgtatactagtttctgattgataatacagccgtaacgaatgaatttgctattggccacgttcataaaagtatatatatttatatattgagctgtagactaaattttcaatgtaaaatatagcatggaaatttcgtgtgaacgcatttagacgaataacgtgacgtgacctgatttccagttaccaccaaatactatggggtggatgtccttacaaacaggtttctcctacatgttcacaacacaactgtcagcgagtagcgtcgtagtgcccgactaataccctgttactgtctaatcctcagaccccattacaagatccctgggcacatctgacagttaagctagccctgatgtgtaggttaccttcttcactctactctgactccaacgagctcatgcttggccaccgtcattcttggatgccatccctgggctctgatctagtccctagattatcatccatttcacataggacagctgctgctcatccttcctgggttaaaaccacatgggtgctcacaccagtctgctcaggagggtctgaagtccaacttgcggtatcacggcggtgatgccctttttcatctgtgcttgggttctgcaacaatttctgtggtggactccttctcctggttctttgggttggatacctggcaccttggagccctctaatacagattgccctttcagctataaaccgcagaaatccacaggaatgaatctttacatgcaatccttgatccatgctgggcatggcttactggggtccttccatagctgaggggttagacccaggatgataaa

SEQ ID NO: 542973 - DNA, 170 bp, Homo sapiens
actagtccaggtgggctagtaaatggtaaatctagggctgggaacagatgttacctcaaagccaatgtcttaatcgaagtgaggttgtttcaccttatcttttcgagtttctcctcaaaattcaattttctataggacttccgtgagtttcacaaactgtataggataat

SEQ ID NO: 542974 - DNA, 1449 bp, Homo sapiens
  misc_feature (5)..(5): n is a, c, g, or t
  misc_feature (13)..(13): n is a, c, g, or t
ttccnctagtttnaatgcccttttggagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaa

SEQ ID NO: 542975 - DNA, 966 bp, Homo sapiens
  misc_feature (45)..(45): n is a, c, g, or t
  misc_feature (48)..(48): n is a, c, g, or t
  misc_feature (866)..(866): n is a, c, g, or t
  misc_feature (907)..(907): n is a, c, g, or t
  misc_feature (929)..(929): n is a, c, g, or t
atagacaatgcccgacaacactatcaggctaggtacgagctgggngtnaatcggacgagggctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcacacctggctgcgcttccaggccagtcatgtgcctgggaagtggtgggacntggccgtccccggtgcttttatgccgggttgcccctgaccncgggggccagccggggggcggncgcccccaatggggcaaatgggccggcccggcgccgg

SEQ ID NO: 542976 - DNA, 945 bp, Homo sapiens
  misc_feature (898)..(898): n is a, c, g, or t
  misc_feature (903)..(904): n is a, c, g, or t
ggcagtacaggctggtgtgaatcggacgaggctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaacctaaagctgacacgccactatggtgacctgaacacctggtggtctgctccatgagtggggtcccactgctgggcttcccaggcagtcaatgtgactgggaactggtgtgacatggccgtcccggtgcttttagccggttgccctggcaccgggccgacgggggcggcnccccnntttgcaaagtttcgacccgggaaggcgtgggcagggccttg

SEQ ID NO: 542977 - DNA, 1041 bp, Homo sapiens
  misc_feature (12)..(12): n is a, c, g, or t
  misc_feature (923)..(923): n is a, c, g, or t
acgtgtcagtanccccggtttatgtagcgaggcctgggtggcgctacttcctcctgcttcccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaacctaaagctgacacgcccacctatggtgactgaacacctggtgtctgtaccatgagtggggtcccacctgctgggcttccaggcagtcatgtgacctgggaagctggtgtgaaatggtccgttcccgggtgccttcttcatgcccggtttggcccctggacagcgggcggccgcagaccggggctgacggccgatcaccngattttgtccccactttggtggtggtaccgcagggcgcactatcgtgcgcggtaggcgcgcctaaggggggccctttccacaaccgttggcccccagacggttcccccgagcgccggg

SEQ ID NO: 542978 - DNA, 700 bp, Homo sapiens
gaaggaaatagcattatgtaatgaggattactgcattaaagcgagaatacctaatatgtgaagattacaagtaattctgggtggcgccaagaaactctgcagaattaacagtaatacaggtatcgttctcgagctgtcccatgggactgttatatcaacctcaagattacaggaacgtttaaagtgaagatatcgatcattgtttgcagactgtatatcacatatcaaggatggctgtattgtctggcgaccaagtactataaactgcgttcacccattcaggaatactatctcacaatcaacagatgaagtactattacgccatgtaagataacgagtgattgattattttagtagagcctgttggacaatagtggagatgctacacaaagcagaaatagtccatggtgacttgagtccaaggtgtctgattctcagaatgcagaatccacagatccctatgattgtaagcaagaacaatcaagctttgacacgatagtggacttgttcctacaggtgtcgaccttagggtgcagctggatgtcacaaacctcagcggctttcggactgaacagatcctggaaggacagaagatcctggctaactgtagcttctccctaccaggtagacctgttcggtatagcagattaagcacgttacactatcgtgcaaggaacacctacaggatctactgagatga

SEQ ID NO: 542979 - DNA, 162 bp, Homo sapiens
attggtggacgaacattgtgacatcccatctttacattaaatttttaaaaaattagcaaggcatggtggtgcacacctgatagtctcagctacttggctgagataggatccctgcgagtctagagggttcaaggactgcagatgagctcgtgatattgtgcc

SEQ ID NO: 542980 - DNA, 873 bp, Homo sapiens
ctcgcaactaacctcctccactcaccacatcccacacagcctccgcaacttacgggctaggtagcgaggcctgggtgtgggtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaacctaaagctgacacgccaaccatggtgactgaccaccggggcggtccagggggggccccggcggggtccaggcggcagcgacgggggggggaacggcgccgggggaac

SEQ ID NO: 542981 - DNA, 726 bp, Homo sapiens
agcaaaaacgactaaagaagcttcgtggaaaggagaaaccaaaaaaaaaaaaaaaaaaaaaaaaaaaaaatttgggggcggcccgggccccggcgaaaaagacttgttcaagaacaccaatcgcgttgtggggcgcgcgggggccccaaggagaggtaagaggagacacacgtgggccaaagagcgggttccccataaggaaacaccgcgggccagaggcaatgagggtggcgcgggattctcccgacccaaataaaaaaagagcgccgcgggggggaaaagcgagagagggtttgggaaaaaaatccacgaagagggggttcgcgaggagggcacaacaagcgggggacactataataacacagggggcgagctcccaagagggagacctgcgaagtattacaaaatatataccgcgcccacggcaccgcgggggggcgaacaaacaagaggagacgacaaaaacaaaagaggaacgaacaaaagaaaaaaaaaacgaaacgagaaaaaaaaagacggaagaaagcacaaagtcaaccacaaaagtcgagcacagggccacaagacgacccatgcgagcaacacaaagcgcaacaagggcagacaccagtgacacgtaccgaacacccagccggacgcaccaagcaccacaaccacaaacgacgaacaaacgacgaccaaccaagcagaacatcgagaagaacaggagacaagacacagcgaggg

SEQ ID NO: 542982 - DNA, 317 bp, Homo sapiens
  misc_feature (21)..(21): n is a, c, g, or t
  misc_feature (114)..(114): n is a, c, g, or t
  misc_feature (122)..(122): n is a, c, g, or t
  misc_feature (143)..(143): n is a, c, g, or t
tgggggagagagatttggaanaggaggaggaggaggagaaggaggagagagaggggaagagataaagtgggtgtgtggcctccttgggtcctctgtttgaccctttggggccantgggccantgccattggacaggaggaggntgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaa

SEQ ID NO: 542983 - DNA, 2177 bp, Homo sapiens
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaacaaaaaaaaaaaaaaaaaaaaaaaaaaaaaaaaaaaaaaaagggggggggggcgccaaaaaaattccccggggggggccccaaattttggcgccgtcccccttttttgttggccaaggggggccccaaaaaggcgaggcgcgttataaccaaggccagagcgcacccgcggccgcgccgagtgcaacaaaaacgcctcgtgcgcgcggtggcaacaagcgtgcggtgacggggggaaaccctttgcggggcgaggacgccccccctacctctcgggggcgggcgagcaccacaattttcggcggcgccacaccatctcccctaagcgaacggtatatacaccggccctctcagcggagaaattctcaaacatcttcaaggcagcgatactcggcggggtcacccccccaagcggagcataatcgcgttcgaccgttaagaaacgtctgcgcacccacggacattagactgtcggcgacactattttatccgcgagcgacggttataaacgcctacctcagcgcaccgccct

SEQ ID NO: 542984 - DNA, 293 bp, Homo sapiens
atgattacgctccgcagacgtatgctgcctatatgttccagcagaatctactcttccatacttaattcttttttgaaatatcttaaataatgaaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccct

SEQ ID NO: 542985 - DNA, 370 bp, Homo sapiens
  misc_feature (292)..(292): n is a, c, g, or t
  misc_feature (362)..(362): n is a, c, g, or t
gtgatttcaggtgatttcattgtgcaaatgtcatagaatatacttacacaaaactaggtggtacacacctaggccatatggtacgggctattgctcctagactacaaatctgtatagcgtgttactgtactgtaggcaattgtaacacagtggtaagtatttgtgcatctaaacatatctaaacatagaaaaggtacagtaaaatacaatattattatcttatgaaaccactactgtatatggggatctgtcatcaacaggaaatgtctttatgtgggcacatggactgganttacatccaaaccttagggttccattggctgtgtggaatcaggggacctcttatggtttaaaagggcacngtttgggg

SEQ ID NO: 542986 - DNA, 1856 bp, Homo sapiens
  misc_feature (1659)..(1659): n is a, c, g, or t
  misc_feature (1665)..(1665): n is a, c, g, or t
  misc_feature (1671)..(1671): n is a, c, g, or t
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaaaaatcaacacatncgaccncacaanaaaccacaagcggggagaacattaggcgacgcgcgcggccaaaaaaacgcgcccagcaaacgggccccccgcgccaacagaggccacacgggacgcaagacacagggcagcacaggggggcaacatcgcggagcaccacacaagcgacgagcgaacagtacgaaccgcgggggaaccggccgaaa

SEQ ID NO: 542987 - DNA, 1668 bp, Homo sapiens
agcgggttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccataaccgggagcaccaccataagatgggaggggtggggcggggttggggtggtggggggtggtgg

SEQ ID NO: 542988 - DNA, 382 bp, Homo sapiens
  misc_feature (20)..(20): n is a, c, g, or t
  misc_feature (40)..(40): n is a, c, g, or t
  misc_feature (73)..(73): n is a, c, g, or t
  misc_feature (109)..(109): n is a, c, g, or t
  misc_feature (151)..(151): n is a, c, g, or t
  misc_feature (160)..(160): n is a, c, g, or t
  misc_feature (176)..(176): n is a, c, g, or t
caaaagcccctttggcagtnggtcccccccccacccgaanggcccacccccagtcaacctacttttccgcctntctgtggcctatacgttagatttggaccttcagaantcctagagtttgaaataaataggcccatataatatgcactcnttttgtgtnctgactttttttttgncttaacatgatgcttttgaaacccacccatgttgagattcatccatgttatcatgtgtatcaataataagttcctttttattgctgaatagtattctagtatatagatataccacaatttgtttagctgttcacctattgatggacatttaggttgtttcaagttttgatctattatgaataaagctgctatatatataaatcaca

SEQ ID NO: 542989 - DNA, 861 bp, Homo sapiens
  misc_feature (622)..(622): n is a, c, g, or t
gactctgttccacattgcataacagggacccctaccatggtggagaccatcaaagatccctcgccacatcagctgtcttggctggatcactgtcatgtctctcaggtcatctttaccagtgtgggcaagttctactatccctggaggggacgtcacaatgtcattatagcttcaccgcagcatttcatccctacgtgcgaaaagcgatgggattggcatctcttagaggtgggagtggagagacaacggcccgttggagtcttcacacgcttcactgtggagtatactttgcccattgacctaacacaatcaaactcagctaaaacagctaggatagtcccagttcactagcttactagcctgcccaaggtagtgactgaagtattgaccagttctgctgatgtggatgcaaggcatggtgtggataccgggggtagcaaagatatgccttatcacaattccgtcccagaaaatgaggaagtacatctctggtgagtaaaccactcagggaagcaggtggaagagcatggagcagcacaatgcagggaggtgtgaagacgatacaccagggagctgatggacacaggtgtatcaggcctcccagaaaagcaagagcgtcagnacacttcaggggctggaactccaaaaggcaagcccggagggagcctgaagaaaccctacaggcggctctgctcacagcagtggcccggtacactgacagaaaccgacgcgccatgggcgggcacagctgggtcacctggagagaccacccgcaagagtcctcccacactccggacgcgcggatcccacgggccactttggccacgtggtcccccgcaatgagctcggcccgctttcggc

SEQ ID NO: 542990 - DNA, 422 bp, Homo sapiens
  misc_feature (1)..(1): n is a, c, g, or t
  misc_feature (3)..(4): n is a, c, g, or t
  misc_feature (6)..(6): n is a, c, g, or t
  misc_feature (38)..(38): n is a, c, g, or t
ncnngngcccggggagtcccgggggaatttaaaatccngcctcagccaacccagtagcagggatcacaagtgtgcacccccacgcccagccaaatacaggatacataggagagaaggggcttctgcatggtggccaggcaggccgtgaacaaccgaccaaagggaccacccggccaaggactaccgaagcgctgggaagacaggcgtgagccaccatgcccggcccactcaccatatatttcctgaacttcagtcatatgtgacgcagggaagacacacgaacagaaaaatcagggagatggagacggagctaaccacggaagccgaaaatagacggacagatggcccaaggcacaataatccggggaacacacaatcaggcaaccgaacctgacagggaaaacccggctgaaccaccccca

SEQ ID NO: 542991 - DNA, 288 bp, Homo sapiens
ccccggcccccccacccctccctcagcccaccagggtccagggagatgttcgttctcgctttaagtcaggagtcacaaatgacttttttttttcaattaaggaaaaaagctccatctcttacctttcaacatgcacccagatcccccgcccctagcccgtggccccaccgctgatgctaacgacagtaatgatagcttactcttgctaactcgagaaacccattctttaatgtaatgtaatgatatgcgtttacttgtattataaagtgccctgatattaaaaaagat

SEQ ID NO: 542992 - DNA, 338 bp, Homo sapiens
  misc_feature (274)..(274): n is a, c, g, or t
  misc_feature (320)..(320): n is a, c, g, or t
cttaatattcattcatttatcagatatttattgagcccctactattttccaggtactaatctaggtactgggaatacagaaacaatgtgaagtccttggcccctatattctactcaattagaaagacaattatgggccaggtgtggtggctcacgcttgtaatcccagcactttgggaggctgagttgggtggattaccctcaggagttcaagaccagcatggccaacatggtgaaaccccatctgtactaaaaatacaaaaattagccaggtntggttgtctgtgcctgtactctcagatactcggggaggctgaggcnggagaatttgctttgaac

SEQ ID NO: 542993 - DNA, 480 bp, Homo sapiens
gagactcttcaataagaggagagtggttaccctgggaaaccagttcacataaatgaagaatgctgtttggtcatttatggtcctggcccttgccccttgttctttctttgtgaagtgttcagatgagcgttttctttcatcttttagttgctcctttaaagctccaagtgatttttttaaacactgtgaagccctcacaatcaattgcttaaaatgtttctagaaattcctggtatcacttaaaaatagcttccgttttgtgctctagaaggttattgttgctgagtgccagcagctacattttagaattaaggcaggtttggccagattggtgtgcagtgtggagatgaagaatcccacccctgcaagacggagccacataagaagccagccgggggaacagatcactgtagccatctctgaaaagtgacagcgctaaatccttgtcctgcctttcttctctttccttccagtttttta

SEQ ID NO: 542994 - DNA, 1191 bp, Homo sapiens
  misc_feature (547)..(547): n is a, c, g, or t
  misc_feature (596)..(596): n is a, c, g, or t
  misc_feature (638)..(638): n is a, c, g, or t
gaacaaattcagaaagcaggaggcttgaaaacctccagtatcataattgctctgacagatggcaagttggacggtctggtgccatcatatgcagagaaagaggcaaagatatccaggtcacttggggctagtgtttattgtgttggtgtccttgattttgaacaagcacagcttgaaagaactgctgattccaaggagcaagttttccctgtcaaaggtggatttcaggctcttaaagcgaactaattaattctatactagctcagtcatgtactgaaatcctagaatggcagccctcaagtgtctgctgtgggggaggaatttcagattgtcttaagtggaacgaggattcatgctgggcagtcggaatggcagtgttctctgcacttacactgtaaatgaaacatatacaacgagtgtaaaaccagtaagtgtacagcttaattctatgctttgtcctgcacctatcctgaataaagctggagaaactcttgatgtttcagtgagctttaatggaggaaaatctgtcatttcaggatcattaatngtcacagccacagaatgttctaacgggatcgcagcatcattgttatttnggtgttactgctactcctggggatcggtttgatgtggtggtntggcccctttgctgcaaagtggttattaaggatcctccagccacaccccccctgcaccaaaagaggaggaagaagaacctttgcctactaaaaagtggccaaactgtggatgcttcctattatggtggtcgaggggttggaggacattaagaaacgcaaatggaggtacgttggggtgataaaggatctactgagtgaaggtgccaggctaggagaaagccaaaaaatgctgtggctgaagattcctgaagaaacagagggaacccatcaggcctagaccactcgaccaaaccatacacagcctcctcagacaaaatggtacaccccaattaagggtcgtcttgattgctcctatgggctttgttagaggcggcagtatgaacccggggttccttttgattgcgacctcaggaagggagatgagggcccgggtgcataaacttctcccgagttcccatctccagtaaacaggggaagcagggaagaccaagaagggtacgaagattgggcacatattccacattagctgattttccaaccacaactgccacaa

SEQ ID NO: 542995 - DNA, 197 bp, Homo sapiens
  misc_feature (72)..(72): n is a, c, g, or t
acgactcttccagaggcacagcacagcaggctccggccttgcctggcacaggcctggagtgtcctcctttcnggcccctgacagaaccgggggctcagggcagcaggccgctgggccagaaggagatggggagcccacggacacccctaaagcctacagtattctaccatgcccctaggcgcagggcagcagggcag

SEQ ID NO: 542996 - DNA, 177 bp, Homo sapiens
tacttttccacatggatatagggggttgatgtggagagctaaggaccaggactgcctccacaagacaggatgtggattatctgcccaaggagcctagtgagttaaaaatgtcaagtacggatagagcccggtggctcacacctgtagtcccagctactcgggaggctgaggcaggag

SEQ ID NO: 542997 - DNA, 183 bp, Homo sapiens
gagcaaaatgagattgattacagcggcctcagggttcaggcaatgcaaataagcagtgaaaggaagaagacgataattgttacagaaacccagaccagcgatgactagtggtgtgtataggcctcctcgggccaggttaaccacaaccaaggaaacaccacaaggccaccagaatctacagtg

SEQ ID NO: 542998 - DNA, 171 bp, Homo sapiens
tccagggaccccagtttcagggcccaaacaggtgggagtggaccccaggttttccattggaggtccctaaaaaactccccaagtttggttttcccgaagtttcctgctcagccctttttaaaaatggatgctttttcaaaaagagttaaagctataccctgtaccctttta

SEQ ID NO: 542999 - DNA, 551 bp, Homo sapiens
  misc_feature (151)..(151): n is a, c, g, or t
  misc_feature (155)..(156): n is a, c, g, or t
  misc_feature (159)..(160): n is a, c, g, or t
  misc_feature (166)..(166): n is a, c, g, or t
  misc_feature (170)..(170): n is a, c, g, or t
  misc_feature (173)..(173): n is a, c, g, or t
ctcgataaggccaatgtgactgtatttggagatagggcttttcggcagtaatttaggttaaatgaggtcagaaagatagggtcctaatctgataggattggtgaccttataagaggaagaaagagagacggctctctctccatgtggtggnccannganngaccanctcnagnctggagaaaagccctcaccagaagcggaatgctaccagaccttgattttggactttctaacctccagagctatgagaaaataaatttctgttgttggagccacccaatctatggtatttgtagaggcagcctgagctgactaatacagttgggtacccagccctggaaccaagaggtggagtcagccctgttcaaactgtgggaactgtgggaaggggtgtctctcccccaaggaaagtcatgttgctgcggctggaaaaagatggatgagatgttttgacatgcagagatgacagctggccacctcttttggataactctcttaacctatctttgcttctatctcccgatctataaaatggagtgctaccaaaaaaa

SEQ ID NO: 543000 - DNA, 986 bp, Homo sapiens
tggctggtactggccccgagttcgttaggatgcggggggcttgtgtgtcctccttccccctcccactgacaactgccccaactgctcttccctgccccggtcacagtgaaaatgtagatggggtctgtatgtccgtacgactgtgctgccagggctcggaggatgtgggcgccctccgctgtgatgcgcccccctgtggaatatttgaacataatcacctctcattccagactatgttagtgtcttaatggtggtgaggacgcccgagtgctcggcccgtatcagccctgaggaggaattgcacacttgggtcatgactgccatcagagtggctgccagagcaagggacctgtgacgcgatgttggagatgtagggactcgctgtatggccttggagcggccttggtgctgcttcgggattccgatggagtgggaggggcgcagatctcttgaaaggctgcttgatcaagaaatctgcacatggttgtaggggagcaagtgcatatccttgggcctgtgaccgtgagcgaggaaagagtttcggtgacaggataagactctgatatcgaacaaatcggctggtataccatgacttcttcagagaccctctcaactggtcgaaacatgaggaggccttacctgggagggccggcatgggagcctatgaggagaccatgtgcatagaagacaggatcctgatacactggaaaccaattgatcatcagagtacaactcaaggttgcagtgctactatcgaccattccatgcaacaacagtacatgccaagggttacatgaaatgcataggagcagcacgattaaagagaagctccattgatacagtgggtaaccaaacatacattacaatgggggcaaagtgagcatgtgcatggggctatggctacattgaagacgcttaaatgcaccaggaaccatgaggaacactaagcagcaatgatcagagctgaagagacccaggccagaaca

SEQ ID NO: 543001 - DNA, 464 bp, Homo sapiens
  misc_feature (105)..(105): n is a, c, g, or t
gtatcaacgcagagtggccattacggccgggggtttccgtagtgtagtggttatcacgttcgcctaacacgcgaaaggtccccggttcgaaaccgggcggaaccnaccactaaaaaaaaaaaacaaaaaaaacaaaaaaaaaaactggtgggcgcgccgccccgggcccctggaaaaaggttttcaaaaaccaatcgggtgggggggggggggcccaagagggtaagggaaactggggccaaaggcgggtgcccaaggagaaacccggggccaaggacaaggggcgggggatcctccccacataaaaaaaggcccgggggggcaaccggaggggtcctgaaacaaaatctccggagagggggtttggggagggccaataagggggactcttatcaaaggggggtcccagaggggagccccgatttccaaattaggcccggcgcgggggaaacaaccacgacgaa

SEQ ID NO: 543002 - DNA, 314 bp, Homo sapiens
acagacatccagggcccaatatgacgagctggctcggaagaacacgagaaggagctacgacaagtactggtctacagcagattgcatggagagcaccacagtggtcaccacaacagtctgctgaggttggagcagactgaaacgacgctacacagagctgagacgtacagtccagtccttggagatcgaactggactccatgagaaatctgcaggccagcttggagaacagcctgagggaggtggaggcccgatacgccctacagatggagcagctcaacagggatcctgctgcaccttgagtcagagctggca

SEQ ID NO: 543003 - DNA, 481 bp, Homo sapiens
tcagacacaaactgaacctacacattgacttacctggctctccagattgccaatttcaaatctctctctcaggacaggcctggtggctcacacctgtaatcccagcaccttcagaggccaaggcaggtggatcacttgaggtcaggagttcaagaccagcctgactaacatggtgaaaccccgtctctattaaaaatgcaaaaattagctgggcatggtgatgtacccctgtaatcccagctacttaggtggctgcagcacgagaatggcttgaacccaggaggcagaggtggcagtgagccaagatcgcgacactgcactccagcctgtgtgacagagcgagactctatctcaaaaaaaaaaaaaaaaaactgtctctctgtctatacacacacacacacacacacacacacacacacacacacacacacacacacacacacacaggctcttgccccaggatagaagctgcccaaaaact

SEQ ID NO: 543004 - DNA, 377 bp, Homo sapiens
acacactcataaacatatacttctcatgccccctgcgaatatcaaagatgtgcaaacattgtgttgaacaagcagtatctaggtgcactgagtgtatagcaacttaggacaaatcaacatctaggcctttctcctggagacccttggcttggcatgacagtatagaatctgctgacctgctaggttttccaattagcttccacaaaatagtagaccttgagtaggagagaggaagagaactatgggagagatcagaatagctttgctccctttgtaaggaatcagtcttggtgagatacctgatagcccagtcctagccactgggggtatgtcaggttcagcaacaggagcgtatgtcttggagatcccccatagat

SEQ ID NO: 543005 - DNA, 907 bp, Homo sapiens
  misc_feature (52)..(52): n is a, c, g, or t
  misc_feature (88)..(89): n is a, c, g, or t
  misc_feature (91)..(91): n is a, c, g, or t
  misc_feature (107)..(107): n is a, c, g, or t
  misc_feature (114)..(115): n is a, c, g, or t
  misc_feature (119)..(119): n is a, c, g, or t
  misc_feature (132)..(132): n is a, c, g, or t
  misc_feature (165)..(165): n is a, c, g, or t
  misc_feature (172)..(172): n is a, c, g, or t
  misc_feature (202)..(202): n is a, c, g, or t
  misc_feature (208)..(208): n is a, c, g, or t
  misc_feature (225)..(225): n is a, c, g, or t
  misc_feature (235)..(235): n is a, c, g, or t
  misc_feature (242)..(242): n is a, c, g, or t
  misc_feature (253)..(253): n is a, c, g, or t
  misc_feature (262)..(265): n is a, c, g, or t
  misc_feature (286)..(286): n is a, c, g, or t
  misc_feature (291)..(291): n is a, c, g, or t
  misc_feature (294)..(294): n is a, c, g, or t
  misc_feature (302)..(303): n is a, c, g, or t
  misc_feature (310)..(310): n is a, c, g, or t
  misc_feature (313)..(313): n is a, c, g, or t
  misc_feature (328)..(328): n is a, c, g, or t
  misc_feature (338)..(338): n is a, c, g, or t
  misc_feature (342)..(342): n is a, c, g, or t
  misc_feature (346)..(346): n is a, c, g, or t
  misc_feature (351)..(351): n is a, c, g, or t
  misc_feature (354)..(354): n is a, c, g, or t
  misc_feature (360)..(360): n is a, c, g, or t
  misc_feature (366)..(367): n is a, c, g, or t
  misc_feature (372)..(372): n is a, c, g, or t
  misc_feature (383)..(384): n is a, c, g, or t
  misc_feature (411)..(411): n is a, c, g, or t
  misc_feature (413)..(413): n is a, c, g, or t
  misc_feature (418)..(418): n is a, c, g, or t
  misc_feature (431)..(431): n is a, c, g, or t
  misc_feature (436)..(436): n is a, c, g, or t
  misc_feature (459)..(459): n is a, c, g, or t
  misc_feature (465)..(465): n is a, c, g, or t
  misc_feature (470)..(470): n is a, c, g, or t
  misc_feature (488)..(488): n is a, c, g, or t
  misc_feature (507)..(508): n is a, c, g, or t
  misc_feature (550)..(550): n is a, c, g, or t
  misc_feature (583)..(583): n is a, c, g, or t
  misc_feature (603)..(603): n is a, c, g, or t
  misc_feature (642)..(642): n is a, c, g, or t
attagttagtttgtactaataaattctcatattacataggcaatttaatggnagaatcttccttttgatatttgaatcatctgaaatnncncaaacagaacaatacnttcaaannaatntcatttgcttaanaaaaagacaagttaaacaacaaaaaaatttttnctttctnacaggtggacattgaagtggacctaattangttttncttttaaaagccccgcnaacaaaagtngtttaanacctatttaanatgaataannnnttggtttactaaactactggnctccngcnccattttnngttttcngtngtttgggtgcgggtncttctttgtntgtntctnctctngcncttttnaggggnncagtngggccattttnntcatgttcatcatgttcatcatcgctngngaatntggttttcttgcnctganactgtacttttcctttaccaganccaggntgggnagctttattaccctttcnttttcctttaaatctacgnncttttgacttccatttgtttagggattcttgttggtcttctnttattttcttcagtgcttctttttccacctctncttctagtacttcccaagtnacttctttgttccttaattgtaggttaccattatttgcntctttggctttacccaatgcttccttggctttttctttaaatagaattatcccctcttttgctcctctgacgaagctaatccattttatttcaccatgatttgagaaaagtatgtgtaaatcttctctacaggtctgatcatctaaatcacccgaaaatttcagcaagcatccaatcttttcttctagagatttcatttcagcatcttcttctaacttttgttttgcttcttgctcctgtttagctcttaatttagcttccactt

SEQ ID NO: 543006 - DNA, 270 bp, Homo sapiens
tggagcccaggagacactggagcaggccgagaagagggccactgactgctgaggcagatgtggcctcgctgagccgccgcattcagctggttgaggaggagcaggaccgggcccaggagcgcctggctacagccctgcagaagctggcggaggccgacacggcggctgctgagagcgagagaggactgacggtcatcgaaaacccgggccatgacggatgaggagaacgatggaactgcaggagaatgcagctggaggtggcgccgcgcg

SEQ ID NO: 543007 - DNA, 505 bp, Homo sapiens
aaatgatatatttgtattgtgggaaaaagacaacttttgataaatagaagaacatttacatcagattacctcccagtttttgcttagacttagaattaagaactatttataaaggaactatttgattttaaagtaatattgtaatgatacagaatagtacggcagctcactttccgaacttgagggagataaacataatttccattaagaaaatcttgaggccaagtattgtggctcactcccgtaatctcagcactttgggaagccgaggtgggaggatcgcttgaggccaggagtgcgacaccagtctgggcagcctagcaagactccgtctctacaaaaaattaaaaaatgagccaggcacggtggcatgcgtctgtggtcccagctgctttggagactgaggctagaggatcgcttgagcccagaaggtcgaggttgtggtgagcaatggttgtgccactgcactccaaccttggtaacagagtgagccactttgtctcca

SEQ ID NO: 543008 - DNA, 170 bp, Homo sapiens
gactcatcattggagtgacggggctgggagggctgcagaaggttgcgtacatgggaggcaaaggcgtggagatcacttgaatccgggaggctggagtgttgcagtgatccgagatcccctcactgcactccagcctgggcaagagaccgagactccctctcaaacaaaaa

SEQ ID NO: 543009 - DNA, 139 bp, Homo sapiens
atggccggtcctattatcccaacaccactcctcttagcaatatgtgctatgccatactagtcttgccgccgcgaagcagggtgggcctagccctactagtctcaatctccaacacatatggcctagactacgtacatca

SEQ ID NO: 543010 - DNA, 170 bp, Homo sapiens
atacccaccctgttcttctcctaggaagtgctcggactccctggtcaacaatgtcacgtttagctgctcaatgccctccgctaccatactgtgcagcatgctagtcctgactgtatgagctgaaacacggcatgatcctcttcccaagcccagggatccttcagcttcaa

SEQ ID NO: 543011 - DNA, 261 bp, Homo sapiens
  misc_feature (38)..(38): n is a, c, g, or t
  misc_feature (107)..(107): n is a, c, g, or t
  misc_feature (164)..(164): n is a, c, g, or t
cccttccaacccccacttggtattacagactcatcacnaaaaccctctggaatctttggaaagaaaacactggggctgagtacacaatgcccccctccacccaaccnacactaccatcatgcatacaacataggaatgttccagaggcatcctagcttcaaacnacaaagcaacttgtctgctagcatcatgcggttccaccagaaagacaggaaacccagagcatatctagatgcatgcattttctgagtgatggggccc

SEQ ID NO: 543012 - DNA, 238 bp, Homo sapiens
  misc_feature (17)..(17): n is a, c, g, or t
ttattaagcaatatgcnctaagacaaaggatatggaaaaataaaaacttttattcagaacacaatgaatagatatgtttatacaatacatagtatgagttaaaagtcttgggtaagatatttgaaaaaaaataatcaagattcggaatatcttgatcttgattaattttaatagcaagagaagcttaaataataaggttcttgtagaaagagtttgaagaagatacttggaaaaaaaa

SEQ ID NO: 543013 - DNA, 339 bp, Homo sapiens
cgtcctcagctgcaatggcatcatgtatgatctgtgtttgtgtgtataattttcaatacatgttgggtttctatgatagatttgtgtatatcttatggcagtaatgatacaatggactaatatccacattttatgcattatgacgtactaaacttcttaattttttcaatatttctagactacacagtctgcaagttttttttttttttgagagggatttttgctctgttgcccaggctggagtgcaggtggtgtgatctcggctcacgtgcaagctccgcctcccagtttcacgccatttctcctgcctcagccttcccaagtttgctaggaccatcg

SEQ ID NO: 543014 - DNA, 296 bp, Homo sapiens
agaggataggctcaggggattacacctgtaaccccaacactgcgggagactaaggtgggaggatcacttgagtttggagttcaggaccagtctgggtaacatcttgagaccctgtctctataaaaataaaaataagaaatcagccaggcctgttggtgtgtgctgtaatctttagactactcaggaggctgaggtgggaggattccttgagcccaggagtttgaggttgcagtgagctatgattgcaccactgcactccagcctgggtgacagagcaagaccctgtccctgtctca

SEQ ID NO: 543015 - DNA, 140 bp, Homo sapiens
cgtaaaagaaggctttttttgttttaatttttgggctaacttccccggtgtacattatttaaattgacaaaaattgctccttttgggttgacacacccttacaaagttttttgcttgttacagaacattatacgccgcac

SEQ ID NO: 543016 - DNA, 408 bp, Homo sapiens
tctccagtaggaaagggtcagatcaaagatcctctgcctccgcttaaaagtgatatagttatgctttgcacgtatttacctggtgtacagtaaggatagatccgtgaatagcatgagtagtatgagaaaggggccgtccaagagatgaacaacctgtagtccaagcgaccagtggagcctcatgcagcccattatcatcagtgctcagggcctaatagtcattctgacatctgttcatgtaaatcacaatcaaagtgaaaggtggtggtatggacggctaatttgatcctcctgtgtattcaataaccagcctacaggaatgagctagtgctattgaacggtttaaaatattccggggttaagagtgcccattgaggatctttttccacactgaaatcattatgaatt

SEQ ID NO: 543017 - DNA, 253 bp, Homo sapiens
tacgccgccgcaattgcggcgttcgcgcgccccgggaggacgcatgtccgggtatctacctgttctgatcttgttcgtcgtcgcgctcacgatcgcgttagccgtgatcgtgctcgtcgcgttccttgggccgaaacgtcccaacaagtggaagaacgcggtgatcgagtgcggcgttcctccctcgggcgacgcgaggaaacgcttctcggtgcgtttctacctcgtggcgctttcgtttctcttgttcggc

SEQ ID NO: 543018 - DNA, 151 bp, Homo sapiens
accttagaggaccccttcgactagcctgacaggcacggtgtgggatagtgacttctctaccggtcagagctaatggtcgtccgaccaccagaacaaccctcattcccttcatcgtcgcccggatccagagtctgtcggactagccgggggc

SEQ ID NO: 543019 - DNA, 150 bp, Homo sapiens
tcgatctaccgatgcttaagcatcctaacagagaacatggcactaaaatttttgtctgcttacaaaaacttacctacataaccagtttagccacttttccagtaagatttcaaagtaatattcatttcctttttcctgtagcccagaaac

SEQ ID NO: 543020 - DNA, 123 bp, Homo sapiens
acagattagagtgacacgatcagactgttacatttagcaatcacagcatggggtgcaaaaaaaaaaaatctacattaaaacccttggtgggaattgcttaacacttttccacagatacagaaa

SEQ ID NO: 543021 - DNA, 210 bp, Homo sapiens
gggccccaaaggggggaacaaaaagggggggggtttcccccccccccccccttgggaaaaaagggggttttttttttttcccccccccctttttcccccccccccgggggggggcccttttggggggggggggggggccccaattgggccccccctaaaaagttaaaacccccccccaaattttttttttatttaatttttggtttccca

SEQ ID NO: 543022 - DNA, 570 bp, Homo sapiens
  misc_feature (55)..(55): n is a, c, g, or t
  misc_feature (71)..(71): n is a, c, g, or t
  misc_feature (86)..(86): n is a, c, g, or t
  misc_feature (97)..(97): n is a, c, g, or t
  misc_feature (110)..(110): n is a, c, g, or t
  misc_feature (121)..(121): n is a, c, g, or t
  misc_feature (140)..(140): n is a, c, g, or t
  misc_feature (143)..(143): n is a, c, g, or t
  misc_feature (149)..(149): n is a, c, g, or t
  misc_feature (166)..(166): n is a, c, g, or t
  misc_feature (240)..(240): n is a, c, g, or t
  misc_feature (243)..(243): n is a, c, g, or t
  misc_feature (254)..(254): n is a, c, g, or t
  misc_feature (289)..(289): n is a, c, g, or t
  misc_feature (298)..(298): n is a, c, g, or t
  misc_feature (305)..(305): n is a, c, g, or t
  misc_feature (310)..(310): n is a, c, g, or t
  misc_feature (340)..(342): n is a, c, g, or t
  misc_feature (371)..(371): n is a, c, g, or t
  misc_feature (430)..(430): n is a, c, g, or t
  misc_feature (442)..(442): n is a, c, g, or t
  misc_feature (495)..(495): n is a, c, g, or t
cagttttggatataactatttggaaggagagtagacatgaagagggcaaaccctngcttttcattatctanaatcaatagtttgtntttcttttttnaaaaagaaagaanaaccctttcantcttcaatactctttaaangcnctcttnttagctactggccaatncacaccaattatttaaattcacttggtacacacctttgtccactgggtaccttatattccttatgccccctgcngcngcgcgcctaanccaccacccctgcctggctgcgcagggcctaatcnggggctgcnggggggngggcntgccaaccaggatcagggtgtttctccgcnnnggctgtctgccaggctggtccctacgagnaggcatatgaaagccggcaagtttagctactgtgttgcaagagaagccaggaccttgtnaaataggtctcnccattaccatttattctctcaagggaagcttaaaaaaaaaacaacaacaaaanggcacattggtctggccacctcatgaatccaacaagcattagtgtggcatttcagtggagaaggaaacttggggg

SEQ ID NO: 543023 - DNA, 1060 bp, Homo sapiens
  misc_feature (413)..(413): n is a, c, g, or t
gggaaggttgaagggtttgttcccagtcacacaaccaggaatccttaggacagtcagaccaggaaaccatttccaaactgccaagccatggcgagagatagtcaagatcctcaggaaccagtcgagcatcaccatggaagcattgggaaaagcctccttagcatttgtgaagcgtccttcaattggtatcttgagttgtgcagtggagcccagtgactgcggggcttttgtagacaccctctagggattacagtgactaggtaccccatgacaaacgtcgaatggcgtgctgggaccacacaatgaggtccgaggcattctctaggggtgccatcgttagggcgccaacgcatgcgtgcgtgggctagttcgggagaatgtccccccctatttacatggcgcccatcgacatntctccttttcctttcccatgtgctgtaatgcgtgagcgagagtctcacggtaccagtctcactaagagagagggtgccacaatggggcgactgagacagcgacggacgttgggacaggtgtcatagcgaagagggacataatccgttcacttgcactgggggtgctaggaactcactggcgtcacctgcacgggggcccgttgatgttgaacagggtgtccccgttgtcaggacgagtaatgcggtttcaccccatccttgaaatttttcccaggggtggaatacacggccccatgttcataggggggaactgttgccaagttcccctaattgcaagcgaacgcccttctagcaacccatatgaatgggcccaaagtttggggacgaaagcccattggctcgcagggcagaaagaaacacggggtttcatgatcgactaggcccgctccaaaaagagaaacggtcacccgtcgtcggaacaggcttgggttcgcccgtaataccctagggccgcaccttaggatagccgggagatgaaacattggggggcccctatttggcgctcccgcaacaggcgggcaaattttctcacaccacccccacagggatgttgcccctcgcagcaatagagggcaacaagtggggag

SEQ ID NO: 543024 - DNA, 242 bp, Homo sapiens
aacctggggcccctgtttgtatgacacctcgattacgtgaactgactatcaactcctaaaggacctagtaggacaggcatccaaatgctgatgggggtgagggtggcaccagaggtccccatatcctggcaagacccactggcttcgagtggctggtgggacgagaaacacatgctgccctacttttcagctaatcatggcgctgacccaatgagaactcaccactattcttcattatcccc

SEQ ID NO: 543025 - DNA, 196 bp, Homo sapiens
agcgttggacacataaataggttatataactggtgattaggtgggtgtagagaagcaagttaaaaggctaaatggaagggcaagtttccatcatctaatgaaagatactataagacaaggactccccttattaatacctcaaaggcattgtaaaaagaattgatttatagacggagtctcgactcatgtcgccagg

SEQ ID NO: 543026 - DNA, 105 bp, Homo sapiens
agcattcgatcacctatagaaggtcaggtatgccagaatggtccaggtattccagaaggtccaggtatgccagaaggtccaggtatgccagaaggtccaggtatg

SEQ ID NO: 543027 - DNA, 106 bp, Homo sapiens
atgatgagctcggtaccacatgattgatcaccgctctatagccaagtgctcagatataattatatacatagttaccatttatttggcacttacttcaggagcggtg

SEQ ID NO: 543028 - DNA, 507 bp, Homo sapiens
  misc_feature (224)..(224): n is a, c, g, or t
ttagagatcccctcgaatcgacggtttctttcctggcaccctgtctcaggtgcacacaggctgcattcccccgacttcccatctcctgggagctccagcttggaacttctcttctcctagcgctaatgattcccagctcttgaatttcagcttcccggttcgtggagcttttggagctcggagcaatgctctgcctcccggggttcacgccaattctccagccntcaggcaccagaggagctgggactacaggcgcccgccaccaggcctggctaagttttttgtatttttagtagagacagggtttcaccatgttagccaggatggtctcaatctcctgacctcgtgatccacctgcccttgcctcccaaagttgctgggattatgaatgtgagccaccatgccttggcccttgtaattttaaagttctgggtgacaacttcaatatttggataccttctgaggttggttttaattgatcgtgtataagggtgggttggtcctatt

SEQ ID NO: 543029 - DNA, 1075 bp, Homo sapiens
ggggttatgcacatgcaatgccttagaaacttcttccatcctatttccatgtcgtaatgctcactgggtaagaaggcaaaaccgacttgagtttttaaacacatgaaaaatttttcatcgctggaattggcggcctacctcatagggagctccccacagtgttccatcagcgttcaaaatttttgcctggggaactgggccttgccggaattcaaatggatgcccacctattgatatgatcctcaagaataggaccatgttgtgtcacgcgtgatattaggacattctgccccttgtgtgaccctggttaacaacgtcaaggggacgcccaaggcctttcccttaccctttctttctccttgtgaactttccagaatcccacccgtccgtgcttcctctagttcacactgtgcatgatgcgcctatgaataggcaagaaagtaggtggtttcctcgctgtactcctagcctgtcctgccgtaaaggattatggtatggagaacatgtcaacacacaactctacatgagtctgcaactgcacccaacatctggagggcacacacgtaccccgcacccgaggcaactgccatgacagaaagctcgctccgctactccaatatgggactcaggcaccccagcatgagtcctagacaagtctgcatcgcgaccgtggtattgatatgtcagttgctgcatcatccagggatacctctcaagctggactgtgggttccaaacttactcatagaggagaaaaccagagaaagatgaagaggaggagcttaggtctattctcaaatgcccaggggctacgtctagatgaggaataaggctgataataagaaactatttcaccagccatttgagagactagacatgaccccacccttctcttcagcgagcagaatcatctgtggtcagtctcaatgtcccagcattcagttcactgaatactcactgttcctccagtttcccatcctttgtcatgctgtcaccccacttagtaaagataagggtctcaacccctccccaccacgtctatgatggaatacgcacaggtggtgggactaaggggg

SEQ ID NO: 543030 - DNA, 365 bp, Homo sapiens
  misc_feature (6)..(6): n is a, c, g, or t
  misc_feature (12)..(12): n is a, c, g, or t
  misc_feature (20)..(20): n is a, c, g, or t
  misc_feature (26)..(26): n is a, c, g, or t
  misc_feature (34)..(34): n is a, c, g, or t
  misc_feature (49)..(49): n is a, c, g, or t
  misc_feature (105)..(105): n is a, c, g, or t
gaaatnccggancctggttnaaaccngaactccncggttttggcccttntcctaagaaatggtcaataataaatgggaaaatgtaacaagtatgtagctttttcnagactggcttttttcaccttaaacactatgcatttaagattcatctgtgacttgtccctggtttaaatggctcattttcttttttggtgggcgggtggagagacagggtctcactctctcacccaggctggagtgcagtggggcaatctaggctcactgtagctagcctccacttccctggctcaagcaagcctctcacctcagcctcccgagtagctgggagactacaggtgctcgccaccatgcccggccagtgtttt

SEQ ID NO: 543031 - DNA, 220 bp, Homo sapiens
ggtgattgacctcagagcagggcagttcacagctctaattatttgggtctaatggcctcggggcccaagggtaggtgaggtgataggcacagattttcacctaaaattagcagaggtgaggcctaggaattttggggttatttcttcaatcaagccttcaaaccccctagaccttttgccaggggaccaagcctgagaataaacgaacctttgcgtacca

SEQ ID NO: 543032 - DNA, 692 bp, Homo sapiens
tgtagagcaaggaagcacttcttcccaagagggtcggagaaggaaaagcctctgggagcacattctgctgtcatcacagtccttggcttctactgggccctcctctcctacctacacagctactcacctgtccaaagaggcatctggattctctcatgtggatggatggactctggggtacctcttgggacgtggcaatcccatgcatgctgtattctaaaccctctctgatcaaaccagagcctgcatcccagatgagcatctgaactgtcctcagggagcagagagccacacagcctatacttacccaactcatatctagaccagctacaaagaattccatgagttatacatacgagtcactgtgagtggagcccatgctagggctactgtgccctactgtgtactagtgcatgcgacgtggtgtagtgtaggagcgtgctgtagcatattgcttgggccagcttgaagtggaagtgccacgtcatgtccctagccactctagttatagcaaagatgccaaaaacccagttctagatgtgtggctccaacagccaaggctgtggtcccttatgacgttcctcacctagttagccaacctatcccgtagatgaactgaaaccccaatgaagacagaactgtgctgtgggagcatgcaatgatgtgagggcttgaactcatctttaatatac

SEQ ID NO: 543033 - DNA, 414 bp, Homo sapiens
  misc_feature (252)..(252): n is a, c, g, or t
  misc_feature (263)..(263): n is a, c, g, or t
  misc_feature (290)..(290): n is a, c, g, or t
  misc_feature (297)..(297): n is a, c, g, or t
  misc_feature (325)..(325): n is a, c, g, or t
  misc_feature (330)..(330): n is a, c, g, or t
  misc_feature (361)..(361): n is a, c, g, or t
  misc_feature (397)..(397): n is a, c, g, or t
tctagcacagccaatgctaagaaccacttcaccaatccaaattcacaaatatcagccaggtacaatattttgatactaaaacctgcctatgcctactatatagagcatatataggcagcagctccaggccctggggtacaagccagtgtcatgctggctgggagacccgcagaaactgtccagagtcttgccagccctcagatttttaggggaccaaaggaccatggcaactcctgggggaacacagtgttntgtgggtcttngggggtgattttaattcttgcacttgnttaaggntcccagttgacccaggccccgagttgantcttncccccctctgttttggaaaattcttgttatnctttccccaggcttgaggggaaggtttttgggtttngaaagagttttttaggg

SEQ ID NO: 543034 - DNA, 909 bp, Homo sapiens
ggctgaggcgggaggatgcttcagtccaggaagttcaggctgcagggagctatgatcatgccactgcactccaacttgggtgacagagcaaggccctgtctccaaaaaaaaaaaaaaaaaaccccttttaatgggattgaattttaagctaatttggactctatttttttattcccaaattcctctttggtaattaacctttgggcaaattttgtgtggatttataccgggggtataagggccctgggggtgatgtggaagtttaggggcaaaatggcatacgggttccggaccttctaagaagcttacaatctggtctggtatgtgtgaggggaaataatggctagatgccatttatggagtccatactcgggtgccgggcaccatggggttatactcatttaacttctatatccttacggtcatccggcaaggaagggtgcattaattttttcccatttttacaggattgaagagacaggaaggtccagagagggttaagaaaccaaagccaagggtttcggggcattattaggcaaagaagtattagtggactaactttttccgtggaggtggtttttaagaaccagaagaaataatgagataaagaaaagaaaaattgtggggggcgcagttgggggccttagggagaagttttgtataaaacacatgggtgggggggcggcgcggggccccagtaggtgacaagcaaacacatgtggggcaaaaagcgggtgcacaaaaggaaagaccccggggcaaaagacaagaggggcggggagggtctctccccaaaaaaaaaaacccccgggggggaccccgagggctgtggagaacaaccaagagaggagggcacggggagacaaagggagacaacacaggggggtccaagggagccgaataaagacg

SEQ ID NO: 543035 - DNA, 181 bp, Homo sapiens
  misc_feature (14)..(14): n is a, c, g, or t
tctctactccaggntctcagctcagacggttgaaaaaataaacagacttttggagctggggcctgggctggcgcaggctgtgaagagcctgtctgccaccccactgttccaccacacttcagaccacctcaccccggccctctgtttgtcttaggccctactcgaatccccagttgctttc

SEQ ID NO: 543036 - DNA, 733 bp, Homo sapiens
  misc_feature (3)..(4): n is a, c, g, or t
  misc_feature (8)..(8): n is a, c, g, or t
  misc_feature (15)..(15): n is a, c, g, or t
  misc_feature (21)..(21): n is a, c, g, or t
  misc_feature (82)..(82): n is a, c, g, or t
  misc_feature (84)..(84): n is a, c, g, or t
  misc_feature (86)..(86): n is a, c, g, or t
  misc_feature (124)..(124): n is a, c, g, or t
  misc_feature (180)..(180): n is a, c, g, or t
  misc_feature (252)..(252): n is a, c, g, or t
ganngcancacaganaacatnagagagccgtgctctctctataatgtgtattgtatatgagacacatctatatatctacatntntntatctctggtggtgctctctcgtggtgagtgaatacanacaaacacacacaacaaaacaaactctctttgtctgctgagaatacgagactgttnttctaacacaaacacaccaccacctccacgcggtgtggtgcgcacacagtgtgtgtgagaacacacagcaanactcttcggcgaacgcctttagagcgcgagtgttttattggcgcgagaaataatattctataaacaaagaaagagggccacggaggtgttaatatcttcgtggtataaattatttaggttgtgaaaaaaaaattttaaaattgtgctcaataacccttaataagaagggggttttaaaacgcccttcctctcgggaaaaaaaggggtctatttattttatgccgcccctttaaacaacaataaaaggcgtttgggtggtataaaggaacaaaaaatcctcgttttttacttggggggaggggcaacaaggaacattaaaaacaccttgttattttatttttgcgggggcccgaaaaccctttttttttaaaaaaaaaagagaaggggcccctcttttttttttttaaaaaaacattttgggggcgaagaaaaaaaaccccggggtctctttgaataaaaaaaccaacaacaccccccggcg

SEQ ID NO: 543037 - DNA, 107 bp, Homo sapiens
aacttttatgggttatgggggtgcagaggcattaggctgtggggtggggaggtcctgtgttccatatagaggaaccccaaataataaaggtgctttttttgtctgtg

SEQ ID NO: 543038 - DNA, 1450 bp, Homo sapiens
  misc_feature (466)..(466): n is a, c, g, or t
  misc_feature (1261)..(1261): n is a, c, g, or t
gcaccactgcactccagcctgggcaatagagccagccctgtctcaaaaaaaaaaaaaaaaaaggccacaatttaaatttggaagggctctcaaaatttttctactttcacaccagggaattgttccaaattgttctccaaagcgccgggtcatttttcttataccgtgctttggaccaacttaaattaacccttctaagatgtcttcatatttgttgtttttaaattggacaatctcaggttaagaaacattttgcataaactttggggacttgtgaaacaaaacatctccttgtgggtgtgtctctccaaggaaattctacttcacaattagggagggcaatgtgagggagggataatatagtggtggatataaaccacgcttttaaaaatttctcgagtagaactgtgcaccgagtgtgtactataagtctctataaacagagtgtatattgtgagaagcactntgattcggtcataaaaatttgttctctgtctctcgccaaggtttctccccccaaaggacgggtgtttctatatttctccacagaaatctgaggccgctctcaagtttgtctcggctccggtggaagaaaaaaatccgctgtggaaacacacatttcttgtgacaaaaacacgagttgtcgcttatatgtataatgtgcgccatattactctatgagtggacagttgaaaacagagtgtgtggggggatacttctcttaaagaggtgcgttaattgcgggggtcattccgaccaaaattgtgatgatctctcctcccgaattattgatgttctcggccgtttgtgtagaagaaaaacttttttttccacgatctttttttaaaacacaccacaaccaagttacaacacgggcggggccgacaatacaatctgcggcgcgaacacaccggggggaaaaacaccccactctctctatcacgcttgggcgcgtcccccaaggggcggatataatatacccgcgggcggcaagcacaaccatcagagccatagagggggggcgcccactcgtggggaggggcgaccaaccctgggtggcgacccactttgtggcgaccgagaacaagcgcccacccacggaggaatgtcttgggggcaaccaattgttggacacagcactgttggtctttcacaaggtgtggctaaacacaggggccccccggtgaaagaaagctcgccaatagctggccaaaaaaaagggagcgacatccttcttaccacagcggacgggcggcggtcnacacacagctccgcaggacaacaacacaactcggtctttttctggacacaacaagaactcttttgtggagcgacacctccccaactattagtggcgagcaacagcattcagagcaacaacacactaagggcacgggagggcaaacctagcctggcgaaccaccacgtgcggcactattacagagcacac

SEQ ID NO: 543039 - DNA, 928 bp, Homo sapiens
  misc_feature (32)..(32): n is a, c, g, or t
  misc_feature (104)..(105): n is a, c, g, or t
  misc_feature (107)..(107): n is a, c, g, or t
  misc_feature (109)..(111): n is a, c, g, or t
  misc_feature (114)..(114): n is a, c, g, or t
  misc_feature (252)..(254): n is a, c, g, or t
  misc_feature (261)..(263): n is a, c, g, or t
  misc_feature (265)..(266): n is a, c, g, or t
  misc_feature (275)..(275): n is a, c, g, or t
  misc_feature (279)..(279): n is a, c, g, or t
  misc_feature (285)..(285): n is a, c, g, or t
  misc_feature (288)..(288): n is a, c, g, or t
  misc_feature (290)..(290): n is a, c, g, or t
  misc_feature (292)..(292): n is a, c, g, or t
  misc_feature (297)..(299): n is a, c, g, or t
  misc_feature (302)..(303): n is a, c, g, or t
  misc_feature (306)..(306): n is a, c, g, or t
  misc_feature (308)..(308): n is a, c, g, or t
  misc_feature (314)..(314): n is a, c, g, or t
  misc_feature (318)..(318): n is a, c, g, or t
  misc_feature (320)..(320): n is a, c, g, or t
  misc_feature (327)..(330): n is a, c, g, or t
  misc_feature (341)..(342): n is a, c, g, or t
  misc_feature (344)..(344): n is a, c, g, or t
  misc_feature (347)..(347): n is a, c, g, or t
  misc_feature (354)..(354): n is a, c, g, or t
  misc_feature (366)..(366): n is a, c, g, or t
  misc_feature (382)..(382): n is a, c, g, or t
  misc_feature (385)..(385): n is a, c, g, or t
  misc_feature (389)..(389): n is a, c, g, or t
  misc_feature (392)..(392): n is a, c, g, or t
  misc_feature (396)..(396): n is a, c, g, or t
  misc_feature (399)..(399): n is a, c, g, or t
  misc_feature (410)..(410): n is a, c, g, or t
  misc_feature (416)..(416): n is a, c, g, or t
  misc_feature (418)..(418): n is a, c, g, or t
  misc_feature (430)..(430): n is a, c, g, or t
  misc_feature (442)..(442): n is a, c, g, or t
  misc_feature (455)..(455): n is a, c, g, or t
  misc_feature (469)..(469): n is a, c, g, or t
  misc_feature (473)..(473): n is a, c, g, or t
  misc_feature (502)..(502): n is a, c, g, or t
  misc_feature (504)..(504): n is a, c, g, or t
  misc_feature (612)..(612): n is a, c, g, or t
  misc_feature (640)..(640): n is a, c, g, or t
  misc_feature (668)..(668): n is a, c, g, or t
  misc_feature (679)..(679): n is a, c, g, or t
  misc_feature (706)..(706): n is a, c, g, or t
  misc_feature (713)..(713): n is a, c, g, or t
  misc_feature (914)..(914): n is a, c, g, or t
atatacttggcatacgtgaatattaatctacnccttttcctatcacttttaaaattttatactatgtactttgtattaaatagtacagtagtttcagtaagagnngngnnnttngccattttaaccaccttaaagtgtacaattcagtgacatttattatatttacaatgttgtgcaaccatcaccactaattcatcaaattttaataatcttttaatttttgaaccagatttagcagtgaggagctatatnnnaactttnnngnnactaatgtnaatnagtgcnganangncagtnnnatnngancngcagtnattnanccaattnnnntcatcctaganngngtncccatgngggttggggggngggtggggtggggggnccngggnggnggcnganagctgctaatngggttngngaccatgggttngggtattttggntatttcatataantgggatcatgtggntggnttcttccacttagcatgctttcttagggntnactcacatctattcattatgtatcagtgcctcattccttttcatggctgaatattccattatatggatgtattttacttatccattcatcagctgatagacatttggntgtttctacctttcggctattgtaagtngtgcttctatgaatacttgtatacaggnttttgtttgantacctatttccaattcttttgggtganatagacnagatgatgaatcaactaaaaacgaggtagcagctctacctctttagctttttggggcctcatttcactttacagaaggtaggatatatatataacttagtgactctcaaacagtatgcacaaaaaccacctgggaagcctttttaaagatgtagattgctgagtctcatgtccaaagagtccaattcagtaggtctggganctagggatttttat

SEQ ID NO: 543040 - DNA, 677 bp, Homo sapiens
agcggatgcttggtcttactcttcacaagtggtatacctctactttggagctgtgctgtatgaacaagagtagcatttcgatattacaagtgtaagtaaagtgaccactttgaagagagtttcgtgcaaggacatgacacaaagctgctagcggaaaatcaaaacgctgattacaagaagcacggtatgatgaccagagcataaagaagtgtcttataataagtggtgtttcagataacaactaatattattactctgagtagttaaactaactcgaggattctcagagtccatgccgccgtatgattggattggtatccgaaacaaatgctattgatgtctctaaagaagacggagatggaagttcaagtaaatacaacggtgccactcaagaatgccgacactaacgtatacacttgagcaagcatagaagcacaatgacatcttcttaggcgggcatcccatgcagttctgagtcactggccttggcactgaacgatggccaaaaaatcgaaccaggacaatgggtagatggagctacatttaccaaatcgtttggccatgagagggagtgaacggatgtgcctacgctcagggatgatggtgcagaaacagatagatgttacaccgaacgaaaatgcattggaggaaaggaatacctaagtaatgtctaagaa

SEQ ID NO: 543041 - DNA, 235 bp, Homo sapiens
ctctctcttcagggattgtccctgcgtccggcggccacataggcccctccgcttggctccttggggaaatggcccaggcgggttgcggttcctcttgagggccttctaccggacaaggagtccgacggggcggatgctgtatcctttgcctccctgctggatgggtttcaccccacctgggaagggcagtgtgctttgtgggggttgcaatcagtaaatgccgtgagttgcccca

SEQ ID NO: 543042 - DNA, 256 bp, Homo sapiens
ccgggcgtttaggcagacgggatctttctgacccctgattttgccaaatataaagccatttctaagcaaattcatgccgtttttcggacaattacgccaaaaattgagccggtggtgattgatgaggcttacttagatgtgaccgccaatgcgttgtcaggcgcactgctggccgcacagttacggcatgacatttatatacacacacgattactctagttcggtgggtgtatcgtataccatactattagcgatg

SEQ ID NO: 543043 - DNA, 318 bp, Homo sapiens
gacaccactttgttaaattgcaaaaaaaaaaccaaaagcatgccaggcacagtggctcatcctgtaatcttagcattttgagaggccaaggtgggaagatcccttgagctcaggagttttgagagcagcctgggcaacatagtgagacctaatctctacagaaaaattttaaaaattagctgtgcgtggtgcacatgcctgtccctagcaacttgggaggctgaggtgggaggatgacttgagtccagcaggtcaaggctgcagtgaattgtgattgtgtcactgtactccagcctgggcaacagagtgacactgtct

SEQ ID NO: 543044 - DNA, 441 bp, Homo sapiens
  misc_feature (176)..(176): n is a, c, g, or t
  misc_feature (181)..(181): n is a, c, g, or t
tttagataaacataagatgaacaacacgttttacatgtgtgtattagtagaacattttttgtgcctcatattgcatagatgggtcaatgaaaacagaaaaaaaagaaacataaagaaagtgagagagagggagaaggaaagggagagggagagggaatgggaatgggagtgggagnaaggnagggagggagagagaaaaagagggaggaagaaagggaggaaaatagttaaacaagcaagatgaacagaaacaaatatctgctatactctgaatgtcaaaatggaaatagcctgtgtaaagttctgcaaaaccataaatgtaatagatttattttaacaaggtaccaaagtactgtatgtttaagaaatttatcatttttcaacttcctaatttatttctggatggtgacattttaatttaaataaacagcagctgacagt

SEQ ID NO: 543045 - DNA, 1058 bp, Homo sapiens
ggtcgtccttggactaatgttttccacgtcagttgatgtttcgagtgaacatgtttgtcctaggtatatgatttgtgttcttaatcctctctggtgtatatgcgaagtccttgtgtgctgaggggttttctggtgccggtggatgctttctgcaaaggttcttgttacaatgtgaaccctttttggttaggggttcgtgtatgtaatgcgtggtttctatgctggttttcaattctttggacacgctccttacgtaactgtgatttttgttctgatgtatgtgggctggctatggttaactccccaagtctggccgtatgtacatacccgcgtgaagtcctcgtgtttactcgcctgttgcatctctgtggaggcttgcatggagtcgaattctgtactaggtatcttgtatccgcctatgtgtacctacgtccctttcttgtgctgtcatggttctctataggtagctccactgacaactccgctggtcttaatcacatggcctctcagcttggtgtaacgcgttccaactggtgtcccgtagaggcgccagcaacatccaagtctctaaccggtatgacatctagctttcatgatgcttcaggatgccgtctcgtcaagtctgaagtcacatgctctcgagactgcaggacatcccagtcgcctgcggatgatggtgcatcgctgcggacgagtgagcctctaggggtctcacatcggaagctcagagcacaaatctaatggctccactatgcgagcgaatgcaccaggacttcatacgcatgcactagtgtgttgacctcatgcgtggcttcacatgggttatcttcccatcctagttctccactatgcctgaatatcgctgtcttttcttctattctataagcaaccacatctgtattaggatcgaccctagatcttctatatgagacaaggacaggctgctggcggccaatagtagccctcaatcactacatgtgctttgttgattgtctgtgtgtctgtcttcccccaccagactagtgagctccatgagggcagggaccgtgtctggccga

SEQ ID NO: 543046 - DNA, 118 bp, Homo sapiens
gatctcgaggatccccgtaaaccctatcgctcatccttcctaggaacacatatgacgcactctcccctgatagctctacacaacatattttgtcaccaagacctgagcaagccatggt

SEQ ID NO: 543047 - DNA, 1486 bp, Homo sapiens
agacagtacattcattgtgttgctgttaatcgtgtgtaggaggtggagtgatgtgggatgtcttggttagataaatatggagtggttagaagagtatgtagtattagctggtagtgattgctttgtgtgatatgatcggcgggggattgggatagattagttagtgatactagagggtgtgatattatcttcggcagagttggggatagtagcgtcgtccctattggagtcctttgtcgtgtcatggtagactgtgaggcatcttactggttttggtggtgatatgtggtgtatattgttggtttatagggggtgttgagtttgtggggagaaattgtgttataagagtaacgtggggtgtgtttgttagtgagggtttgtttgggtgtgattgtgctagggttgttgtagagtttagattttgttgatggttgttgtaggaagttttttgtttgaggttttgggtatgtgtagggtgtctgtatgtgtgtgcttgaagtatagatgttgttctgtggcttaggttatgttgtagaggggatatggtttttgtaaaaatttgagggtaagttttgagggctattgttggcagtgttgagaacatggactgattggacaatagtggtgaaaatgaacgatagttaaggattgtagagtttgctgggttgtttaaattactgttggaaaattaggttggatctaccaaatggccattgggtaatataatttgcagagaagattagggaaagggagagaactccggattacggcgtttgttgagaaccttgtgtgccattttaagaggttacttgaatgtttggtaagctggtgatgcctgtgcaacgtgttacgagattgcaagccttagaatatagacagaacgcgaggcaaggttttctggcttgagaacagtccgttgaattgttaggcgagctacttttagcattagcaggccataacttgttactaaagtactttggtgaatggggaccgtttatgaggttgaatttatctttattatttttagttttgtttaagtgtctggtgcttttctaatcactctggttcgtaatcttttaagtgtaattgtgtgttgcaattttggggtaagacttttttatgagtactttttgtttgaagttcttagcggtcaatttgcctgttgaatgaacatcgtgaagttataactgtggctatgcgaacagctgcctcaacctgacgcgagtcattactagtgagttagtgccatatacagaccactgtatggtttacttctcaccatttgagttgcccatcttggttcacactagtcagcaattctgtgttttaagtgcctattaagtgtgtgaaacagttcacggtgtacagtgcaaatttaacgggaagttatttagtgcaaaatatgcctaaaatacattaaagtcggatgtctgtgactgctgatgatttacatcaggtcgttacacgggttatagtaatgcctgag

SEQ ID NO: 543048 - DNA, 602 bp, Homo sapiens
acatgaagtcaatggattacataacgacatgactcaggatatgaagttcatcatcaaacattggtgttctctatgcagaagatgtggtgctacaaacaaaggtgcaatcatcggactcatggtgggcggtgttgtcatagctatagatcatcgtcatcaccttggtgatgctgaagaagaaacagtacacatccattcatcatggtgtggtggaggtagacgccgctgtcaccccagaggagcgccaactgtccaagatgcagcagaacggctacgaaaatccaacctacaagttcttagagcagatgcagaactagacccccgccacagcagcctctgaagttggacagcaaaaccattgcttcactacccatcggtgtccatttatagaataatgtgggaagaaacaaacccgttttatgatttacatcattatcgccttttgacagctgtgctgtaacacaagtagatgcctgaacttgaattaatccacacatcagtaactgtattctatctctctttacattgtggtctctatactacattattaaagggtaacgtgtacagtaaagaatttagctgtatcaacctagtgcatgaat

SEQ ID NO: 543049 - DNA, 312 bp, Homo sapiens
gaccaaggaaggagcatatatcctcccctaccccatttctaagggcacactctaagaaccccaggcaggctccgtctatcctgcgagcccacacagcctccagctcttcctgcacagtgccgtcggtctcacctgcttgtaagcgacaggctcatcgcaggagccgttcttcacaatctcgcggtaggacagctcagagttcctctacttctgcagggccctagagagccgcatccacagctgaggtaagagagccgcaagggcactcaggctttctcgcgacacctgatcacggagccaggaccctctcaa

SEQ ID NO: 543050 - DNA, 1240 bp, Homo sapiens
  misc_feature (788)..(788): n is a, c, g, or t
  misc_feature (1020)..(1021): n is a, c, g, or t
gcacgagcacatgcctatcatatagtaaaacccagcccatgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtttaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatttgcttcatccgccaactaatatttccctttacatccaaacatccctttggctttgaagcccccccctgatactggcattttgtaaatgtggtttgactatttctgtatgtctccatctattgatgagggtcttaaaaaaacanatacaccaaccccaggggggcgcggtccaaatcggccaaagtgagtgataaatacatggcgcggtacaccgttggttggaaacctggggtccccatatacttaagatccatttccaagggaaagaagccgcgatgctcaaattcgcatgatggatgcgacttggaccacattgcacctgtactgacgactacaaagggggtggaccaagcagaaggtcctgtcctgctagcnnccacacaaaaaacaaaaataaataaaaaaagaactaataaaattatctgacccacagcacaactagatgcagcacaacaagaccacgctcaacattgacacccaccctgaccccgccccatatgtgtcttgcacagacacgacctcacgaccaagcaaccacaacaccgatacaagaagtagcccagttcaacaccacagataccgagcaacacccccg

SEQ ID NO: 543051 - DNA, 267 bp, Homo sapiens
tctctagctcagctgggcttgtacttgcagtcctcactcccagcaggctccggtacatgttgatctcgccctccagccgggcccggactgtctgcagcacctggtactcctggttcttgcgctccacggtcagcccggatctcagcacgctgggcctcaacatttggtgatcatgcactgcatctggtgcagctgggagctgtagctggtgctcactctccggacagcgtgttttccagggcagtccctctaaaggaaaggaagaca

SEQ ID NO: 543052 - DNA, 1208 bp, Homo sapiens
  misc_feature (111)..(111): n is a, c, g, or t
  misc_feature (123)..(123): n is a, c, g, or t
  misc_feature (143)..(143): n is a, c, g, or t
  misc_feature (200)..(200): n is a, c, g, or t
  misc_feature (756)..(756): n is a, c, g, or t
  misc_feature (988)..(989): n is a, c, g, or t
ggggtttaattaaaacccggccattcccccttaaaggggcctttaaccttctaataaccccggccaaaccaatggttttccttcccccccaaaaggctcttaaattgggcnttttaccacccnctaccatatccaatatgggncgttttaccaagaaagccattccaaggcccccccccccccctgtccaaaaaggcttntccacgggataatcctatttattacctcagaagtttttttcttcgcaggatttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtttaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatttgcttcatccgccaactaatatttccctttacatccaaacatccctttggctttgaagcccccccctgatactggcattttgtaaatgtggtttgactatttctgtatgtctccatctattgatgagggtcttaaaaaaacanatacaccaaccccaggggggcgcggtccaaatcggccaaagtgagtgataaatacatggcgcggtacaccgttggttggaaacctggggtccccatatacttaagatccatttccaagggaaagaagccgcgatgctcaaattcgcatgatggatgcgacttggaccacattgcacctgtactgacgactacaaagggggtggaccaagcagaaggtcctgtcctgctagcnnccacacaaaaaacaaaaataaataaaaaaagaactaataaaattatctgacccacagcacaactagatgcagcacaacaagaccacgctcaacattgacacccaccctgaccccgccccatatgtgtcttgcacagacacgacctcacgaccaagcaaccacaacaccgatacaagaagtagcccagttcaacaccacagataccgagcaacacccccg

SEQ ID NO: 543053 - DNA, 1079 bp, Homo sapiens
  misc_feature (627)..(627): n is a, c, g, or t
  misc_feature (859)..(860): n is a, c, g, or t
cgcggctggggaatcctgccgaagataaaaggccttccaaggcgaccaacaccatctgttcaaaaggcttcgatacgggataatcctatttattacctcagaagtttttttcttcgcaggatttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtttaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatttgcttcatccgccaactaatatttccctttacatccaaacatccctttggctttgaagcccccccctgatactggcattttgtaaatgtggtttgactatttctgtatgtctccatctattgatgagggtcttaaaaaaacanatacaccaaccccaggggggcgcggtccaaatcggccaaagtgagtgataaatacatggcgcggtacaccgttggttggaaacctggggtccccatatacttaagatccatttccaagggaaagaagccgcgatgctcaaattcgcatgatggatgcgacttggaccacattgcacctgtactgacgactacaaagggggtggaccaagcagaaggtcctgtcctgctagcnnccacacaaaaaacaaaaataaataaaaaaagaactaataaaattatctgacccacagcacaactagatgcagcacaacaagaccacgctcaacattgacacccaccctgaccccgccccatatgtgtcttgcacagacacgacctcacgaccaagcaaccacaacaccgatacaagaagtagcccagttcaacaccacagataccgagcaacacccccg

SEQ ID NO: 543054 - DNA, 234 bp, Homo sapiens
ttttttccccccaaaaaaaacccggggggggttccccccccgggttttttctttgggggggggggggggaacctttttcccccggggaaccctttttccctttgggcctttttgggggcccctttaaaccaggttgggccaaaaaaccgggggggggcggggcgggatttcccgggattttttccccccccgggccccgggggggggggggttttaagggaattttccctttta

SEQ ID NO: 543055 - DNA, 742 bp, Homo sapiens
  misc_feature (704)..(704): n is a, c, g, or t
  misc_feature (706)..(706): n is a, c, g, or t
gcacgagcacatgcctatcatatagtaaaacccagcccatgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtttaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaacttctactatctgctcaatcgcaactatatcacttacatcaacatacttggctcaagcgcgctgaactgattngnatgggttgctatctgatgctcatcattgtaaggctt

SEQ ID NO: 543056 - DNA, 678 bp, Homo sapiens
  misc_feature (17)..(17): n is a, c, g, or t
  misc_feature (27)..(27): n is a, c, g, or t
  misc_feature (50)..(50): n is a, c, g, or t
  misc_feature (84)..(84): n is a, c, g, or t
  misc_feature (127)..(127): n is a, c, g, or t
tcctcctcccggccccncccccccccnccccctccccccgctggcgcgcngtcccccgcgcccgcccctcccccggcccccccnccccccccgccccccaaggccccgctccgggctcccccatttntccccccgccgtttttcccccgccggattcccccgagccccttcccccccccgccccgcccctccccccccattcggcggcccccggcccccccccggcccccccccgctaaatcccctagaagtcccactcctaaacacatccgtattactcgcatcaggagtatcaatcacctgagctcaccatagtttaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatttgcttcatccgccaactaatatttccctttacatccaaacatccctttggcttcgaagccgccgcctgaatacgggcatatggtaagatggggttggacttcccgtagggatgcaaaaacaaaaacaacaaggggggcccccaaaaagtcgcccggcaggc

SEQ ID NO: 543057 - DNA, 142 bp, Homo sapiens
tggcggtcgttaaatttatctaaaaactgaaaatacgtaagaggtcatataaggaaaatcagaaaatacaatcaaaaatctacccacatatagtcattcttaagcttagatgcatgcacttctaagttcttcaagcatatac

SEQ ID NO: 543058 - DNA, 300 bp, Homo sapiens
tctgccacttttcgaagctgatgctcgaagataacatgacccttctcatgagctccttggagccatcttctttcatcataagcattttgagtagaacaatcttggaatgtgtataagagtagctggcatgtcagatgaaggacatctcctttgtttggttttaatataaatggtagaacttgaaatatacttgacccagtgctacagtgaattctctgtgaatattttacctgtgcttgctcagagcaatgaggtatgcaccatataaggtggaatcccaaatgttgaagtttctgccaa

SEQ ID NO: 543059 - DNA, 806 bp, Homo sapiens
gcacgagcacatgcctatcatatagtaaaacccagcccatgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtttaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatttgcttcatccgccaactaatatttccctttacatccaaacatccctttggcttcgaagccgccgcctgaatacgggcatatggtaagatggggttggacttcccgtagggatgcaaaaacaaaaacaacaaggggggcccccaaaaagtcgcccggcaggc

SEQ ID NO: 543060 - DNA, 1332 bp, Homo sapiens
gcccgcaggcttctcaataggtttggcatggaccaagcatctcatgcaaggccaagatggcaggtgcactggtgcatgcacatcacacatgtggcacacagcattgcatggtctagcccaggtgccgttcaccctgctcatttaggcatgcaggcacttgcctagcaactcaccactggcacatcacacagtttattaggtgcccatgacagggcagctgtgagcatggcaggcttgtctcatccctccacagtcaccacaacgcattcccatgcgttcatgcattcatgcacacagcaaaggacatttcacatgccagcaagatacatcggcacagccaccatccatcgggcccagcacatgcttcgccagcattcaccatgctgcctcagtctcacatggccacagcaagccatcgcaacagcatcgcttcaccagtatgcacacaccagcttctcttccacatcacgcatcaacagcaaccagccgctcacactcacccagcaccatgcatcgcgatggcagcatgtcatcacagcaacagctccatgcttcgctcatcacgcagcagcaatcccagtctcatgcacaccagcacagccccacacgcacaagcacagttcccaccacagcacagcaggctggcacccccgtcccctaacccttgtccccttgtctccacgccagcaccggatccgcggttcgctccctcccgtcaaggcccgccttccttccagcagcttccaggcagcgtgggctgcttgacgcaggcttcaacacccagccaagttctccttcatccctccccctcccgcactactccgagtttctctcacccttcactgcaccacgcaaacacactgacctacacaccaaggtgctgcaccacccccacagcagatactccccaccaagagcgcccgcaggacacacacggtgcacccagacctcgtcgtgatcccacgaggtgcaccacacgcgcgcgccgcaatcccacccaacaccactgggctccgaccagaaaccacagccacccgacctggcaagacggtaaggccccccccctgcgaacggccactcacccgcacagggaccatcgcacagcacgcacacactccaccccacgcaccatccacttcgggggctaagggataacgccacaggtagaccacacacgtcgcgacacccaccttcacgggcccgcatccccgggggagcgaccacccaacgccgggcccgcgacgcggacgcgaaccccaccgggcgcagcccacgctacacgaaccacgcagcgagcacgacacgcaccgacgccaccaccgcgccgacacc

SEQ ID NO: 543061 - DNA, 985 bp, Homo sapiens
  misc_feature (533)..(533): n is a, c, g, or t
  misc_feature (765)..(766): n is a, c, g, or t
atttgttactatcgcgtgatgaggctgagcctatttaccactcgaggctagcccgcataacccccgaatgtaggatgggcatatgtgcgcccgtgaggcttcaccccgctaaatcccctagaagtcccactcctaaacacatccgtattactcgcatcaggagtatcaatcacctgagctcaccatagtttaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatttgcttcatccgccaactaatatttccctttacatccaaacatccctttggctttgaagcccccccctgatactggcattttgtaaatgtggtttgactatttctgtatgtctccatctattgatgagggtcttaaaaaaacanatacaccaaccccaggggggcgcggtccaaatcggccaaagtgagtgataaatacatggcgcggtacaccgttggttggaaacctggggtccccatatacttaagatccatttccaagggaaagaagccgcgatgctcaaattcgcatgatggatgcgacttggaccacattgcacctgtactgacgactacaaagggggtggaccaagcagaaggtcctgtcctgctagcnnccacacaaaaaacaaaaataaataaaaaaagaactaataaaattatctgacccacagcacaactagatgcagcacaacaagaccacgctcaacattgacacccaccctgaccccgccccatatgtgtcttgcacagacacgacctcacgaccaagcaaccacaacaccgatacaagaagtagcccagttcaacaccacagataccgagcaacacccccg

SEQ ID NO: 543062 - DNA, 103 bp, Homo sapiens
ccaccttaggctcccaaagttctgtgattacaggcgtgagcccccaaggccagggtaaggtaggatgttttcttactccagcaactacgtggaacttccagtc

SEQ ID NO: 543063 - DNA, 819 bp, Homo sapiens
  misc_feature (74)..(74): n is a, c, g, or t
  misc_feature (102)..(102): n is a, c, g, or t
  misc_feature (111)..(111): n is a, c, g, or t
ctagagacagaacctcgcctgttgcctcacaaccacctgtgggagccttgttaatgcagatggccatggtgaantgtgggagaggggggtaatatatccaantttttccantatggatggggatgcaccactaatgagaatacctattcaaaccgtaccctgatgggcaactggaaccaggaaagatatgacctgaggagtatcgtgcagcccaaacccttgccttcccaggtggggggggactttgaaacaacatatgatacaagctacaacaacaaaatgccactttcaacacatagatttaagcgagagcctcactgggtcccaggacatcaacctgaactggatcctccccgatacaaatgcgcagagaagtcaacttacatgaataggtattcaagggcttaaattggggatcactgaggagtggggtgagatcttaatattgagctaggtcacatcgcaggttctaaggaaggggaggatacttcacttttccaggggggaaggggcgggggggcacattctaagggcgggtgaaatggagggggactggacacaggttcggtctgtggggtagtggggggggagaccccgggagagagaatggggcctcggttgggctccaaggggggagagctgtggggcgcgcgtacccgttgaggggagggggagttgggggcgcgcggcttacgaggctgccgtccggtgcgggggcggcgcgcgccagggggccgcgccccggtgggtgcggagggggcggttccgggtgcccggggagtggggggttccgggggggccagccggtgagccaggggg

SEQ ID NO: 543064 - DNA, 1174 bp, Homo sapiens
  misc_feature (722)..(722): n is a, c, g, or t
  misc_feature (954)..(955): n is a, c, g, or t
gcacgagcacatgcctatcatatagtaaaacccagcccatgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtttaatagaaaacaaccgaaaccagtacttcgagtctcccttcaccatttccgacggcatctacggctcaacattttttgtagccacaggcttccacggacttcacgtcattattggctcaactttcctcactatttgcttcatccgccaactaatatttccctttacatccaaacatccctttggctttgaagcccccccctgatactggcattttgtaaatgtggtttgactatttctgtatgtctccatctattgatgagggtcttaaaaaaacanatacaccaaccccaggggggcgcggtccaaatcggccaaagtgagtgataaatacatggcgcggtacaccgttggttggaaacctggggtccccatatacttaagatccatttccaagggaaagaagccgcgatgctcaaattcgcatgatggatgcgacttggaccacattgcacctgtactgacgactacaaagggggtggaccaagcagaaggtcctgtcctgctagcnnccacacaaaaaacaaaaataaataaaaaaagaactaataaaattatctgacccacagcacaactagatgcagcacaacaagaccacgctcaacattgacacccaccctgaccccgccccatatgtgtcttgcacagacacgacctcacgaccaagcaaccacaacaccgatacaagaagtagcccagttcaacaccacagataccgagcaacacccccg

SEQ ID NO: 543065 - DNA, 238 bp, Homo sapiens
gttcgtcgtgtaccatccgcggatgagcatgattaccagttgactctggatggaacagtagacataggagactccattttgttctgtactaagaaaaattcttctggcttgagattctgttaatctatgacttacccccaaccccgtgctctctgaaacatgtgctgtgtccactcagggttaaatggattaagggcggtgcaagatgtgctttgtttaaacagatgcttgaaggcag

SEQ ID NO: 543066 - DNA, 436 bp, Homo sapiens
tggcccccagtttctttcttttgggtctatacccggcagtgggattgctggatcctatggtagctcaatttttagtttttcgaggaaacgccaaactgttctccacagcggctgtattaatttacattcccaccaacggggtacgagggttcccttttccccacatcctcgcgagcaattgtgattgtctgtcttttggataaaggccattttaaccggggtgaagtgatgtctcatggtagttttgaattgcatttctctgacgatcaatgatgttgagctcctcttcagatgcctgttggcagtttgtgtgtctcctttgagaaacgtctattcagatcttttgcgcgtttttttgatgggattattagattttttcatatcgagttaattgcatgccttctatgttctggttgtgatctgtgtgacaggagcg

SEQ ID NO: 543067 - DNA, 437 bp, Homo sapiens
  misc_feature (8)..(8): n is a, c, g, or t
  misc_feature (67)..(67): n is a, c, g, or t
ctctaagngacgattatgatggtttattttcattgtatacacttatacatatactattcaaagccgntggagtcgggaatggtgaatggaaactttctccaccctagacaattgataaactctaggagtaccctttttcatattcatctttccatatttgcatcttttgaggtacttggaatactgttaagtgatttttcttcccacttactagggatttgctgtcttttgaagaatttctgaaacaaacatgtggtccataagtccaagtaaaatattttaaaaacaacgacaaaccaataaacagcaaataataatggccacaaatccatgaataatcaaatttaataaaatattgacatacaaggatttttattgcttattacaatcactaacatgcaacccagcttatggataccacggagttccaatattgg

SEQ ID NO: 543068 - DNA, 183 bp, Homo sapiens
aagtagcacgttcttgcagtccatatgccagcagctcaagacccaagaagagccattttgcagttggcgtctgaaagcagaaaaacttatgtcccagcccaagagcaggagttcccccgttacttgagagaagaataagccctttttgttacattcagggctttcaagcagactgagatgggg

SEQ ID NO: 543069 - DNA, 124 bp, Homo sapiens
  misc_feature (25)..(25): n is a, c, g, or t
tataaacaaatacaaaatacaccanaataaaataacacattcacctaacattaaagtataggagatagaaattgttatcctagacgctatagcgatagtaccgtcaggcaaagatgaaagacgg

SEQ ID NO: 543070 - DNA, 426 bp, Homo sapiens
cactccagcctgagtgacagagcaagaacctgtctcaaaaaaaaaaaaaaaaagaagaacttgccctgggtgagtgattttttgtttgtttgtttggttttttgtttgtttttaaccgaactagtcttatcagtgaagcaaccgggccagtggctcacgcctgtaatcccagcactttgggaggccgaggcgggtggatcgcagggtcaggaaatcgagaccatcttgttgaacacggtgaagaccctgtctctactaaaaatacaaaaaattaatcggacatggtggcacgcgcttgtgatcccagctatttggaagcctgaggcggaagaattgtttgaacccggaaggcggaagttgcagtgagccaagattgcaccactgcactccagcctggtcaacagagcaagactccatcaaaaaaaa

SEQ ID NO: 543071 - DNA, 211 bp, Homo sapiens
ggacataacctgccagcagggagccgcctctgatggagtgctccaaggccgcgcaaacagctgggaaacccatgtaattgcagaaggaatggcagacgaaccgtgcccagatcacggtgtcctgtgacggatgaagaggaaagcagtgtatggaccgacaacagctgtgtaggagaactggaacgcagcagacaagaagatataccccacg

SEQ ID NO: 543072 - DNA, 483 bp, Homo sapiens
  misc_feature (14)..(14): n is a, c, g, or t
  misc_feature (37)..(37): n is a, c, g, or t
  misc_feature (43)..(43): n is a, c, g, or t
  misc_feature (71)..(71): n is a, c, g, or t
  misc_feature (114)..(114): n is a, c, g, or t
  misc_feature (145)..(145): n is a, c, g, or t
  misc_feature (163)..(163): n is a, c, g, or t
  misc_feature (183)..(183): n is a, c, g, or t
  misc_feature (321)..(321): n is a, c, g, or t
cttttgcccccccnttaattaacaaccaccaaccagnttttantcccaagcgaccggggcgcgaagcttgnagtgcccgttgttcgccccccaaatcccgaaccaccaaccacnggggatgaggtcccacgcgaccggggcggcnaagcttcgcagtgcccgntgtctcgccccccaaatccncgaaccaccaccacgggagctcgcggatgaggtcccacgcaaccggggcagagaaccccacagagcccgcagactcgccccccaaatcccgaaccaccaccacggggatgaggtcccaagcgaccggggcgcgaagcnccgcgtacccgctgtctcgcccacgtaaacggggtacaggtccgaacgcaggaccaacccggaggcgtccgggtccgcagtgaaggagcccagcgcctcaaactgatagggcaagccaccgcctggtccaggtaggcgggcccgggcaggggcacctcgcga

SEQ ID NO: 543073 - DNA, 302 bp, Homo sapiens
cagagataacagagaacaccatggagaggctacggtgggtgacagtctcaggaggagaggaactagtacaccactcgcaggcaggacaagtcacctcaaccacatccctatgtctcggcagaaaaacactctcgcactaaccgttttttttttcaacgcacataaacattagtgatgtaggttcttagtagagagttaaggccacagctaaatcagactttactttccggaaagaatcgtgtttttaacaacaacacaccctgataatttacgtgataacctcatcacgaggcactacgtgc

SEQ ID NO: 543074 - DNA, 127 bp, Homo sapiens
gacggcagctttgttgactgcgatgtttccaaatcacttgctcaacctgcagcgttcccatggagcttggagcgcccagcatagggctttattgttgttttgaggcaagaaagaagttttcagaagc

SEQ ID NO: 543075 - DNA, 211 bp, Homo sapiens
cggccgagtcgacatagcgcgccagcgcctcctcgagcgtcgggatgcccagcgccttggtgtcgacaccgagcaggccgttgcggccctcggcgggctgcacccagctcatcaggaaatagctgaggtccgcgatcggatcgcccagcgtcgagagctcccagtctatcagcgcgatgaccctgggctcgtcatgcgcgaagatccggtt

SEQ ID NO: 543076 - DNA, 159 bp, Homo sapiens
tatcgatgcctttacactagaattattttagtaaatattcaatatttctctacatttgcaccaaaattatttttactaataattggaatattgtagatttgaataaaatctaaattctttttatattctttcttgactctattccttctacattttcct

SEQ ID NO: 543077 - DNA, 147 bp, Homo sapiens
cctagacgactcacactggtcgagtcaggacagtgtattcgtgtgtgcacgtatgtgagcacaagcagtcgggcacatccataggtcaggacttgagaaaccacggttgcaggctagaatcccaggctgtacagccatgcgactgaa

SEQ ID NO: 543078 - DNA, 233 bp, Homo sapiens
aggatccgaaaaaatcgtcccagcacctccccctgaaccgtgacacacgataaaagtgaagtgcaagtgtgatagttggtctaacatctgtcttattgcatggcttactaatggttacgaattaacagacaaatagcagtcgacaaattctcacataataaaggcattgtgatccagcgtgcattcctagttggtggttatgtccaaacatcgatcaactgtatcgttatcat

SEQ ID NO: 543079 - DNA, 1192 bp, Homo sapiens
gcgatgacctgcctgcctgaggatgcctcggttggatcgcgcaacgagctgcaggcatccagcgggacaagcatgccaatcgtggcacatgcatgctagctgacattgtgctataatgaccttcttctacctccgatgatgcttcatcactgtgtatggggggtacctctgcagtgtgcgagtctaccagtatttccagtggcagcaggaccagcgccaggccgtcgagagagaagcatggaagatcgctcaggaagtcatgtatgaacgtgaggagggctttgttcgtcctgtaggcacgagagtgcccaattggcatgcctgctggaggaagacttcagacatgtccacgcattttcacaggctcagacaggactagagccgttgatgagttattgcaagaccctgttcggtaagaaagcttgctccaatggttatctctggttctagccaggtttgacagtcttatggaggcttattgaatcgtaatagccaatgtcgaggggtgagggtacaccgtactagcacagttagaattaatttcgctcgtggacctgaaagaacacagagaacaatcggagacacaacctgaatcgcccctagagaaggaagggggggaaaaagaaggctgaaaagacacaagcggcccgagaagacaccaaaacgtcgggagtgaactgcggaccgcatagcatcgaggccaaaacagcggggccacaagccaacagaggggaccccataggagggggacaccacgaagaaatcgcacaagaggcccagaagaaacaccaggcaaacaagtgagctcagacaatacagagacacgccatcgacaacacaatgacaaggcgaactgaaccgatcgcgagcgtcagagccagggcctgacgagatcacagccgtagccaagcaacacaaccccgctatacccacgcccaaagatcagcgtgcacgcgagacaacacgcagcgcaccgccccgcgccactcagacccgcaccacaccaggcgcccccgcacgagaaacacaacagaggacgcgcgacccacacagaggagaagggactagggacactaaatatcctcccgacacagccaaacgatacgcacgacagaaagctgacaatagggagcgggacacgagcaacacaccaccacgagtaagaagacaaaaggtagaacaaaagacgagc

SEQ ID NO: 543080 - DNA, 149 bp, Homo sapiens
  misc_feature (73)..(73): n is a, c, g, or t
cgatcctctaatggctgtgctattgaactgttcacgggtgtggatcacaccaacatgctactctatcacagantggtgctgctacaggcaaagtagacaatgcgatacaggagatctgagctagtggaataaagagatgattgagccct

SEQ ID NO: 543081 - DNA, 401 bp, Homo sapiens
actcctatgatgttccagatggggccttgtgtaatgtggatgcctatggcacattccaattgagatcccttcaccgccttaccaatccagactgtgctttctactatactaggctccaaggaaagagcaagtacagatatggtggtttggctccaccgtccccgggccaccgtgactggctatttctctccccacgaccataatgtagtcagcatgcctaaggctgcttgtgtgaagcagacctacacctcatgggatcttgagtgacatggaaaaataccgcatgcagtccatccggagagagagccgtgctcggcagaaggtgacagggcctgtcatgtcccaatatgataacatgaccccggcggtgcaggacgacttgggtgggatctatgtcatcc

SEQ ID NO: 543082 - DNA, 786 bp, Homo sapiens
  misc_feature (29)..(29): n is a, c, g, or t
  misc_feature (115)..(115): n is a, c, g, or t
  misc_feature (174)..(174): n is a, c, g, or t
  misc_feature (178)..(178): n is a, c, g, or t
  misc_feature (215)..(215): n is a, c, g, or t
  misc_feature (518)..(518): n is a, c, g, or t
  misc_feature (535)..(535): n is a, c, g, or t
  misc_feature (539)..(539): n is a, c, g, or t
  misc_feature (557)..(557): n is a, c, g, or t
  misc_feature (571)..(571): n is a, c, g, or t
  misc_feature (613)..(613): n is a, c, g, or t
  misc_feature (627)..(627): n is a, c, g, or t
  misc_feature (658)..(658): n is a, c, g, or t
  misc_feature (690)..(690): n is a, c, g, or t
agtggggcgtagggttgtggtgtgccgtngggccgggggtcgtccgggccgtcacgtgtggccggccgcggtgaggaagcgcggtggagaaggtcgaacagggtcccgaattganctttgcgcaggtttgcgcaccgtcggtctcttccagccccggtcacacggacgcgcacntggntccttggccgccgagcacgccctttcttctcaatggntgcgtgcacaggacggctctgcagctgccccgtgcggtccaggtagctgggctccgagccctgctggtggaggcccaggcgcagagtgaggcccccgtggcgcggctcgtccccgtgctcggcgcccagcaggtgcttgttgaagtggggcagcggcaggctgggcctgaagtctgagcccagcatgctgacgggcgccaccggatggcggcattggtgactgggcctttgagggccaccgtccggatgcactgcttgcactgcacgtcccagaggcgcacggtctcgtcgtgggagcctganagcagcacgctgccgtnagtngacactgacaggcaagtnacctggttcctgtnccctttgaagaccttcccggcgtcctgctctgggtggaagcncctctccctctgtncgggccaggtgaagaggtcgacctggaaganggagccctcactgcccccgcagaacaaatggngctcagccagggccatgggcactgccatgatggacacgtcaaagaggacggagagcagcagcccccccgaggagacctcccatagcttcaccgtct

SEQ ID NO: 543083 - DNA, 593 bp, Homo sapiens
  misc_feature (162)..(162): n is a, c, g, or t
  misc_feature (171)..(171): n is a, c, g, or t
  misc_feature (178)..(178): n is a, c, g, or t
  misc_feature (190)..(190): n is a, c, g, or t
  misc_feature (201)..(202): n is a, c, g, or t
  misc_feature (209)..(209): n is a, c, g, or t
  misc_feature (229)..(229): n is a, c, g, or t
  misc_feature (242)..(242): n is a, c, g, or t
  misc_feature (255)..(255): n is a, c, g, or t
  misc_feature (269)..(269): n is a, c, g, or t
  misc_feature (305)..(305): n is a, c, g, or t
  misc_feature (311)..(311): n is a, c, g, or t
  misc_feature (322)..(322): n is a, c, g, or t
  misc_feature (346)..(346): n is a, c, g, or t
  misc_feature (348)..(348): n is a, c, g, or t
  misc_feature (351)..(351): n is a, c, g, or t
  misc_feature (358)..(358): n is a, c, g, or t
  misc_feature (361)..(362): n is a, c, g, or t
  misc_feature (536)..(536): n is a, c, g, or t
gggttccaggggagttaaatccagtcttatgaagtatgttattaaatgtctttttaaaaagagaaatataaacatatatttttactattaaaatattcagttttttaaatgaagtagaactgagttcatgtttatatgaaatatttaccaaaaaaaaaaatngaggtaacnggttttnaaaaccttgganttgagtctgcnnggtaaancttctgaatatggagttggnggagaaataaaantcaaaatttcttnaagctggtaaagtngaggggcccaccagcagtgatctcctgatgccttantggaancttggttactngtctgtaccctctgattggttttnangtnagttttnatnngtgagcacacatagtacctagttacatcttaagatcaggtttataaacactgtggagtgcagcggtatggtatggaatgactgtgaatgtaagctgtcagggagcaacactgttgtcaccttttgctaagatctgggggttccttcatatcctgctgtggaacgcagttgaccnaaattgcttgccagtattgccaaagcctgctgctgacatgtgacctcctgggtctaa

SEQ ID NO: 543084 - DNA, 247 bp, Homo sapiens
attccccgccctttcccctgcgcgtcccgagtcgcagcttcggtgctttgcaggacggcagttaggcctatctggttggcctttttgaagacaccaacctgtgtgctatccagtgccaaacgtgtaacaagttatgccatatagacatccgagctagcacagccgcatacgttgagcaacgtggcttgagacatcctactatgatcgggagaacattttcgcggtaccagtagctgcgaaattctgt

SEQ ID NO: 543085 - DNA, 277 bp, Homo sapiens
gcgcacaggtgagctggatcttctgtttagggtcgcacaaggatgacatcaggatgtcaccagggttgggttcttatgtggaggctaaattagggaaataatgtgcttccaagctcactcaggcttctagcagaattcatttccttgaggttataggactgaggggccctggtttcttcctggctgttggtggaaacatcatagaggctgttagtagctccttgccacataggcttccctaacagggctgcttatcttataatgccagcaaggagtc

SEQ ID NO: 543086 - DNA, 128 bp, Homo sapiens
  misc_feature (84)..(84): n is a, c, g, or t
ggcattgggggttacagatctagatcccatgctaggattgtctgtaatgccccagcccaccttccctttcagcccccagagcanggccctccagcctctcgtctctcctttccaaactctggaggagt

SEQ ID NO: 543087 - DNA, 88 bp, Homo sapiens
catggatttgctggtgcagtacaactaggcttaatagggacatgtcacggcaccccagcctgggtgaaagagcgaaactccatctcaa

SEQ ID NO: 543088 - DNA, 872 bp, Homo sapiens
ttcaacagagtatccccgagtgctctccgcagcaacccatttccatttgagggtgatgatggattctagtgtgtttgagagcaacgccattgcctactatgtgagcaatgaggagctgcgggaagtactccagcaggcagacagacaggtggtgcaggggtgagcttagtagattccgatatattgcccccagccagtacctgggtgtgccccaccttgggcatcatgcgaccacacactgagacatggccactgagaatgcaaaggagagaccgtgaaggcgacttctggggctgctggatgcttactctgaagacgaggacttttctggtggggtgaacggagtgagcattggctgacatcaccagtatgtctgcaccctgtatgccggctctataaagcaggttctagagccttctttccgccatggcctttccccaataccaaccgacttggttccttcacctagacattaaccaagtcccagtttcccgggctggctatgggcgcaagtgcacactgtgtgagaagatggccccagtttgatggcttaaccagtattgggaggagacgcaaactaatcaaggacacaccaccggacaaagagcagggtcatgtgaaagagaagcagaagcccaaggatgaactggaacgcagcagcacaagggcggttgcccctgggtctgaggcagcgaatgctgagtgtgacacgaggcaggttgcagaacccagggtacgaccctagtcactgcccagagttctttggttggatgcataaggacgttcacgacgcaaccttgggcggccaattgggcattaatggggcaccggcacaaaaagtcctaaaataaccagcgtactcgaaccatcaa

SEQ ID NO: 543089 - DNA, 403 bp, Homo sapiens
tgaaacagcctccagttacaacagctccattacaacagtaatgaacatatgccacccctaaagtttccttatgtccctttgtaatctcttctggcccctcgttcctcagacaaccacggatctgtttctgtcactctagactagcttgcatttgcctagaagtttatgtaaatagaatcctacagtatgcattcttttttgcctgccttcttttactcagaataagctattttgagattcattcatgatattgtatgtatcatcagtattcatccccttttagtgccgagtagtattccattgtatggatgtatcataatttgtttatacattcacctgttgataaacatttgggttgtttctagttttcgcccattatgaataaagctgaactgttgtaact

SEQ ID NO: 543090 - DNA, 158 bp, Homo sapiens
atctatgcgggagatgaaaaagtcctaaagttatgtatctaatgtgtcacagaataggacgatatgattccaacataatcaactccctattaaattctttaatgaagatttttttttttttttttatttttttttttttttttttttttttttggggg

SEQ ID NO: 543091 - DNA, 1007 bp, Homo sapiens
agctataggccgactgcttaggtctgcaaactgggcagctgttcccctggaggggctactgctcccagaaggcaaagggagagctctgcaggaactatcgtagaggctctaaaaggccgtggtgggcggcacccacatgaccacaagccagcaagaaagggaccaaaaagcaagcacagggcgcgagaaaacagaaagcacaaagagcaaagccgaccagatgcattaaaagaattgcccagagagcaaaagtcagaagattgcttgcagatgtctcgcagatcgaatgatgaaggtgggaggcctggcagacgtaagtcggggactgaacgggcgaattctaagggggtaaagacttgacgaaagggaatgggttggaatcgtttaacaattgttggaacgcgaatggagcaaaaaaggtagccagaaaatccaaggggacatatattgccattgttagcgaactacaatttgtgaaatattaaattccgagataaaatcagttctttgcaatgttcgcgagcgagatggctcaacccggattggagagacaacgaagcggggggcctaccttggggaggatccccagttagtatccccaatttactaccaagatcttcggttcgactactataaagctatagagccaatatctatcgcgaggggggttgtagcgtttattactcgaagcacggatttacccactttagcatgagcgatcctataaatcatatttatcgggactctgatttactgacttctaaattcagatagatggggggaccattgctcccagatcgagttcatggtggatctgaattcaatctcattggaggggtcgaggggggccaaaagattgtgacttggtggagaagaatgagaaacaagtctctgggcgaagaagagttgggacttctttgtgtgacttcgagtgggggagatggggagccgagattattgaacttctgaaatttttctccttctttactatctttctttgcaactta

SEQ ID NO: 543092 - DNA, 438 bp, Homo sapiens
ccccccgggaaaaaagggggggttttttttttgggcccctttttcccccccttttccccgggggttgtttttgggtttttgggggaatttttcccccccccggttttttccccccccccggggggggccttttttttggggggcccttttttttccgggggttttttcgccttttccctttgggggggccccgggccccccccttttcggggcccggggggggttttttccccggggggttcccccctttttcccccttttttttgaaggtttttccccgggggggggggggcctttttttttttgaaaaatttttttccccaattttgggggggggaaaaaaaaggggtttccccggggggtttttaatttttttccccccttaaaggggggggttttttggggtttttttttttaaaggattttttccccccccca

SEQ ID NO: 543093 - DNA, 385 bp, Homo sapiens
  misc_feature (17)..(17): n is a, c, g, or t
  misc_feature (154)..(154): n is a, c, g, or t
  misc_feature (189)..(189): n is a, c, g, or t
cagtatttggatttgtnaatatttataatatttgtaaatataaatatttttaagttaaaaatccttgaattttcaataaggtaaatatcaataaaggtaacctttggccgggcccagtggctcacacctgtaatcccagccctttgggaggccnaggtgggcggatcccctgaggtcaggaattcgagnccagcctggccaacatggcgaaaccccatctctactaaaaatccaaaaattaggcaggcatggtggtgggtgcctgtaatcccagctactcaggaggctgaggttggagaatggcatgaacccgggaggcagaggctgcagtgacctacaattgtgccactgcactccagcctgagtgacagagcaagactgtctc

SEQ ID NO: 543094 - DNA, 945 bp, Homo sapiens
  misc_feature (719)..(719): n is a, c, g, or t
ggtggaggttgcagtgccctgtgatcacaccactgcactccagcctgggtgacagagccagaccctgtctcaaaaaaacaacaaaaactcaacagaagtccaacatctaaataaattgtccagaaaataaggaaatgagagaaatcagcagagataaatcaagaaaatttcctagaaccaaacagtcatgttttctgaacaatgggtgaaagggaagttgtatatcaagacacatcattgagaattacccaagtaatggggcaaagaaaaagaagagatcataggtaaagagtcagaattcaggaaggcacaagagttcttggaactagaagaaaatgacacaatacccttgaaatcctgggaataaatgattttcaaccaagccaagctttttgtagctagtcgcactgttaagcatatgtgaggttagcataaagactgtggggaaaagcaagagagatcagattgttactgtgtctgtgtagaaagtagtagacataggagactccattttgttttgtactaaggaaaattcttctgccttgagactctgttaatctatgaccttacccccaaccccgtgctctctgaaacatgtgctgtgtcaactcagagttgaatggattaaagggcgggtgcaagatgtgctttgttaaccagatgcttgaagggcagcatgctcccttatagagtcatcaccatccctaatcttcaagtanccaggtaccccaaaacttggggaaggcgcgaggaactctgctaggaaagccaaggttgtgccaggtttctcccctgtgtaagtttgaaaatggccctggggggaagacacagacgtccccacgaaacctaagggtcgtgtggggatataaaagaagagcgctccctacacaaaaggttttctccgcccgaagagttccaaaagggccctgaagagaccccgggggg

SEQ ID NO: 543095 - DNA, 198 bp, Homo sapiens
ggtcccaagctccaacaagagcagatattggtgagcacatatgtagttgagattgatgccaagacaggattggatgctaagagagaggacttgggcttgaacttggccaaataagtgcgtaaggggcttaaggtctcgataagtgggcaggagagcagcaggggagactggcagtggagaaccccggttgtgctatta

SEQ ID NO: 543096 - DNA, 520 bp, Homo sapiens
  misc_feature (102)..(102): n is a, c, g, or t
  misc_feature (147)..(147): n is a, c, g, or t
tttgaagagaggagagctgatacctgcgtgctggcatggaggtagatgcataggggtacgagagaatgtcgcgaagccgcgaacgtatttacacgcgaaatntatagccctaacggtataaaggcaatattgcaagacctaacgagngtggcctgtcgaaggaaacaattaaagggtctaacaacacgcgagcttgagagtagctttctccggggatagaatgtaagtgaaggaactgtggaagaacagatcccgcagccccgcatgtaatccccatgagggccactcctttatgattagaaggaggggacctcaccgccttaagatacatttaaaactgtatgtggaataaaaaatctgaaaccgtcttttaaaaaagcattaaccagcctgcttcagatcctcgtatcacacacaggaaaattctcttttaaactcatttaccccttctcaaccccacgcattgaaaatgggaggaaaccatttaaaaaaaaattaagaaagaacccaaccggagcca

SEQ ID NO: 543097 - DNA, 150 bp, Homo sapiens
cttggcactgatttcttcgaaaagatatcctggaaagtctactattagtgtaagtttggctgtagcagcaattcctgagggtctccccattgtggtcacagtgacgctagctcttggtgttatagaatggggtctcctcctccggcgggg

SEQ ID NO: 543098 - DNA, 228 bp, Homo sapiens
  misc_feature (1)..(1): n is a, c, g, or t
ntatctcacattattcacagagcaggactccatctcaaaaaaaaagaaacaaaggtaatccatatgtataattgttctaattttggaccagtccagaagttgtccttcaattatttaagtgttatctataattgattcccaacctagcttttttgggtaaatttctttttgtgtgcacagtcctatttttaagggggtcattcattgaggttttcgggccccgtgtcc

SEQ ID NO: 543099 - DNA, 370 bp, Homo sapiens
ttaagacacagcttccatgaaagatgacaggtcacccacgcaaaagacctggaggtggcagctccctgtatgctccgtagtttgtgctgcctcccaggtttacatggagagcatactggcacacagaaaagaatactgatcatagacctgacggggtgaaggggcatgagctataaaatcagtgtcggtgtctagagtgtccccatacctcccccacgggggtcggcgattctgagcattttgtattaatacttcaactcccgagggcccatataacagcaagacaggagccttctgaagagacagaccccatgctgtgccctctcacggtgcctgtactgcgccaggtagaaaccttatcaagaattat

SEQ ID NO: 543100 - DNA, 129 bp, Homo sapiens
acggatgatagaatggtttcctcctcattcaggtccaccttttccccgtgtcatggctaatgggtgcgtcacaccacgtgctctgaagggtgctgcacgctctatgaagactggctgggcagcacggaa

SEQ ID NO: 543101 - DNA, 408 bp, Homo sapiens
ccgattcatgggaacccggagacaaattttgcagtgagccgagatcacgccattgcattccagcctgggcgacagaacaatgactctgtctcaaaaaaacaaaaagcaaaactgcatactataaaccatatatgtatatgtccatatgtacatagaacattgtcttgaaaggtccacagcagcggtgatagagatgaagggacagccttcctccattgcttgggtgtattttccaatttttctaaactgactctacgaaatgtttcagttgacagatagcacaaacctctcaatgattccaatacgctgcccaaaccatgctaggggagaaacagactgtgataagcaaatctccctcagcacacgcctccactgcagggagaccgccatggtcctcccacctgcacc

SEQ ID NO: 543102 - DNA, 232 bp, Homo sapiens
atccttgttatttgactcctcataactgaacatctcagtcacttctcccttgggcagcgccaccaggacaggaaaaccgatgcaggcggggaccaggtataggagggcaggctgagcatgcttgacagatgtgcagtgatgaacgatggtacaggcccagtgccagaagagtgtagtgctgcaaaggcgtggtgtacgaagtacggtgtgaggtattctatcttcaagcgtg

SEQ ID NO: 543103 - DNA, 309 bp, Homo sapiens
  misc_feature (309)..(309): n is a, c, g, or t
attgatccagaagatgatgtaagagataatattttaaaatatgatgaagaaggtggaggagaagaagacccggactttgacttgagccagctgcagcagcctgacactgtggggcctgcatgccatcaagcctgtgggcatccgccgaatggatgtacagcccatacccgctgagcccagtatccggtccgacatacggtccacaccatggaggacattgggtctccattcatgagggaccttatgagacgacctctgccacatgataccaccactgatctcacagatcagtgtctagcatatagagcn

SEQ ID NO: 543104 - DNA, 173 bp, Homo sapiens
taagcccaggaacgatagggagaaggctagcacgggatataggttacaggaagatactactgggaaagggctcccagagttggaggaggtagaaggggtagactaactagagggaggatagactaacaacaaatctataaagacatacaaatagcacacggcacatagagcac

SEQ ID NO: 543105 - DNA, 146 bp, Homo sapiens
ggtgactaaggacccgctgagtgcatataactcagatattgctgtgctttggattcaggttgatgcggccaggatgatcagacctgtgaactacccagaagaaattgtctgctgccctcttccaatccagtgaatgttatatgcca

SEQ ID NO: 543106 - DNA, 188 bp, Homo sapiens
taggtggtcaattgtaatcccagcatttgcgggaagatggcttgggctcaggacttggagacttgtgtctgtgagaaattaaaaaataggctgggtgcgatggctcacgcctgtaatcccagcactttgggaggccgaggcaggcggatcacaaggtcacgagtttgagaccagggtgaccaacaggg

SEQ ID NO: 543107 - DNA, 554 bp, Homo sapiens
  misc_feature (554)..(554): n is a, c, g, or t
aaattttcatgcttagccgggaccattaccgaacagacgactggggataccgatgacgagcacattgacgtgtttagtgtcattttacagggaaacatgcatattcagggtcccatgagacatgacctctaaatgactgccctgcccctaatatttctcccgagaatgactccggggtagggaccccatgtgctttcagtaacaatgtataaccagaacatttttatgactaaggcttacctggagcaagccgtgtaaactagaatggacttttgcaaatagtattcggggactggatagagacgtgtggacttcttgcggttctttgagcgaccaccagggagtgcacagctacctaacatcggaacgggtgcagggcagtacatggcttaagctgctccaggggggctgattttatgcatagtactcagttgtctttacacgttggaatattaccccaggtaacagcatatgccccactcggggccgctgacacacgaggcctatatcttaaaagtggaactggcccttggggtcacttcaagttatggacn

SEQ ID NO: 543108 - DNA, 117 bp, Homo sapiens
tcaggtgcacaccaccacgcccagctatttttgctatttggtagaggcagggtttccactaaaaataaaattgtgccactgcactccagcctgggcaaaagagcgagactccgtctc

SEQ ID NO: 543109 - DNA, 200 bp, Homo sapiens
aaagataaattgtgtaatttttgcctgacaatgctggccacattctgatctgtttcattaaatttgtggtgatgttactctaaacaatttgactatttgaatgtacttgggagtcaagaaaccaaaccagggagggaaataatgttaaataaaatggttcctctctgcaagggaactctcacactctggaggacagggat

SEQ ID NO: 543110 - DNA, 356 bp, Homo sapiens
cggggccttcctttggaaacttgccctgcttgggggcccttttgcccagtttgggcccaattgggttttccccccccccttttttagtttcccgggcccttttggaattgggcccttaagggcctggggtttggttggaaggggttagggggggcaaaccccccctttttggggcctgcgggggggggttggggttgggcccttccccgggggattttttggcctggagggggggttgggatttggggggggggccacccttttttttggaggtgccctttttttttttccccttgggggggtgggggcccccgtttaaatggaaaaacggtttttggccccgggcctccccccca

SEQ ID NO: 543111 - DNA, 1300 bp, Homo sapiens
tttccttgggggcgttgtctgtggctctgtgttttcttgctctgtgccgcgtggtggccgggttgctcttgaatgtctctggctctttttgcgggttttcgcggggcttggcctcctgttgtgcgtgactccctcttggcgttgcccgcgcgcttgggtggtgtcctgtgtgcgtgttcgtttcacgtgttctgactcgcggggcgccttagtgttggctcctttgtcccctgttttcggaatgggtttgcgtggcactcattgtgttggccctgtgtttctccggctcatgtgtgtccgccgcttcgtgtgtgtctggtggctctctggggttcgccccttgtctgtgcttcggttcagggccccaatcgtgttttcccgttggccttttgtttccccttgctgcctgggtcgctgcgggattcccaggttcccttgtgtttggcgccctttgaggctttgtattgaattcgtcggaacccttttccctgggtgcagatcgttaggccatgaatggtttgtcaaagcgcccgaggacgttccttccagacgaaaggtgacgactctgtggtacagtcgttgcttgacgcgggactgggctgtcccgtggctcctggctttcatcgctagcacccatgctgttgtctggtttccctgggtgccgtgatgtgggacgcccaagagctccgcttcctccgagtccccctgtccgtaccccgccgttcgcccgcagcccagtccagttaaggccaggcaacgccttgtacgaactcactctgggctgtaaccgtgcgcatctggtatggttgtggacaccagtggttacgaagatcaacgtcctcactgaaaccatgcgctgtcgatctatgcagcctgcttctagtgtggatcagcccagagcctgttctgcccatcatgtggccccacccaagtcaacgggaagatagcgaggaatgctggactgtgaggcccctggagctcagatgtgcaagagggctgacagcgttcctttcctgtgtgtattctgtccagttcctttagaataaaattggatgcccagaggactcccaatcctggacttggggtcaagaaacagccagcaagagttacggggccttagggcatctgggctgttgttccaattgaagccgactctggacctggcccttacttgcttctctagctctctaggcctctccagtttgcacctgtccccaccctccactcagcaatgtcctgcacgcaaacacttccaccctccaccttccattttccaccactactgcagcaccttccaggc

SEQ ID NO: 543112 - DNA, 369 bp, Homo sapiens
gaagactctcgaggatccccctgtatggggtgcgtgcatgttatgcgcatgtgtgtcctctgactatgagtgcccctgctctgggttagagcgcgtctctctggccacatggaagcctccgctagctgattctacactgtcctggggtcccccagcatcctgcccttacctggatggtgacctcggctgagcttgtcttgcagtctctgcccaggtcctggactctggcgaagaatcgggaaagcgtctggctgaggactccagggggcggtgtccaggtggagaaagtcatatcttcacagacagtgtccttttggctattcgggtgtccatgtctgggcttccagcctgggcggcagcggcagctgc

SEQ ID NO: 543113 - DNA, 338 bp, Homo sapiens
cagagcaagactctgtctcaaaaaaaaaaaaaaaagtaaaataaaaataaaagaaaataagtgactatgactgggtacagtggctcacacctgtaatcccagcactttgggaggctgaggcaggtggatcacaaggtcaggagttcgagaccagcctggccaacatggtgaaaccccatttctactaaaaatacaaaaattagccgggcatggtggcaggcacctgtaatcccagctactcgggaggctgaggcaggagaattgtttgaatccgggaggcggaggttgcagtgagccaagatcacaccagtctgggctacagagtgagactctgactc

SEQ ID NO: 543114 - DNA, 848 bp, Homo sapiens
  misc_feature (196)..(196): n is a, c, g, or t
taaaaaaaaaaaaagtgtttattataggcaacaacaccaaggggaacgggtattggtctacaccaagggagtgcaatttttcatcttccaatgggcgggcctcaaccttgaggcagaatccactgggcagaaagatgcctttctagagaagcagagctccctgactggggctaaagatagtctcagatggatcttnaggtcaatgggtaaagaccttatgtagtccatagaatgtctagggcttttacgggcgctgggtgtcagccacaaagcaagaatgggaagacgggataagatgtgggtgggctccacaaaatccgcgaaagaactataacgcagtggaagaacgagagccctggagggcatacacttgtatccagggaaaccatcagcaacaaacacatctggcgaaaaagacctgggaccatcgggtacacaaaggatccattctcagggacacatttctggggtccccagggttattggcaaagggtcctttggcccttaacagacttgggatggtcatatattaagagggtgactagtatcccaggcattaaatctccatcgacaggacagtgtgacatgttggtggcagtatcaaagtcgtggaagctgagttaaagccagggaacggtgcttggccaaggtcaccccttaagagggggatagagatatgaagagactatgaaataaacacgaggagaaatgatgccctagatgcaacaggtgtgggacccaggggatccccccgcaaagaaaacaggttcagggaaaactcagagcccaaagaaggcatacccatgcgggagctcaaagccgaggaggagaaacaaagaggacagcaa

SEQ ID NO: 543115 - DNA, 107 bp, Homo sapiens
ctgtttggtggtgtcacggatggatgtcccagaacgcaagacggttgtcgttttaagccctcaattccagcttctagtggtctcttcgttccttggtcccgcgcgga

SEQ ID NO: 543116 - DNA, 415 bp, Homo sapiens
  misc_feature (79)..(79): n is a, c, g, or t
ggttttctttcccaagaaaggaataagcggtagaacttaagaacctttttatgtgtgtttaagataccagtccacagtnttatgtttaagaatggcttctcatgctaaataagttagttccccgtatacctttctccttgaggcatgggccagatggattatgtcccattttacaatgactgatggagaattaccacactcttttattgctaaaagtatctcagtgactcagtactttagagcttatgcatagataatgtgataaaataaaggcatggtagatgaaagggtttggctttctttgaggtctgattttcagattttccaattggttactttcccattatttgaaatcctgaacctaatccacatttttaaagtatctatctctacagtcttctttaaaaaggcaaaa

SEQ ID NO: 543117 - DNA, 334 bp, Homo sapiens
tgaggcaccgaacatatcaagactgtcttggctgagcacatcagtgatagaatgcaagaggcgatactctacacatgggcataaatctcagaagaaggcctttaccaagtactgcacgacatggcaggatgaggatggcaagaagcagctggagaaggacttccgcagcatgaagaattactgccaagtcatccgagtcattgcccacacccagaatgcgcctgataccatctgcgccaaaagaaggcccacctgagtgaaaatccaggtgaccggaggcactgtggccgaaaagctggactgggcccgagaaaggattataagcagcagggta

SEQ ID NO: 543118 - DNA, 318 bp, Homo sapiens
cgtttaggcagataactgatattaggcagaagtatatatattgggaaaaaaagatgaattactattaagtggtagtggggaaggaggaggaagctagttatcttaatagaagggcttatacctttttgtattagagacagggtttcaccatgttggccaggctggtctcaaactcccgatcccaggggatccagccgcctcggccccccaaagcgccgggaccacagatgtgagccaccacgcccagcccggaaaagaaattgtttaacctagtatagttatgcatactaattattactttttaaaaaaataagtttg

SEQ ID NO: 543119 - DNA, 323 bp, Homo sapiens
  misc_feature (109)..(109): n is a, c, g, or t
  misc_feature (120)..(120): n is a, c, g, or t
  misc_feature (169)..(169): n is a, c, g, or t
  misc_feature (183)..(183): n is a, c, g, or t
  misc_feature (191)..(191): n is a, c, g, or t
  misc_feature (240)..(241): n is a, c, g, or t
  misc_feature (266)..(266): n is a, c, g, or t
  misc_feature (284)..(284): n is a, c, g, or t
  misc_feature (302)..(302): n is a, c, g, or t
cccaggtgctgtgaaggtgcaaatccctttcttcccttcctcatctcaggctctcctgttttgccctcagcgctccacgtatgcctttgacgctttagtctgttagaanaggaacccccngtgacttgacacagcgtttcacagtctggctgctagcgaccgtgcgggnctgtggtgctcacngtgtgtcntgtgtcatgcgatgcacatgcacggccctggtatggactgtgcgtcacnnccgtcaaccagagcgtgcctccggngccagcttccctccaagngaatgagtggatttcatnacaggatctctttattgcaca

SEQ ID NO: 543120 - DNA, 399 bp, Homo sapiens
  misc_feature (390)..(390): n is a, c, g, or t
tgacaaagaaaagggaagatggagcctccatgctgaacatgcctggtccccaggtagccttttcctattggcatagctgccagcattcatccatgcaagcttccagtttgcttatctatgtttgcagctcaacttttcaggccactctttgttagaaaagaaatgattcgggggctgctttttattaaaagggtaaccttgctgaggactctctttaccctcactaactgcctaatttctttctaggctcctgtatcaaaagggtccccattccaccttgcacaaggcatgagaggggaaggtcccctgtggtaataaaaccctttttaaagggaaaaggtaacttttggaaaatggacccaagccaactttcaatggttttccttggantcttggcta

SEQ ID NO: 543121 - DNA, 293 bp, Homo sapiens
ggtcgacgagcttttgacctcaagtttgaagctgcctttgctcgctggcaaagaacaggacaatcttttgtactggcattgattgatattgatcactttaagagttttaacgacagctatggtcatgccgcaggagatgaggcactgagtcaagtcgcggctctgtttcagcgccatagcaggaactatgactttttcgcccgttatggtggtgaagagtttgtgctgatcctgccaggcacagacacagcgtccgcaaataaaacactggaaaagttaaggctggtagtggc

SEQ ID NO: 543122 - DNA, 179 bp, Homo sapiens
  misc_feature (1)..(1): n is a, c, g, or t
  misc_feature (26)..(26): n is a, c, g, or t
  misc_feature (93)..(93): n is a, c, g, or t
  misc_feature (132)..(132): n is a, c, g, or t
  misc_feature (154)..(154): n is a, c, g, or t
  misc_feature (161)..(161): n is a, c, g, or t
  misc_feature (172)..(172): n is a, c, g, or t
  misc_feature (175)..(175): n is a, c, g, or t
  misc_feature (179)..(179): n is a, c, g, or t
nttatgcagcagcgcgcatggccatngcggatctcaccgcttccaaggcagaccgtgtggtccttggcccatccctgcccgtgctgtaccaanccctgtcgcgtgcggcacgcccactattgggcagcaatncctcggtggtgctgtccaagcnggatccncccacgcaggncgnggcn

SEQ ID NO: 543123 - DNA, 803 bp, Homo sapiens
ctgctcctccatgaggggcatattatttcaagggtattgcttcttaaaaatcttggaaagcctacgagagttgaaggcagcctcgttttagtttcattatgctctgttataaatacatatgcgcataaaactgcttctctcttacactgtttgaactagaaaatcagctctttaatgtaggtgaccacttataagcacaaaagaaacatgtatagaaaaccacatctaagggtgttaaataaaatgtaaacagctcctatttggtagagatgactcatggaaaaatagtgtaggctgggcctgcacgtgtaatgatgagatcgtatatcgcatacatgtgtcacttttaaatactaagtccacacaagcgagccgaatttttagatgacgacgtgcatatataactcgagaatttttgttatctgttgttaagctgaaatgtgtattcatctatcactaaatagcacatagcctttatttatacgtgctctgtatttgggtcacagagtaataatacctcatctaaaaaataaaaaccactactgtgacatgttattaattttaaaagctcgaaaattcatgtagttactctgtgtacatatataatctgggaaagaataattgatgtgtgtatctgccacagttgattaaagcattacacaccatttatcaggatttggtaaacatcccgggcttcttttatctgcttaatcagacatatttttgactgtatgacaagaaagttttacgcccttcctgttttgactctgttgtggattaatagctggatgcaatttttcatg

SEQ ID NO: 543124 - DNA, 929 bp, Homo sapiens
  misc_feature (3)..(3): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (292)..(292): n is a, c, g, or t
  misc_feature (318)..(319): n is a, c, g, or t
  misc_feature (360)..(360): n is a, c, g, or t
  misc_feature (396)..(396): n is a, c, g, or t
  misc_feature (400)..(400): n is a, c, g, or t
  misc_feature (519)..(519): n is a, c, g, or t
  misc_feature (522)..(522): n is a, c, g, or t
  misc_feature (540)..(540): n is a, c, g, or t
  misc_feature (628)..(628): n is a, c, g, or t
  misc_feature (630)..(630): n is a, c, g, or t
  misc_feature (639)..(639): n is a, c, g, or t
  misc_feature (660)..(660): n is a, c, g, or t
  misc_feature (664)..(664): n is a, c, g, or t
  misc_feature (672)..(672): n is a, c, g, or t
  misc_feature (711)..(711): n is a, c, g, or t
  misc_feature (725)..(725): n is a, c, g, or t
  misc_feature (737)..(737): n is a, c, g, or t
  misc_feature (740)..(740): n is a, c, g, or t
  misc_feature (755)..(755): n is a, c, g, or t
  misc_feature (760)..(760): n is a, c, g, or t
  misc_feature (768)..(768): n is a, c, g, or t
  misc_feature (773)..(773): n is a, c, g, or t
  misc_feature (788)..(788): n is a, c, g, or t
  misc_feature (793)..(793): n is a, c, g, or t
  misc_feature (811)..(811): n is a, c, g, or t
  misc_feature (820)..(820): n is a, c, g, or t
  misc_feature (833)..(833): n is a, c, g, or t
  misc_feature (855)..(855): n is a, c, g, or t
  misc_feature (861)..(861): n is a, c, g, or t
  misc_feature (912)..(912): n is a, c, g, or t
ccnttgtcacccagcagggtcctggaacttcttggctggaatacagaaatccagagtcctggttacctacaacatctattctttacntantancttacaatcatcaaattccaccctcaccttattcttttccttatctattccctccaaaatattcttcatttcctccttcttttctaaatcatccccttctttaattaaaacatcttcaacatccttattttcattttcacaatcatattttaattctttttctcctttttcttttttatcattcacattatctccatantccatctaatatttaaccaattccanntttccctccttatattcctccatcatatttttttatcatcnaatttctatatcatccccttccttaataataaattnttcnacttcataaaatcctccacatcaatctaaattaatatcattttctttattttcttcttttttttcatttatattttctcctttttctaatattatttccaccatttcttcattttcttnccnttcatcttccatcaattnattttattcttcatcattaacttcttcaatattttctcccctttcaataattatatcttccaattcaacattttctccacattcatcnancttcaattnatattcaaattaatcttcatncatnttcacttnatcaccactatccaaaatcaaacttgccatctctacatntccatccatgcatncctccattaatncantttgcatctcatctnttttntgctcttnatctncaccatcttcaattntaaanctaaccatatccaaattncctttgtancatcaagtgtganatcactttctttgaatcattanaatgantgttgatgcctgcccatgatctaaatgactcttgcacttccacatgacctnacttgctgctccataat

SEQ ID NO: 543125 - DNA, 171 bp, Homo sapiens
gaggatcccccgccatttacaactatctgggggtggccatggctaggtttatagatagctgcgtggttggagtaaatgagtgaggcaggagtgcggggaggttgttgtggaataaaaatgataaggatactagtataagagacaggtcccctttaggtggatgcttcattt

SEQ ID NO: 543126 - DNA, 266 bp, Homo sapiens
tggggacccctatcctacttaaaacaatataagtcatagtgttactaagatcttgcttagcgttaagtttttaacgtaattttcatagcttaagattattaagagaaaatataaagacttataagagtcgcattaggtaggctgatcagagatcaggcctcatttaagggaaagcaaagaacaagtcagtaagagagaaactggagatcgaagtttagacagtacctttgaggaattcttgttgtaaaatataggggtttccccag

SEQ ID NO: 543127 - DNA, 273 bp, Homo sapiens
tgagtgattagaggatctaatccacctgtatcttccatcattgggtctcggtctgcatccctgaaagccgttcgtttcacttccttaaagtcattctttattattctgcttaaagagttatttttcaagaagtgctctctggtacatttcaccatgtcacaattttatttctctccactgtcgaacttcctcccacttcagactggtaagcatccaggagggagcctcctagaagcacgtgcccttgacatacaagcaaggctgcccctaata

SEQ ID NO: 543128 - DNA, 1512 bp, Homo sapiens
  misc_feature (1122)..(1122): n is a, c, g, or t
gctgtgagcggggcaacctgatacctgtatccatgcaccttcactgtgggtgactctacgaaggtctactacgattccggatgcgccaggtaacacgccggggatcaggttccaccgggactaggcgcgaatcccgacttgcatattcgggacaacgccaagggcgctaacccactgagattcttccggcccaattgtacctggcgtcagagggtgcaccgaccactcccgaggaggatagatggaagtcggcatttcttgtgtgtgtccgcagaggcacgagcgcatggcactaagtaatggtgaggcaagtgcagagacggctagcgcgcggaacgatgcgtactcgtgcacggctacgcagggctgaccggtagggcggagagggccttgaggcctctgggcctgcactatgccggattagtaatttcgccacccacccatggcaagctcaacacgtggcgtggtaaggtccttgcccaaatctattgcgcgctagatcccaatgcccagggcaaacaagaaggcacaccaatcgggcgaccttggaagggaggactgtcccgaagggtatcgcaaagggctcgaggcgcggagaaaaatcatttcgcgcgccatgacctaggggacctggatgccatcggtgttgagaagcagaaagagaagtatgctcatttgactttgagcatggagagtccgcaggaacgaaagggtgcacaccacgtatgggagcctagatggatgtctagtggggatggggttcaatggcagggcacagtgggccatggaatgggacatcccttggtgaacgaccagggtggtccgtagaaatggctcgtggggaacccactgcgcgagggaacatttctacaccgcaaaagggttacgcgagtagggcagcttcgcggtatttcgctgcgaacccattgccaaatctgaactctaagatccgcggtaaggtgtgcgcttggtgacctcgtcccttgggagagcagtaccgttggaaacaccatggatcgagggcacgtacacgcaatgttgggcaccagctttggggaactcgtcttgaccaacacgagtctgggcccgtgtggacaccacaagaatcttgaaagaacacgngcggatcattggcacgcaacggggagagaggtcaatcgacaggagcgcttacaagttgcgaaagaagacgggacaacttgccgaaacgtcccccctggggagttgatagacctgcgcatagggaagggggagtaaacacaaggtgacccgttctagggtccacccggaccactgttgataggacggggacgcacctaggccctgctactgttgtggcacttgcttgggaagtacttcaaggctaggggtgcaagagacacaagcggtttgcaaatgtaaaggcgtgcctgtcgggttctagcacttgacacagcaaggaagttataacgtagtggaatacatggggcgtacatagtgtataaaggaacaggacaagattctaggcccatg

SEQ ID NO: 543129 - DNA, 148 bp, Homo sapiens
gggacactgccagataaagatgaatggacaccagacatgcaccatcaggaaccacgcacctgatcctcacccctgagaaagagccccggggcgtctgattatatccatacagaaaacatctggatttgcagccaaatgtggctacacg

SEQ ID NO: 543130 - DNA, 125 bp, Homo sapiens
cacttttctagaggctaacatactgccactgttcaggtggagactgagcaaaggaagtcctgggctgtgccagttcccagagcttcagcagaaagagctgcagctgtgtgcctgggaaccatcag

SEQ ID NO: 543131 - DNA, 117 bp, Homo sapiens
cccacttccattatcgggcaagagcctagaccagcactcccataaattatctccgacaaattgtcctgccgtgtcaaggtcccacgactacttttgagtggatgatcgactggagtt

SEQ ID NO: 543132 - DNA, 867 bp, Homo sapiens
gggggaaccgaggtggggagtcgccagagctcccagactgcgagcacgctgagccgccgagcgtcacccgcgccgcgtcacggtcccgggccggcctcctctgaccccatccgctctctccgttttccccctctccctcctcctcctgcgagcgagcagtgacttaagcagacggagctgcggatgaatgcctcatttgttctccttcctcgcagccgcgccagggagctcgcggcgcgcggcccctgtcctccggcccgagatgaatcctgcggaagaagcaggagttcaaaatcctcctggtcaccgattcctacaaggttactcacatataaacaatatccacccaaaacaagcaaagtttaatgcctactttgaattgccgctgacaacaagacgaacagacaacagtccaatatttaaggacggtgaacactactgacgggaaacagtacttatgatgggttgcagtacgatcttaaataagtacttaaaaggctaagtagtaccaaagagaaaatccaggaagccaaagtatgtctacagagaactttccaaagatgatgtctttacatgcccacgggcgctggcacctacattcctttgagacaagtatgattgggccttcttgccaagtagaaattcaacatgcttgtaccttgagtgcttttgtcaagttccacagagcgacaattgttctctttcacgcgcgggcgacaacaccgggttcaacaggtgtctggcgttagcacttgggattgagacctattctggtgccgagcctggtatcacattcccagggggcccaacatcttgagcgcacaaggcacttgcgccgtatttttccacgtctggtgcccaaaggtt

SEQ ID NO: 543133 - DNA, 562 bp, Homo sapiens
  misc_feature (54)..(54): n is a, c, g, or t
  misc_feature (380)..(380): n is a, c, g, or t
ttatcagtgtatatgaatgagacaggaaaagcagatatgttgaccaggaagaanaataagagaaattagagagatcaggcatttcttctatctgcctcagaaagcaagatggtgctaacaatgggatgtgctagagggctggaatatttgaggatggggtggcaaaaactggaaaaagatttttaacagaaagtcagagatgccaaagattaccttcctttttattcagacaaactatcctgtaaggtcgcgtaaggatgtggcctccactcacccactcccagcccatttttgtgccagtcttgccatggtcttctgggtaatcctgaaactaggactctctttctcaatcagccaacaagaagcctagtgagagccanaggaggacaactgcagcatcagtcaatcagcaagtgtgggggactctggggacagaatttagaagatctcctttctcttcattacttgtcttctgtgtacaatgctttattaccttcacataagcaaagggcttggtggagagcagagagcaaatagataatataagaatctcacccccaaa

SEQ ID NO: 543134 - DNA, 899 bp, Homo sapiens
gtcagaccccgagagtacagatgatggcagcctgagcgaggagacccccgcacggaacaccccacactgactcagtgacccacagctcagccctacacccacagcagatacgccgaaatacgcatgaactgtgtctgtgcccgatctggggcattcaaggagaagaggacagaggcgcggacatcagatgaggagaatgggccgacctctatcgcccgacctggaccgccatcgcggcgagcatgcagcgcgcatggatgcatgcagagaggccgaggacacccaggatcatcggggacctgccacggacacgcggcattaacacccagcgacattccagaagcatgaagcagaaaatatagaagatccagggagggagcgccccgggaccgcgatccagccacagaacacaaaataagaccaccacgaacacaaataccgaggacactgaaaatcatgagagacgaatccagggaacccgagacaatacataagacagtataacacaaaatacacaagagaatagtccccacacatcatgaacaaatcaccaagacacgaacacataaacaaaacaaacagaaccatgaccaagagaacagaaaggagcgagacatacatgtccaccagaaaacaccagaaaaaagagagaacatgaacaggaacacacaacatccacggcacataacaagaacagagacataccaccaaataaaaaggcagacatagagaatcgagacagaaagttcaatacagacaacataaaattggagtacagcactcacataagcgaataaccggacaaaacgccgaacaaaaggagaattagatcgaccacgagcaatatgccaccacacaccccataagtcacaagaacaggaacaaatcaaagaatgaga

SEQ ID NO: 543135 - DNA, 339 bp, Homo sapiens
tttctctctttaacccaccataaagcttttttaggggtttcttcataggattttccatctttttcaatatccacatttggattagaacctttaagtgacttacctgctggacttgcatgaaataaaggtataactaagaatcccatttaacttattgcagtttaataatatgctggagctaaagcatttccagttgattctactaaccatgatgcaattaaaggcgtagtaccaccaaataaagaaacagatatgttaaatgttactgataatgtacgatatctgatatgtgtatagaacattgttggtaaagatcctggcattgttgcttgtcgacgc

SEQ ID NO: 543136 - DNA, 122 bp, Homo sapiens
atccgcccgcctcggtctcccaaagtgctgggattacaggtgtgagccaccatgcccatcctgttattccttttaactgctgtaattaaatgaaccacctaaaaatctcttttaattgcaga

SEQ ID NO: 543137 - DNA, 465 bp, Homo sapiens
  misc_feature (51)..(51): n is a, c, g, or t
  misc_feature (68)..(68): n is a, c, g, or t
  misc_feature (143)..(143): n is a, c, g, or t
  misc_feature (169)..(169): n is a, c, g, or t
  misc_feature (171)..(171): n is a, c, g, or t
  misc_feature (187)..(187): n is a, c, g, or t
  misc_feature (222)..(222): n is a, c, g, or t
  misc_feature (237)..(237): n is a, c, g, or t
  misc_feature (245)..(245): n is a, c, g, or t
  misc_feature (292)..(292): n is a, c, g, or t
  misc_feature (322)..(322): n is a, c, g, or t
  misc_feature (374)..(374): n is a, c, g, or t
  misc_feature (425)..(425): n is a, c, g, or t
  misc_feature (457)..(457): n is a, c, g, or t
cgccggttcccgactgtgtctcggcacgtggcagcgcgcctggccctgggnttggaggcgccggcccntggatccgccggcgtggtcgccgagtcggtgtcgtccttgaccatcgccgacgcgttcattgcagccggcgagantcagctccgaccccgccgcgccccgntntcccaggaggttcatntgctccttcctgactgcagcgcaattacagcaaanctggaagcttgacgncacctgtnaagcacacgggggagagaccatttgtttgtgactatgaagggtgtgnaaggcttcatcagggactaccatctgagcngcacattctgactcacacaggagaaaaacccgtttgtttgtgcaagcaatgntgttgatcaaaaattcaacacaaaatcaaacttgaagaaacattttgaacnaaacatgaaaatcaacaaaaacaatatatatncagttttg

SEQ ID NO: 543138 - DNA, 329 bp, Homo sapiens
taaatttgcggccgcgtcgacagaatgtttagaaacagtagatgtttagcccgggcgtgatggctcatgcctgtaattccagcactttgggaggccgaggcgggtggatcacgaggtcaggtgttcgacaccagcctgaccaacatggtgaaaccccgtctctactaaaaatacaaaaatgagccaggcatggtggtgcgtgcccgtaatcccagctactcaagagtttgaggcaggcgaataacttgaacctgggaggcagaggttgcagtgagcctagatcacaccactgcactccagcctgggcaacagagtgagactctatctcc

SEQ ID NO: 543139 - DNA, 272 bp, Homo sapiens
gccttagtgcaggtcaccagtgatacgttggcagtacgggacacgggaaggcatgccagtgagcttccctgtcagctcagtgatgagcttgcccacagccttggcagcgccagtagaggcagggatgatgttctggagagccccgctggccatcactgccacatgtttcccgtgatggggccactccacacgtctatctggtgtggccagtgcattggccttggcacgtgtgtgtccatgcagtccccttcccacttgtctgtggctcagtc

SEQ ID NO: 543140 - DNA, 872 bp, Homo sapiens
cgtggtgtctcacacctgtaatcccagcacttggaggctgaggtgggtggattacctgagaccagcctggccaacatggtgaaaccccatctccactaaaaatacaaaaattagccaggcgtggtgattctagctacttgggaggttgaggcaggagaatcccttgaatccgggaggcggaggttgcagtgagccaagattgcgccactgcactccagcctgggcaaagagcgagactgtcttaaaataaaataaaataaaaataataaagcagatgtacaaaatgtgcaaggggatatgctgttttcaaaattattttgggtggtacaggaggcaagagtttgaagactctcttttatatactgatatatggcagtgccaggctattccagaggcaggactgtagcaggtgaatgtcagtctccgctggaatgaaccaatcaaccaacggaaaaactcagctcctatgtgctgcctgcgctgggcggctggagtttcaggctgtaaggcaggactcttaaacgcccactgatgtgactcagcaacaattggacaatgaagaggagccacaactcacctcatttggcacaaatgaaactaggtttggagatgacagaactgcataatgaaaaggaatcctgatctatttcatttaggaacagagcggagatctagttgaaaaaatcctaagaaatctgtactgtggaggaagagaagtcggtgaaactcagttgggtggttgtaccggggaagccgcctcggccatcaggagcttaaagggttttctaggagaggaaatcccctggtgggtaagtcaaaggggggggggttttggggggggcaaaaaaaggccggcggggtgtggggcccgg

SEQ ID NO: 543141 - DNA, 1123 bp, Homo sapiens
ggggggaactgggttccgggagccctgggtccgcgtggcgtgggtggtcgcgcgtgtaggaaggaactggtttcggaggagccctgggcggggcggctgtggggaggaaggtgacgtgcagggggaccagaggctctgcgagcgtgcgtcctaggacagctcatctgtaatcagaaagaaaatagataaagatacagaacggctgacgtcctccgtgagacggatcggggaccttagcacgtgttaatcccgtcccttctgatgcgctcggtgtgcactttgtagagctatagcgtgtttcattggacgtgtctagcgtctcgcatccagtgtccttgatgtggcttttagagacttagcgagaaaggttggacacaagcagggaacttgattttttaagaaaaaatattacattttgaggacatttttgacaagtaggggagagagagggcttctgttgtttggtctgtttcgtataactaaacctgaaggtattaatttccagcgaaagacactggtccctcaggagcactcaggtacagctctgccagggacagagtccctgctagtgggaggtctcaggtggggcggtgtgttctggtgccgtgaggcagcgacatggtccggatggatgtcgtcaccagccttcctcaggtctcatcacctggtcgtacgccaggccgactcttcccagcaggggtcgccagggactgccgtttggatcctgagtcttaatttacttttccgtcaacttaccgatttggagacatttggcattaaagggactcatttaaagtgtgcagcagttctcccagggcggattccgggacttatttgtccaaaaccgattaaccccagggggaacccgtctgggagacaggggtcctggtgtccaacaggactaagggaggggaaaaccctcagagatgactacgggaagagcacaaggggaaaagtaggggggcttttaaaacatgggagggtctactaaaccgaggctgtcccaacggaagccacccataagaaaaaaatgacgcgtatgagtggttcctctttgcttcctctgcttctctgttctttcctccttctcgaggaagcaaaagaagaagaggagagacaaaca

SEQ ID NO: 543142 - DNA, 245 bp, Homo sapiens
gggtcttcttttcttaacagtgttggacggacagatcggggactctctttcagcctcgaccgccctcgattttctttcgcttgcaaccctcgggaccaatttcttggccaatttcgtcttctgggaccgccagcaccgtttttgggtaggctcttcttgccaaccaaccatagcctccagatctgtcagaaatatttcaccgacggtgagggagccgataacagcctggctaattgttaccttca

SEQ ID NO: 543143 - DNA, 451 bp, Homo sapiens
gggatttttcattaaacatccctcagataatttagctatatatcattagaaagggaaagctatcatttttattttaaaactaaacaaggccatcttataaacggtcaccaaagtctgggggggttttattgcgtgtgtgccttgagtgtcggtttacatttaattcactatgttttcatgtattttctgtttggtggttatttcttgtggggtgggatgttcatattatgtttgagagggtaaaaatgtatgagcagcttaactgaagtagaactattcatgatgcttttcacacattgtggcataagatgtaaagtttgtaattaatgttaatttctgtgcattttaatattcttttataattattaatgttaatttctgtgcattttaatattcttttataattatgagcattttaataaattcatttttacaaacaataaaaaaaaaa

SEQ ID NO: 543144 - DNA, 120 bp, Homo sapiens
ccggatgtatactatttgcgcttactttgtagccttcatcagggttttggtgaggcaggtcttgtgttttatttgaaaggacaaatgagagaagtgcttttcatataattttataccttt

SEQ ID NO: 543145 - DNA, 466 bp, Homo sapiens
ttgcctcaggtctcccaagtaggtggaattacagggcatgcaccaccatgcctggctaattttaaaacactttttatagaggacagagtctcactattttgcctaggctggccttgaactcctgggctcaagcaatcctttcacctcagcctcccaaagtgctgggattacagacatgagccaccatgcctggccaacattaatcaatcttaagagtggaacagcaatgtaagttgaagaatcacttaaaagttgctatgagaagcctcctattaatcacatattctgggaaatgactcctaagttccaaatgtaaggtgcttttgttaaggcacgtaggggaaaggaaattcagttgtgtccagctgggattttcaaattaaagggccttctcactaggggtattaagccaactgtaaaatcaatcaaccccgctaaattactcaaaaggacaggggttttttag

SEQ ID NO: 543146 - DNA, 792 bp, Homo sapiens
  misc_feature (767)..(767): n is a, c, g, or t
cgctctttcctttcgcgccggttgccgctgcggagcgcggcgggtccatgtgcgcagtgagtggcgctattcctggcccagtagcacccgagccccgggtttgaccgagtccgcgctgcgatggaccccaacaccattatcgaggccctgcggggcaccatggacccagccctgcgtgaggccgcggagcgccagctcaatgaagcacacaagtctctgaattttgtctcaacactgctccagattactatgtcggaacagctggatttacctgtgagacaggcaggtgttatctatctgaaaaatatgataacacagtattggcctgatcgagaaacagcaccaggggatatatccccttatactattccagaagaagatcgccattgtattcgagaaaatattgtagaagccattatccattctcctgagctcatcagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtataaaaaccagaggagcggagtccattgggtagcagcaaatgcagcattttcttgccagttctaaacggatcggtttaatcccagcttctttcgaccagtctgatcagtctgtctcatccagaaacagatatccagatcttctatgcccttggtccggatcacaanctggacttgtaccagaacctgggtg

SEQ ID NO: 543147 - DNA, 738 bp, Homo sapiens
  misc_feature (23)..(23): n is a, c, g, or t
  misc_feature (181)..(181): n is a, c, g, or t
  misc_feature (188)..(188): n is a, c, g, or t
  misc_feature (192)..(192): n is a, c, g, or t
  misc_feature (233)..(233): n is a, c, g, or t
  misc_feature (238)..(239): n is a, c, g, or t
  misc_feature (279)..(279): n is a, c, g, or t
  misc_feature (309)..(309): n is a, c, g, or t
  misc_feature (317)..(317): n is a, c, g, or t
  misc_feature (322)..(322): n is a, c, g, or t
  misc_feature (326)..(326): n is a, c, g, or t
  misc_feature (332)..(333): n is a, c, g, or t
  misc_feature (336)..(336): n is a, c, g, or t
  misc_feature (385)..(385): n is a, c, g, or t
  misc_feature (433)..(434): n is a, c, g, or t
  misc_feature (444)..(444): n is a, c, g, or t
  misc_feature (457)..(458): n is a, c, g, or t
  misc_feature (462)..(462): n is a, c, g, or t
  misc_feature (464)..(465): n is a, c, g, or t
  misc_feature (467)..(467): n is a, c, g, or t
  misc_feature (553)..(553): n is a, c, g, or t
  misc_feature (564)..(564): n is a, c, g, or t
  misc_feature (594)..(594): n is a, c, g, or t
  misc_feature (607)..(607): n is a, c, g, or t
  misc_feature (664)..(665): n is a, c, g, or t
  misc_feature (724)..(724): n is a, c, g, or t
ttactaagcaatatagagtcagncaatattatctttccccttatgatcttttaagacagccactcaagttagaagagtatgatacaacattagagaaagaaagatacaaaggctttattcatgtgtgatagtaaaaatcaggatgagtcttagatatacaaaagataaatggctatttaanatagttntttntgcttttttagcaaaatattcgcgtgttaagtatttctggntcttnnaatacaaaatccacttattttattagttaaaagtagaagnttgaaaagacaaagtaatattgttttgagnggtaagtngggcnaaanttgggnngcntgtctttgttgttcttcctccattctaaactgctaattatccaacaganacccctaggtcatagtttacgtttctattctcattaaagcaaatgggnnactggggaangaaaaaaaaaggnntatngnntnggggcggcggtcgcctttcggtgtggtccatcataaaaaatatggtttgactcaatatttctatgacataaaatttaaaatctggnagccaattcantagatttctccatgtttgcacaaatctaanttctatttttggntcactaatttggtagtttataaaaatgctggaaatgaaattgtgtctagactaaatnngggagtatgttctattttaaatatttagtttgaaggtcattctcacttttttgcctgantctttcagcgtcac

SEQ ID NO: 543148 - DNA, 101 bp, Homo sapiens
acggccgtgtattactgtgcgggaggcctcgggggcgccaatgtactaatggtgtatgcttttgactactggggccagggaaccctggtcaccgtctcctc

SEQ ID NO: 543149 - DNA, 132 bp, Homo sapiens
aagataaatttatgctgttgatcctacaaaacaagtacagtgatggaaaataaatgggaggtcataaggataagacattaaaggacgcagtagaattggcttataagatgatggatttagaagaggtactac

SEQ ID NO: 543150 - DNA, 698 bp, Homo sapiens
tctatgcattcaatatcaatcgaagcacagagaaaagaggctaaatgctcaatgaaaatcctgttctcttgacagggtgggggttttactccaacgaagaacaagaacatgctaattatctgctggactgtaatgcctgtgtcttactttcatggagggcatggatgctgttaaaattgctgttaataacactatgcaatttgacttgcagcaacaagttttttaccctactacgcaaaacaggtattgttatatattgacccgcaacgcttatatacacaagctgcgtattcatacataacagctttccgttgcttttttgatgccttgcgcttgctggtcacaagctcaacaagtgcagattggtgcacgaattagctctccgtttaatcatagcgtgatatattctgtctggaatgagaagagtacactatttatactttctgcgaacgggttgaatatccaatttcatatgcttaactcaatgatcgcctgctcaccggagattgtgctgcataacttcgtgtctatgacacttagctgacgtattctcatggaaaacacattaagtggctttggtacccctggtggaaagaccttttggacccgcgcatttcattgcgcatgatgacttttcaccgacagattggagaacacttttttctttgttttggtgtaaacgttatacaaaaaaaggg

SEQ ID NO: 543151 - DNA, 212 bp, Homo sapiens
aacccgggccggtagagcggctacagaacagaatagaacagaacagaatagaatagatagaacagaacagaatagaacaaacagaatagaatagaatagaatagaacagaagagaatagaatagaatggaatacaacagaatagaacagaatagaagagaatagaacagaatagaatagaatagaatagaacagaacagaatgtaacggaat

SEQ ID NO: 543152 - DNA, 112 bp, Homo sapiens
tcatcgagctcgcacggtgatgcgctctgaatcagaacggaatggaaagtcgccatagctggtgactagccccgatatgcgaaagcagtattgtggaactaggtgtacgaca

SEQ ID NO: 543153 - DNA, 431 bp, Homo sapiens
tgggaacggctctgccggcccaggtgcctcgcgcatattcatggaggccgcaggtagaaccgagtctcactgtttggggaaatgcctgcgatctcccggagatagaaaggcgggaagtttattgaggagcaggtacagtttccctactatctcctgcagtacatataatctagtctatcttcagactatatttaagcgactgcttcatgtatgatgtctcactcccacatcctacatccattgtcaggcaaactttctagatagcaccgtgacccatcctttcaacccccaagcagccctttcctattatctggtgtccgtgtactccccagtccctcctttcttcagggccctcgctttatcaccttcatggacagaacatacttagatctctctaaacctgcggtttatacctgacacgcgtacagtaa

SEQ ID NO: 543154 - DNA, 343 bp, Homo sapiens
agtcacactatggagcagctgagccaggatttgaacccagcagatctccagacccagactggtccacccggggcccagccatggttccctgggtcctgatgggaaaagctgtgtctagcccggagatgaaccagtttagggaccattcccttgagcgcgtacgggctaatgaagtgtcgatccagttgtgctggactccctcaaacaccaaacttttctaaaagcagttttcttgtgcacatttaaaatggatgtttttctgaaatgtaatatgcactttctcatcttcttaaacagaaaaatgcaagaagcatgcaacctttgctgttggcttgaattgttt

SEQ ID NO: 543155 - DNA, 357 bp, Homo sapiens
acttcaacctgcttcgcatgccttggtgccgacgctttccgtaccagccactacctctatgcagaggcagtagatgcagatgtgataccgctatgggattgtggtcatcgatgagtgtcccggcgtgtgcctggtgctgccgtagttctacaacaaggtatctctgcatcaccacatgccggttatggaagcagtggcgcgtagggacaagagccaccccggtgtcgtgatgtggtctgtggccaacgagcctgcgtcccacctagaatctgctggctactccttgaagatggtgatcgctcacaccaaatccttggacccctcccggtgcaggtgtccggagcaggtttgggacat

SEQ ID NO: 543156 - DNA, 314 bp, Homo sapiens
tacaaatgtttgggctttacaggcatgatttcacggattcaaacaagaaattaacactgttatttagccttctgcatgacatacacagaaataacattgctacaaactgcaatggagagaatcttgtttcaaatggcttaatttggggttttgactcaaggtctcattctataatgaaagctccattttgagggtttgtcaaattgtgatactattttagcacataacagaatttcattgtgactatattcttaatatataaactaacgcttaatacgttgtgtattaatgctgtacattcattatatcaaatg

SEQ ID NO: 543157 - DNA, 1817 bp, Homo sapiens
  misc_feature (1437)..(1437): n is a, c, g, or t
atcattccctctaagatagtgttggcgcgcggagacaacactctgctcctgcggttttttaagcgacgtcccttttgggttcggctcataaaatttgcttgctggttgatgttgtttggtgcgtttggtcgccgttgaatattatgatttggttgttgcaccttgtgtgtttatatacttctgccgctccctaaactaatgggggggggcccaatcatttgtgttcaccaacatccaaaaggtgggggcctcattctctcccccgggggatccgtactctccactagttttttggggggggttgttgttcacgcacctcctgcctaaagtgacatagatgatcgtggtggtgtggttctctttttgaggatgtgctcctcgtcctccgttgattgtgggaacaaacttttgtggcgatactcactttattatgggggccggccgggggctgcctccaaacttatgttcccctcaccgggaggatgtgtggtgtcctctatctccccttcccgtaaggggttctatcaatttctccgtgctctagactcttctggggtgggtctgccctcggggcggttttctttcacgccaactatagtgtgtcgccttgtccttggctgcttccctggatgacaaactcattgggggctactctgcggccctgccgaggagggcggttggtgtgatcactctctcggcggggcgtggttgctatatatattcgccctctcgcgacagtgttgttcttttgtgggccagtcaaacaatccccccgtggttctcctccagcagtaggtgtagttcctggggcgcccccacaacacccctttttgtaggagagaggtgttgttaccccgcatcgaaccacaacacattctacgcgcgttggtgcctcttcggtaggtgggaggacagacctttgtgtttgttaataactaacacctcggcggcgcctcatctcttggtaggtgcctcggcgcctgcatatgtgtgtctctggaagagccgtgtttcttaacagcccctcctttattgcttcttcgtggcgtcatgcgtatgctcctccacctcacctttggtcgcgacaccacaccaacgaggggcaccccgacacacaacttttgttgtcgcctcatcgggatcttggagcccctcctcctcgaggcatgtttctctacggggccgcccatatctccacacaagacgcggggctctctctgatatagtgctcgtggggtttttctccaccttgtggcccacctgtttgtctctcaagagccctcccgtggaatctccccaattggcgcacagagaggccaacgtttcacaacaagagggtctcaccccggacactcgggtatctctctctttacccgaggtgcgacacctctccgcggcgcagagtgtatacccgcgcgctctcttcttgtgggcccnccctgttcaacacttgttatagagaggcgctctgtgatacacacactggagaacctctcgcacacgcgtgtacttctcgcgagtgtgattctataagacccccagattaagagtgtttcacgaggactggtgtaaacgcgactgttctattcaagattaagaggcccccgctgtctgggcaccacacacccgctgtctggaccgccgttccaccgcacactttggcgccctggcgtggagaccaccaccctgcccccctaccagaaagacccagactgggttccccggacagcccaacaggggcaccaccccagaccttagggtgcgctcccaacactgcggggcttttttgccaataaaagttcacgagcgtttggaaa

SEQ ID NO: 543158 - DNA, 162 bp, Homo sapiens
gtatctagaggatcgcttacgggttgtgcatcccccctcaccccactgcttcagggtgctaggtgagggatgtttttcctcccccttaccgcccatgccttgaaagaaaagtcactttttgtggagggcatcattcattccggattcacaaacccggaaggt

SEQ ID NO: 543159 - DNA, 280 bp, Homo sapiens
cgtcgttgtactgagagacgttacgcggtttcgctgactattctgattagcgctctggcctttggcagcgaagtcagatatcgataactttccgccggttattcagatcgggcaggggaggtcgcggcggcacgattgaatggtgcagcaagcgatgttcgtaaggatcggatttccgataagcctgtatggtattcttttaactatggggcttgtttttttggggaatcgattctatgtaacgtcaacagacacgcggtgcgtggggctgaatcttcag

SEQ ID NO: 543160 - DNA, 133 bp, Homo sapiens
ggcggaccgtcggtctctgcaagacagttcattttgttaatctcaaatctgtttttcagcacagttcttaaagtagaaggagatatgctcagttcttcagcgatttccttttgttttatttttacctgcatat

SEQ ID NO: 543161 - DNA, 114 bp, Homo sapiens
gcggccgtctactactactactgctcgaattcaagcttctaacgatgtacggggacatgaagatccccgcgcaattcaacgccttctggcttccaggtgatgactgggccccca

SEQ ID NO: 543162 - DNA, 142 bp, Homo sapiens
aggttatgtcttacggagtgtcagtctgtgctggctcagccctcccccagcaccggaggagggccccgtcagccccctctactcctgaccttctcagtcccacccaggtgagccagccacgtgggtcttgcgctgcaggtct

SEQ ID NO: 543163 - DNA, 167 bp, Homo sapiens
tccagaggacgggggtaggaaatgctccaggaatctgaggaagtatcactccgcttctcctgctcaatggtcgtcttgggtcggcagggatgttctatcatcctgacgctgtccgtatgcttcagtgtggccgtatcgaagctggcgatttcccccatgtctggttt

SEQ ID NO: 543164 - DNA, 184 bp, Homo sapiens
cagcatgtccagcacgagcacctgactcgcgctgggatcagcaggcagaatgtgtgtcctgcgtggcatggtactgtggctggtgacctgcccgctgccccagacacggcacctgacctggaaagacgtcgcccgcctcgtactggaagccggcagcctgccataatcctgacaggcctgggta

SEQ ID NO: 543165 - DNA, 1143 bp, Homo sapiens
  misc_feature (254)..(254): n is a, c, g, or t
  misc_feature (603)..(603): n is a, c, g, or t
gatatagacgggataccgataagagtaaagacgcgactactaaaaacaaataaatagacccaagacgagacgcgcgcggaggtaaacaattcttctaaacccaaataaatactgacttatttaaggatcaaacaatgaaagcctattatccttcctatactaaatacaagagactctagagacctaaataatcaaatcctacgctaagaatttaataaatacagcgctaacccacgaaaaatctcttaggaatnaaatcgagctcctggatactcgaagaatatgaatccctcaaactatgcgaatttaaatagaggctcatatccgctgatgaagacaaaccataataatctctccacgatggaaattagataagctacgctaaccaagacgccatattataccgactcatgattccaaataataattaggactcctagcaagaagggaaggcttataacgattattttattggggtaggaatctatgagttcaactatatacacgaagtcgaataaatagttagttagaatggtattcatggatggaaggtaggactactggacgcaattaggcattacctatttaagtttataaaagctnaggtggaaatgaccttggatagtattagataaactctatatactagtcaattgatcaattaaaacgacacagattacatcacgattagatcgaaattcatatttcaaactattgctacttgttgagattcgagcaagacgtggtactattcgcgacaataattagagcgggatttcaattaaaagtgttgttgaggtattctttataaggcaataacaaaaaattaagaaaaaaaaaaaataagaaaaaaaaaataaacataataaaaatattaaataataaaaaaagaaaaggaatacaataataaaaaataataacactataacaaaaaataattatatatagggcgttaatcgggatacgggacggaaggttatattgagagaatcacacggtatgacataaacacaaacatagaaacacattacatatatacatacaggatagagacataacaattaaattatacttactaaaacaaaaagaaaaaatataacatatatataaacagaacatagaaaaagactaacgaaaacagag

SEQ ID NO: 543166 - DNA, 346 bp, Homo sapiens
  misc_feature (153)..(153): n is a, c, g, or t
  misc_feature (172)..(172): n is a, c, g, or t
cattacagacaaggtcctcatcacaagcccagaatgatggttgtccttattttaaaacacttatgttgggctggttgtggtgtctcatgcctgcaaccccagcactttgggaggctgaggcaagagcatagcttgagccctggagttcgaganccagccctggcaacatagncgagactctgtctctacaaaaaatcaaaaaactagctgggcattttggcatatacatgtggtcttagctacttgggaggctgaggtgggaggattgcttgagcccaggaggttgaggctgcagtgagctgtgatggcaccaccgtacttcagcctgggcaacacagcaagacct

SEQ ID NO: 543167 - DNA, 185 bp, Homo sapiens
caggacttaacatgttgactttcgccaggctaggagtcaagtggagctgttgctgcctgcctatgccagagccacagcagtgccagatctgagatgcgtcttcgaccaacaccacagctcatggcaacgctggatccttaacccactgagcaaggtcaggaatggagcgaaagtcaacgatgtgt

SEQ ID NO: 543168 - DNA, 659 bp, Homo sapiens
gccacagctacagcaatggaagctctcgcctcgtcgccgcgggctctcttcgcccgcaccgccactccgacgacggcgctggccacgccagcaagatggacgccgtcatcgaccaggcgtgtcaaggccgccgccgccgccgagccggccggcgaggccaagccggctgcggcagccgcgtcgccggcgcccaagaagatcctcaagaagaagcccgtctactccatgaagaaagggcagatcgtgcgcgtcgagaaagagaagtacctgaacagcatcaattacctgtcggtggggcacccacccttctacaaggggctagactacatatacgaagaccgcggcgaggttttggacatcagaatcttcgaagaaaccggagagtatgctctgatcgcgtgggtagggattccaacaccaccagcatggctcccaacttatatgctcatcaagtcagacaaactcgactatgagaggatatgatcgccggatgagcgattgcgagggagaacaatgttttgtgcatcaattgatgtcgctatgtggtgatgttgtgacattgctccatggatacaagattaagcagttgtaaatcgaagaaacaacagtgaaatatatccaaagttgttaaaaaaaagagaaaaaggacgcaaaagggg

SEQ ID NO: 543169 - DNA, 158 bp, Homo sapiens
  misc_feature (9)..(9): n is a, c, g, or t
tttgggggnttggggcccccccccccgggccggtttttcccttgggaaaaaatttcttttccccttggggcggggttttttagggggggggggttttttcccccgggggggggggtttttttttttttttaaaaaaaaaatttgggcgcgggggaaga

SEQ ID NO: 543170 - DNA, 241 bp, Homo sapiens
tatgtaaaaaccctagcgtgggtgtggtggcacatgcctgtaatcccagctactccggaggctgaggcaggagaatcgtttgaacccgggaggcagaggttgcagtgagccaagattgcatcactgcactccagcctgggcaacagagcaagaccctgtctcaaaaacaaaaacaaacaaacaaacaaaaatatatctattcttgacaattgctatgagagtagatttcagttgttcttac

SEQ ID NO: 543171 - DNA, 903 bp, Homo sapiens
  misc_feature (903)..(903): n is a, c, g, or t
ggcgggagctcggctggagtggctgggccagtgtgactggtccgggccatgccgaggaagaatgccattcatgctgtgaatgcatgaacgaatgaatgcagttgcatgtgacaaactggtgatgctgtgaatgcagaggtgcttcaatgatggtgcttgctgctccatgttccatacagcctgcatgctggtgagcctgggatgctgtgcgagaggaacatgacctgacaacctcgtgactggtggatgtcttgtgacccgatcatatcctgcagtgcttaaccatgcagccttctcacgggtgctggtgtccacgagtgctaccgacccaaaatctgataaccgactgccattttgcagaggcagaagagcagggcaggcatggtcagagatgtgagcaaatgagcagcagccctgtggaagcgaaggtttcatagagcctggttcatgtgcgtgagattgttgaggaagctgggacaatacagggaagagtgtatacaagacttggcatcagattcttggacattaccatcagaaagtcgctccatatggaagacatatgaagatagtacagaggaagcaaacataatagagaccaatggaggaagaggaagcttcacaagaaatatcatttggagaaggattcattggggctttactccgtctgaggaaagtacaagactactaatgaagacacaaagtctaggacgacatatgaaacgagaaagggattggtaggagagggagatgataaaagaagagttggtcgtggaacattaaggtgaagatagatttaagtacacctcgcattactcacggacgaaattcgaaggataagtaggaagataacagagagaaagagagtataataagaatatcagtaaatagggaaaaacattgggn

SEQ ID NO: 543172 - DNA, 231 bp, Homo sapiens
atctcaaccatacctggtgggagtcttcgctccaacctcttcttccctaggttcaaagccactatcatctgatgtgtaagggatgggttctgactggcagaaataaatacagctcccaataggagcccacggaactaagtagggtcccaagaaaaaaaacgggagctatatcacaagagctgagcttctgccagatttcattcctcaaacctttagttgagggtaaaattg

SEQ ID NO: 543173 - DNA, 738 bp, Homo sapiens
gggaaatgggagcaaggtctcagcacccgtgactgcacgggccgtggcaggtgggggcagcggttggaaaatagctgtcgctttcgtgacaactctcaggtcattgaccagccctgtgatgccttctgatggttttaggaagcaacaataagtaagcaccactggaagcagtgatggcgcgagggagggctcccaaggtgaaggggcccatccgtgcgtgagagatgcaggttttgttgacgagcctgggaagttcacattcccctcaccccatgaggaaactgagatctgccctgagccccagaccctgtgtcccttcccaggggcttgtgtgagagcggccacatggtgcacctgtagaggtgaaaaggatgcccaggggctgggtgggccgtcttgctcaggaggaaatgtacccccacccagtctcagcacaactgcctggccagccccatcctggtgacccaggtggtctctggtgggccctggtcctggagggctctgggattcccccaccagacctgcagcccaggtggggaggggcaggtccgagactcctatcccccgtcattccccacctctgaggctggacctcacctttgacctgaccctccgaggaagaacaacttgtgttattgctgggggtcttcgggtggtcagcacctcaccacacaggaggaatccttctgtctctgggggtcacagcaaacgctgggacaaagcagcagcagggtgcgg

SEQ ID NO: 543174 - DNA, 187 bp, Homo sapiens
cctagcggaccccgggtgtaccttgtctaaatcctatatcacgcctcttggacttaaaactaactgatgcggatttatttcgaggcatagtatccctgtgcggacgtctaacaagaatgtatctcatcatcgtagtgtagaggtctccaggctgattcgaatgtgactatggtatcatctatacatc

SEQ ID NO: 543175 - DNA, 180 bp, Homo sapiens
ccagccctggtcccgcgtgttgctcactgcagtgcccctctgtacccgcaggaggctactggcgtcgagccacactgccttcagaaaacttcctttcatctgttcctactgagactggtcccagcctgcagttcagagctgccctctcctggcgcaggctgcctccccgcctctgcttgc

SEQ ID NO: 543176 - DNA, 452 bp, Homo sapiens
aggattgacccctaggtatctggagtggatttactgagataattatctttttttttttaatggcgaagtgctctctctttccttgaaacttggtgagactatttggagcgttgagttgaggttgatttcgtccacagaggtttggtcttggcttttggcctgttgcctaagacacagcccggcccatgatacaattttgatggtcatcacttagcatcaaagtaatttttaggccaggtgcggtggctcatgcctgtaatcccaacactccgggaggtgggtggatcacctgaggccaggagtttgagaccagcctggccaacatggggaaaccctttctgtactaaaattacaaaaattagctggggtgtggtgttgcatgcctgtaatcccagctactcaaatgggtgaggctaacagaactgattgcacctgggaggtggagattgcag

SEQ ID NO: 543177 - DNA, 691 bp, Homo sapiens
agcgggttcaccggacgcggcggatgagccggccccgctggggaaggctcaggccggcggcgggcggccgggaggaggctgcgtgctcggggctggggctgcgagcggggtgattttgtattaaaatgaggaggaggaagaagaggcacccacagcggcagcggcggcggcggcggcagcagcagcaggagcagccggccgccgaccgcatgcagcagcagcagccagcgaggagccagagcggcgtcacacgagggcgcaagcgacggcggtctgcgagcatcagtgcaagcaagatggaagcaagggcgagcaagatggcagggcaggcacgacggagacaagtaaactaacggcaggccagagaggcagatccgtccgtcagtccacgatcacagaggaacgtaggatgcgtcgatagctctgaggaccggatagggaacggaaccgagagactaattgcacttagatttcgacagggtgcgagcgcgacgtcggtcgaacgagacaacacaaaccgattcaatcatttcatatcgtagaaaacacaaggccagggcagagctaagctagggaaccggaaggcaaccggaggggaaccgcagaggcgaggagaaagggacgaacctgacgcacagagaaaggaagcggaacgggcatgggatcgggaagaaagaaatggaacgaagga

SEQ ID NO: 543178 - DNA, 450 bp, Homo sapiens
gcacgatggcgcgtctgttcccgcacagcctgtgaaacctccattttgccactttcaaggtcagtgcccctgaagacccgtggccgttgttgaccataacactagctttggccacaaaagccagggacacctacgcttggaaatgtgcctgcaccactgtgtggtgcctccttaagttgccccagactccagatggtcaaagaaaaggtgaatgtccaggtggctcatggctcctaagtatggggtgtagggtggggaatgaccccggcaggtaaggagacagcgactaaggccaagcccatattttctggtagtataacggacatttctattcttgactggtaatacctagaagctgtcccggtcacgtggctctacctgacaatgtggtaaatcagacccgtgacggagcaaggtgagcgttcacattctcgcatagataatgggctg

SEQ ID NO: 543179 - DNA, 241 bp, Homo sapiens
cagggagacgtgtggaaagataactctgccaactaccctacagttcattccagtttgcccgagggccttgcgtgggcagcctgaagtcgagattccctgagtgagcttcccactcaaggtgttgctctgtcctcttgtggcgtgatgtcctgattccgagctaatccatttttgtatgttcatgccccacaaaggatcttttgacacggcgtggcagcaaaagctgtaatgattcttctta

SEQ ID NO: 543180 - DNA, 145 bp, Homo sapiens
tcagttaagcgagcagtgctgggggtatgttgtgttggtcaggcctgccttggcctcccagggtgctagggttgcaagtgtgagccaccatgcccagctgagatctgatggttttatacatgcttgacagttgctccgttactga

SEQ ID NO: 543181 - DNA, 804 bp, Homo sapiens
aagagaaagaaaacgcagatggtcagacagaaacatgcacgacctacagcaagtgggacaacatccaggagctcctgggccaccctgtggagaagcctgtggtcctgctcgaaggtcttcctccccaaacaacaccaacccattggttccacattctggctttggtcttcaggcgaatgatcttgaggtcatgcagaacaaccacgagtgcctcggtgaccctgtatggtccccccaggccgggtagggcacctgagaagcagcggaaactccccctagggacaccagcacccatgcccctcgtgtccgtggaactgtgcatcaacatccgtgctcagttgggctctctgtaccaccctgtgcggcttttctatggactagcctggccagtgctgaagggctgtcgtgatggttctgaggtggggctcaggctggggtgctctgccatgggctgaggggcccagatattcttctgtccatcttcggctgctggtgccagctaggggacacagactgccaagagaagcacaaagtcagagccttgattcctggacccaggagctcctcaactaacaaaggaggcaggacgaggtcaacccatgtccccatgcgacatagggaagactccggcggcactaatcgcggacctggaggaagaacaggcaaccccagggattacaggaccaagcgtcctgcacttggggctccacatggcagacacgacccttatacaggcacgcgggcacaagtgtacacagtaactggatgaaaacatagaaccaacaaccacttcagacaccggac

SEQ ID NO: 543182 - DNA, 439 bp, Homo sapiens
ttcatgtcagggccttcatccccacactctctctggtgacagtactcaacatgtatatggtatgcctgcaaggtcctttcatgttcagtttcaaagaggagaggcagggataagaggcctgcctgggttcacgagaggaaggaagggaagcagcacctgctcctgttcagggagcaagcctgactgggcatgaaagcactcgatatgaattcatgtccagtcctttcatgccgtcagaggagtcctcaggaggcaggaagtggctgtgcctccacagttgcaggtgagcgtggcgggtgaacctgatcagggcactgcaagggaagcggcgcatatgctctgcacagttgcccaaagctgcctcgtcctgtcgaaagaactcctcgaaggcctcaaaatggtgagcacaggccctggggaatcttggcggatgattggg

SEQ ID NO: 543183 - DNA, 372 bp, Homo sapiens
tgataagattaacacctagtctctctgcttgtcgagtatagctctctgggcaatcacgctctacatactagagggagcttcacttggtaggacaacaagcttaccagagtacctggtgggctaggcagagcataagtacatccaggttgtctaccttcattacaacaatatctactgtaagtttgatacaagtgacttctgcccacctggatcggaacaccaaagggagggcttctttaatacgggtagtaggagtctattttcagcaaccccggtaccagtactgggagatacagccataccaccttacagatttgtctaacgtgcgctctgccattcaactcggaaactataagtaattcttcaagaaag

SEQ ID NO: 543184 - DNA, 188 bp, Homo sapiens
gagttcgggcaacatggagagaccccatctctacaaaacattaaaaaattagttgggcatggtggtgcacacccgtggtcccagctacttgggaggctgaggtaggaggatggcttgagcctgagaggtcaaggttgcagtaagacatgatcacgctacttctgcactacttcaacctcagcaatgcg

SEQ ID NO: 543185 - DNA, 250 bp, Homo sapiens
  misc_feature (142)..(142): n is a, c, g, or t
gagatccccgatgcaagttgtcaggacagagccatgttcaggagcggagccatgtgttttgctgatcgagtcgaactcgagcccaggtctttagttgtttcatctgatgtcggtctttggggagaggcaaagggtgaagttncttctacttacgatgcggctgtgtgttgaactccgtttcaaaagatgacagctgctgcgtactcctaaaagtccaccacctccacactgagaatcacccagatgacat

SEQ ID NO: 543186 - DNA, 1113 bp, Homo sapiens
caacctcgttatctactctaccatcttggcaggcacagtcatcagcagcgctaagctcggcactgatttattcacgttgacgtaggcgccgtaggaagagtaaagcatgacgtagcgtgttgtgattgcacagattgcatagaacgccaaagaaaataacagcgctcggatctctacagaagcatgccatcatacgttattgtccctcacagtcaacgcaatccgtgatcgcgagtaatcctgtcgtgaataggcgtgatgcgcttcttacagacaatgatagcatctccgggacaatgagaccgtaagccagatactacgaatcaatgactcatcattaataatcataatggctatagcaataagaatctaggaatagtccgccctttcacttctgaggtcccagcaggttaccctaatggcagccgccgtctggacgatgccggtcactggcgtctcgtgtcgtcagcagtgtacaagaaactaggcccccattctcaagtcatataaccaatatctctccctcactaaacgtaagccttctcctcactctctcaatcttatccatcatagcaggcagttgaggtggattaaaccaaagcccagctacgcaaaatcttagcatactcctcaattacccacataggatgaataatagcagttctaccgtacaaccctaacataaccattcttaaatttaactattgatattatcctaactactaccgcattcctactactcaagttaaagtccagcaccacgagcctactactatctcgcacctgaaacaagctaacatgactaagaccccttattccatcaccttctctcctaagagggctgcccggtaacggttttgccaatgggcatatcgaagattccaaaagatagcttatatccaccataatagtcacatagcctcttaaactagtatactaggctagtaaagtccctaagaagaagtcccattaacggaaaacagaagtgggaaacaaaacccaacccaacaggcaaaagggcaaagaccggaaaagttaaacaggggagacacagagaggacacgaaagcacggaacagcgaacagacagcggagagaaaagcagacaacgacg

SEQ ID NO: 543187 - DNA, 390 bp, Homo sapiens
ttgggcctgaaatcccttaaaaggcctgatagctttaaaaattagggggggttgtctgtctggaagtgttaagtggaatgggctttgtccccccggaggtgggggaatgtggtaaccttgaataccgttgaataaaatcgcttccaaaactccccctctcccaatgcattgttaagtatgtaaaagccataaccttgattttctgttggacttttttggaactaattctgtgagagttgagctccttttctagttggaagaatgtgatatttgttgggttggtggtttccctaatgcccctccctaattagattttgataaataggtttgtccttttgccagttccatgtttttaacctttttcaatgaagtcctccttttgacttgtta

SEQ ID NO: 543188 - DNA, 212 bp, Homo sapiens
cgggccaacgcaccgtgttgggccacgcaccgtgcagtggataccttattccagcggggattcttggggccattgtgtgtcgtgggcgtctcgtacaccgcgtagcccaagcgcagtccgcagtacgggtccatgccggtcatgccgtgattcttggccgactttgcctgttccaccgtgatgttcagtcggcccacggtgcgttggcccca

SEQ ID NO: 543189 - DNA, 288 bp, Homo sapiens
ggtgcacacctgttaatctcagctactcgagacgctgaggcaggagaatcgcttgaacccgggaggcggaggttgtagtgagctgagatcgtgccactgcaccccagcttgggcaacagagcaaaactctgtctttaaaaaaaaaaaaacaaaaaaaccaaacaaacaaacaaaaaaaaccttatatgggctgggctgggcgtggtgccttatgcccacaatcccagcattttgggaggccaagatgggaggttcacttgagcccagaagtttgagaccagcctaggc

SEQ ID NO: 543190 - DNA, 1602 bp, Homo sapiens
tcccgctccggagttccgggatcctggaggtgggggctgtgccctgagtggagggcacagggaaccgggatggggctgggcggacagctgagtgctgggaatgtgtgctgatgatttcactcctgtgggctctgggtctgagctacccctgtgcttcagtgctggtcctgctgcctcctctccccaatgacccttctgtggtgacacatgcactgcatgaccctgcctgtgagacaatcttgttgctgtgtgatgccctggacgtcctcgtgaataaccactatgtgtcttcttgactacgcctgtcatggctgtctcctgctttgactaacattcagtcatcgcacttctacgcgggcctgcccgtgacacctatggttgcatcgaatgtgccacagcttcggtgttgataatgcactgtgcttgagccctgtgcatgctgggtgcaccattggctgcttgaccgacccatctggcctcggcccttccaactgccgctgtgtgggcgtgaccgtggctgcaccgcccttttcgcgggacacgtgagccgtacgattcagctcctgtggcacgcagcacgtgactgccagccccaccttggtggaagaccggtcggttgcgacaggctggcttcgcgctgaaatggcccaacgggcttccccatggcagccctgccttccactttgcgaaacgcacttgtaatcaggccccatgtagttcgacgtccggtacatcagggccccctggcctggaacgaccaacgcacggcccggtaacgacactgcgctatccccagttggcccttcttagttcctcgggagacccttcccctacaacacaacccacacgccactgtctgcggaagcctcggtggcgattctctcccaacgctcctcccgagcggacacgcacctgcccgcggcaacgccactgggctgcgcgcacgcacaacggactcagagaccccaaacgggacctccccccggcggctccataatcggccctccctgcagcgcgcacgcacccatgccagcgggcgcccacctccacgtccattagcacccccgcactgggggcccacccgtcggccgccgatcacaatgcgcgacgcttggacagccatgagcacgacacaccggggtgcgacacacagggcaccgcacgcaccgcccccgcgtccgccacacgtgctatgtgacgcaagtggtcgcacccacggcgcccacggcgcgcacccccgtgccccggggccgcaccaccgcacaccccggccacgcactgcccctggtgcgtggagccacccccggacagcagcaacacctgcaggaccagtgcggacgcccccctcacagcgcgccacccgcgcgcgcccgccacagccaccacagcgtggcgtccggccccgacccagcacagcgcacacccgtcggttcacccggcccccgcgcagcacaccacgaggggcagcgaacgcaaccgcacgaacgcagccaacccaccagagccagcaggcagctgcctgcaccgcaccacaccagcgctcacccacccaaaggccgcaagcacacgccccctggcgcccccccactcgcccaccaccac

SEQ ID NO: 543191 - DNA, 1043 bp, Homo sapiens
caaagggtacggtggccatgagccctcttgccactggataaacatggccgccttggtgacatcccccaggactcaccatgactctcctccagtctctccaattccacaaatcccttccctgccatatgtccaaactctgccaagctgtgatgaacgatgagctgataagctgtgctgaaaaccatggtgggtggtgcttgactcagcccgccttattaccccaaggagccttcagggacacgtccttctggcactgctccacgaattccctccattcttggctagtgatctcgggaggggtaggagcaaaggctcgtgggaaggcgatatcaagctatgagagggagaaccacacgtagaccactaagggcacttttgttcctgccacaacggaacacaagttatccattcaagtcgtcctcatcccgaatgcaatgcgatcatgagcgtccccaccaaacaggacgggactactgtaggggatgagcgtgggcgaccgggcctggagtgcagtggcgccacgcattaggacacattatttcgggttattgtggtcccaagtttaagctttttgtccatgttctattctcgagacaattaaaagtgttttccgtttaatcattcaacccggtaaaaccaagacaacctggaccttgagagcaccgtgtggcgcgcggcgcctttctgaaaggagaattatggcgccccccgaaagtgtgcgcccacgcataacggtctgtaaacgcagcgttagacaccccgggggctatccagctgtaggataaccacactgctggtgctccccccactataatagtggcggagagaccacggccttaatctaaacatcggcatagtgggtccttatggagcggcccacgttcagatttctaaaagctagaacccgattggttgcaaacctgtggccttaaacccttgtatgccgctaaggacttcgggggggacacctcgtccccggggcgaaaagaggagcaaacccctttgacctttccctagggtcgggtaggtgtagctccactaag

SEQ ID NO: 543192 - DNA, 213 bp, Homo sapiens
actgactagcccgacatgcccacgatctgtggttaccccccaggtgacagcccatgccaggcacggggacctgtgccacacgaccagctgtgctcccagcatgaggctgtgctgtgtcagttcttctcgcgaagtgtgttatccccccgcactgtctgggctagtacggggacgtgtcgcggctacgtacggggcgggtacctgaggctcgaa

SEQ ID NO: 543193 - DNA, 919 bp, Homo sapiens
  misc_feature (57)..(57): n is a, c, g, or t
gaggaaaggagatttttcttttgtgcatagctctcccgatgtaaatcctaggtccgnaatcctctgtcctggcaaaaccacaaagttccgtatggccaagaggaagggaataattcatctcccccaaggatgaaatgggcaaccattgcttattctcgggggtaaaaaatgggaccttcttgaccagccaaagccactaatccactggggctggaatctgatgtaacaatgaacatttcgactcttgttggtaaatgctcaatgccttcctgaaaaaagttggggtgctgccttaccatccacgagataaagcagccaaggaccattaaccagaaaatttgaaggagaaaaacttcaagcactgatcctcatatagatcacgtatagctcgtcatcgacatctcaccaccaatctatctatagccagattcaggaacagcgcatcactgaaagaagctccgtcgacgaaaggacagtgaatcgtattaaacacagcaagcctcggatctgtgccacttgtgtcagaggcaagaagaaacacgtagtggcagttgtgcgaataattggtattcctaacaatgccatgatgtataattatgttgttactttgttgatttgagaactctacaaataaaagtcgcctgggagctagattacactcgcagaacattcttagttatatgtgtagagcctttagttgttactcctttctagctacccttgaagatatgatccttaaaggtggcctagcttggtaagactgtacttatccttaatctgcattcttctttcattgtagaatacagtatttgcaactcattcttttcttgtttttagttacagatatacttactttctctttgatctattaattgtagacactaagcattcaattgaaaatttgcccgaactgcgtcct

SEQ ID NO: 543194 - DNA, 312 bp, Homo sapiens
cccccccggggggccctggggggggggggctcccccgcaacagggggggggggggggccccaaaagggggcggggggttcccccccccccggttccttggggcggggtcccttccccccccttgggggcccggtaagccccgcccgccttcccttttggggggtttaacagggggggaccccgtttggttaaggaagaacccttaaggtggtttatttttttccaaatattcaagaatttttttttgtaaaaaattgggcccccttggcccccattggagggggttcagaaaaaacttaaaccctttgggga

SEQ ID NO: 543195 - DNA, 159 bp, Homo sapiens
ctctagaggatcttaaaaaaaatataaaaattagcttggtcagtgttatctcctgtactcccagctgctagggggctgaggtgggaggattgcttcagcctgggaggcagaggctgcggtgagccgagatggcgccactgcacttcagcgtgtgcagca

SEQ ID NO: 543196 - DNA, 152 bp, Homo sapiens
tcatatagaatcgagcctgttaccgaaaatgtctgacatacgagctggataggacagatatacggatcctggccgaattgcaacgcgatggccgcgcacccggcgcaggcagtggctggccgaccgcgtctccctgtcgcccagcccctgcc

SEQ ID NO: 543197 - DNA, 643 bp, Homo sapiens
aacaagtgacattcagatgtcaatctccattatcaaatgaatggctcagacactgtgacatgtgttaatagtcggtggattggacagccagtatgcaaagataattcctgtgtggatccaccacatgtgccaaatgctactatagtaacaaggaccaagaataaatatctacatggtgacagagtacgttatgaatgtaataaacctttggaactatttgggcaagtggaagtgatgtgtgaaaatgggatatggacagaaaaaccaaagtgccgagactcaacagggaaatgtgggcctcctccacctattgacaatggagacatcacctccttgtcattaccagtatatgaacccattatcatcagttgaatatcaatgccaagaaagtattatctccttaagggaaagaagacaataacatgtagaaatggaaagtggtctgagccaccaacatgcttacatgcatgtgtaataccagaaaacattatggaatcacacaatataattctcaaatggagacacactgaaaagatttattcccattcaggggaggatattgaatttggatgtaaatatggatattataaagcaagagattcaccgccatttcgtacaaagtgcattaatggcaccatcaatt

SEQ ID NO: 543198 - DNA, 392 bp, Homo sapiens
tcctactgtgttgggtgtggatcatgtcgtgaggggcgatcactagaatccgtttgagtttcagcatcatgggcctcgtcctggtggctcaagtatctggcgtgaggcgctgaaggctctgatctttgtcaatgaatacccggtccgggcagagacctttccccgctggtcgattaaccccgcaaaccccggaatgaacagtgcgccgcagtgcctggcacctatgctggataaactccctattggcgtcatttctcatgccggaaacacgaccactgcacattcaacacctcaaggctgcctgttccagttgcagcgttttggagttgtgcctgcccatcggtctgaccggtccggaggtccaacgtctggacacgctgatcgtgcaacgc

SEQ ID NO: 543199 - DNA, 112 bp, Homo sapiens
atggatagatgtgtatactcgcgctacctgccagccccgggagtggtggtgcccttgactgtggagctcatggcaccgtggccaaacagctggtgcccagctgcgtgactgt

SEQ ID NO: 543200 - DNA, 285 bp, Homo sapiens
acattatcgattacagaacaggctcgtctcagcagggatatgaagcactgccaggtcctttgagtattaagctgtggctcgtagtgttctggcgagcagttttgttgctttaactgttgaggtttagggctaagccatagtggggtatctaatcccagtttgtgtcttagctattgtgttgttcagatatgttaaagccactttcgtagtctatattgtgtccccttggagttttgagaactcaggtgagtttcagctttattggggagggggtgatctaaaaaa

SEQ ID NO: 543201 - DNA, 152 bp, Homo sapiens
cggtcatctaaggatccgctggcgtgtgttctgtgctgtgcatggttggcttgggggtctgtggttcctgggccttgtggcaggttctcccgtggagactttggtgtggaaagcattaggaggccctttccgagggttgacaccgtgtcctc

SEQ ID NO: 543202 - DNA, 189 bp, Homo sapiens
  misc_feature (56)..(57): n is a, c, g, or t
ctgaggatccgagcttacgaggtgggttaaatagaaagacacatcattattacctnntgggtttatggaagattaagagatatccacataaagttcctagtatgtgactgccatgtaatggagtgtatcaaccaagttagctaatattaattacataaaacagataactacttgaagatatccctcgtt

SEQ ID NO: 543203 - DNA, 266 bp, Homo sapiens
cactacatgaaaccacctctctcaatcagtggtgtcatttggaaagcttgcttggcctggtacagtggctcacacctgtaatcccaacactttgggggtcgaggctagtggatcacttgagctcaggagttcaagaccagccttggcaacatggtgaaacttgtctctaccaaaaatacaaaaaattggctggtcatgatggtgtgcatcttgtgatcccagctacttgagaggctgaggcaggagaatcgcttgaacccaggggg

SEQ ID NO: 543204 - DNA, 147 bp, Homo sapiens
ttattataacatatggatccccatgaagccctctacaccaaatttaccaggagatttgataggatggggctgatgggcttatcgtttataaaatccgggctgctgagatggggttttgccatgttacccaggctggtcttgaattcc

SEQ ID NO: 543205 - DNA, 183 bp, Homo sapiens
accatgacgtcaaactatatatacatattaaagccatggcacaaaacgaaagaaagaacgtacagacacaaagacagaaagaaagaccgaacgaaagaaaggaaaagaaaagaaagaaaggaaagaaaagacagaacagactgaacagagagacagaaaggccaagaatcagaaccgccaaaa

SEQ ID NO: 543206 - DNA, 113 bp, Homo sapiens
ggcaaaagtgtaacggcccaacactttgttccgctcaattttacgcctgtctctgacataaggaggtgccctaaatagcttggaaaagtaaccatctcctggccatcccttca

SEQ ID NO: 543207 - DNA, 154 bp, Homo sapiens
gtgtggacggggcgtgagcaacactcaggaggtgtcttgagattatcatccgctgagggtggaacggggagtgagcagacactcgggcaggtgtcttgcatggctcagggcagttatcagttatagaatgttagatgagttggtagtgatggtg

SEQ ID NO: 543208 - DNA, 334 bp, Homo sapiens
  misc_feature (267)..(267): n is a, c, g, or t
  misc_feature (300)..(300): n is a, c, g, or t
  misc_feature (324)..(324): n is a, c, g, or t
ggattgcatgaacccaggagttcaagaccagccctggcaatgtagtaagaacctgtctctgcaaaaaatgaaaaaaattagccaggcctggtggtgcatgtctgtagacccagctactctggaggctgaagtgcttgagcctgggagggtgaggctgcagtgagccaaggtcacgccactgcactccagcctggggcaacagagcaagacttctgtttcccagaataatggtatgggaagttttctgttgtctttgttaataaaggntttaatttcgatttattttagggatttagtatnccgatacccattcaacatgtcaantcggctctta

SEQ ID NO: 543209 - DNA, 287 bp, Homo sapiens
agtagagtggtgagctacagtgcatgggccaaagcatccagctggttgttgtattttatagtagagacggggtttcatcatgttagccagtgatggtctcgatctcttgaacttgtgatccacctgcctcgacctcccaaagtgctgggattacaaggatgagccaccaagcccggccaagcttcttgttttgtacattgattttttcttttttattttttttttttttttttttttttttttttattttattatctaacgcgggggggggggggggggggggggac

SEQ ID NO: 543210 - DNA, 351 bp, Homo sapiens
  misc_feature (15)..(15): n is a, c, g, or t
  misc_feature (19)..(19): n is a, c, g, or t
  misc_feature (255)..(255): n is a, c, g, or t
  misc_feature (310)..(310): n is a, c, g, or t
  misc_feature (329)..(329): n is a, c, g, or t
ggggccaggcgtcanacgnctgtgggatcacgggcaagtcttggaggtgcctcttccagcttcaaatctctatgtactttggggaggcagggggtttgcttcccaggtgcaggcttgcactgcgctctttctggattgcatcagagctgctcaggactcatttccccacccccacagggcgcctacagctccctccccctcccataacttattagctacagataacatccctttgttctcccagtgacttcacanccacagaagggagagggggatgaaggaaatctggcagggggggttgccttcccgncagtattttgatggaagcntttcctttttgagtaatatgtt

SEQ ID NO: 543211 - DNA, 643 bp, Homo sapiens
gcgatatggccgcataccagctggtcgcgggggcggcggcgcctatggtgccctatggtgcctcgtgcacgacttcgtcgtgggtcagcaagagggccccgctgaccaggtggctgcaggtcctctctagagaatccagaaccccgaactcgggcacgaggaatccagctgtcacaggtgctacctgccctgctcctgcaaagagttacacctgatactgtctattagatcgtctgaatgagcatcatcttgtgatcccatctgtcctgcagggtttgaaggcacttagcctgtgtgtggccctgcccccagggctggctgtttctgtgcttaaagccatctttccaggaagtgcatgtacaggtggaccgacacacagtctacaatatcatcaccaattttatgcgaacccgggaagaagagctaaaagagccctaggagctgacttcacctttggcttcatccaggtgatggattggggggaacaatgtgatttcccccgtaaatctttctggttggcctttccgcatcgttccatgtatctcatcttcgcatggtaactaatacgcttgtgaccctttttgttggaggacacgtttgtttgacaggttgaaccaattctctttgttttaattttcccctt

SEQ ID NO: 543212 - DNA, 379 bp, Homo sapiens
caacctcagtaacaaaatatatgacatgtcaataacactaaaggatgcagttggaaatgtattaccatatgtttgcaggagcccacttttttcccgctggtgttggtcctaggatgattttagtgtttgaaacccaggtctgctaacgagaatctaactttctttagttttccatgttccaggtccctagttccctcttatttgaaggaaaaaggacagctagacaagtgcccaaaccagccggtctggctgttctgcattcattcatgcatgcaagcaacaagtatttattaaacacatactatgtccaggaactgtgcagggcaataactacttatttgttctcaaggccccagaggagatttgtgcagcactggga

SEQ ID NO: 543213 - DNA, 210 bp, Homo sapiens
cacattcagatcatggcagtcgcattataaagagagacacacagctctctctctctctctgaccatgtaagtctacacacaagtctgccatctgcaaaccagaagcaggtgggctctctcagcacagatctgctgcactcgatctggactgcagctccactggtcagcatgcacgcttctctgattctcagctcagtgttatgtgcctgc

SEQ ID NO: 543214 - DNA, 105 bp, Homo sapiens
ctcttgaggatccccccccgggccgatggcccatgactctatttccactacactgttcctcctccttgagcttactgcatgtgttaggggtgggctggaaaatgc

SEQ ID NO: 543215 - DNA, 144 bp, Homo sapiens
ctgcaacctctgccctcctggagttcaaagggtcctcccatctctgcctcttgaagtagcttgggactacaggcacatgtcaccacacttggctgatgtgtatttatctatctatctgtttattttgtggtggagcatgtgaag

SEQ ID NO: 543216 - DNA, 628 bp, Homo sapiens
  misc_feature (367)..(367): n is a, c, g, or t
  misc_feature (394)..(394): n is a, c, g, or t
  misc_feature (412)..(412): n is a, c, g, or t
  misc_feature (469)..(469): n is a, c, g, or t
  misc_feature (572)..(572): n is a, c, g, or t
  misc_feature (622)..(622): n is a, c, g, or t
cttaattctgtcatcttcataagctgaggatgaatgtcgcctcaggaccctgtgatgattgcattaactgcacagattgtttaaacaatatgaaatctgggcaccttgaaaaaggaacagtataacagtgatgttcagggaacaagggagataaccattaggtctggctgcctgagagccgggaggaacagagccatatttctcttctttcaaaagcaaataggagaaatatcactgaattctttttctcagcaaggaacatccctgagaaggagaatgcattcccaaggggaattctctaaaatgggccgctttgggaatgtctgtcttttatggttgtagataagggatgaaataagccccagtncttcactttagcgcttcccaggcttanttagggacgaggaaattncccgcctaattaaattttggttcagaccagtttgttctgcttttcaaaccctgtttncctgataaggtgtttattcaatgaccattgcgtaccccaaactttcattaggcatttttaattttgccctgggttctgtgatcttggcctggcttccatttgnccttgttgatatttttattaccctgtgaagtttgtgatctttctgacccncatttg

SEQ ID NO: 543217 - DNA, 641 bp, Homo sapiens
cgctgatttgtggtgattgctctttcgagtgggtgtgtggtgttgtgggacatttattcgtcagggtttgaggtgtgctcctagcatgcgttcagtgcccgttgatgaacacggggtgtcagtccctcggcttagtggggttatttatgcccgatgggctttgcctttcagtgtgtcagctgttcttccctgggtgtggcttcgttccgaggggatagtgtcccctccagtccagattgtcggggcggctccccactcctctgcgcatcttggttcacggtggtcacccatctctgttgatggccgtgctcaccctgtctcattcacgttgatgtgtctcgaatgaagtcacaccaactgggggtcattgtgttgtcaagtggcccctttgtgcagtttacatgtaggtgactgattcacattgtttgtccaaatgtattgcacagcgccaatgtgcatgtcagcccgctctcccacgtcatcacagtctgggttcctcgataatccctgaaggaagattcgctcacctcgttggttctgcagcttgatcaggttctcagcagttccctctccctcatgagattggtgaagaaagtaggttggcaaaattgggcaaagacacatcaataagacagaataca

SEQ ID NO: 543218 - DNA, 228 bp, Homo sapiens
cggaggttgtagcaaggccccatataatggcttttttttgacgacggaagaggagtttttgatcaggaggtgaatatgtaaattgtaacatgatagacatgcaagactgttatccaatctagatactatatttacattctgatgacttaggaaatcaaagcattcattagtgacaagcctaaaacgcttgacatatataacatacttaggatctttttttgtgcgagt

SEQ ID NO: 543219 - DNA, 477 bp, Homo sapiens
aggcatgaaaacattaatctcccgatacctctccgtcagagctctgggtgattaagttatgtcaatgtgcaataatattctgaaagaaatcttttttctgagcagctaggtcttaacactgggcctaaaatattggtataccgtgctatcatctaggctgtgtcattccatttataaagcataggcagagtagattttgcacaattcttaagggtcatagggattttggaatggcaaataagtatgggcttcaattagaagttactagctgcattagcccctaagaatcacatcagcctgtcctctgaagctttgaaaccagacattgacttctctcttactatgaaagtcctagatgatatcttctttcaatataggttgttttgtctacattgaaaatctgttgcttaatgtagccatcttcatcagttatcttagctagatcttctggataactcactcctgcttctacactag

SEQ ID NO: 543220 - DNA, 794 bp, Homo sapiens
acaaatgcaccgatgtgcctactataacctagcaatggggccgaccatctaaggaaatcattctgtagatacggtacgactctgagaatatatctaggtagttgccattgttccctcatgagattggcgtcaggactcgatgcagtaccgtagtcctaagcagtgtggatgtcactgaacttataaacgtcgtaggactgtatgatcctagtataggatctcctccgggtatcaagtggctatattataccctctaaaagcactcttctattgtataatgtccgacccagtacaacctagcgtggaagcttgtcgtgtatgtaaatcttcaatggcgtgagacaccctagttgggcctcaggtcctatcttgagtacattgatgcgcaccggtcattaacagaactccggcagtaggaaagccatttgtcatccaccctagggatgtcctgtaaatgttgatacggatgtagtggttcaatagctccaggggattcccttaattcatgctggcaaccagttccataggagaagcttcttaaatcgcgtttttcccagaaagcaggtgtaacctgcaggtcacttaggtttcccgttaaagttccggccggataatgagagactgcaaggatatagccgatggccaaaacgttttagcctgaggttccgatggcacccaggcaattaggaaagaccggtaagctctgagaggaaggaataacttgtcacaaggattaacccccaacccctttgcccttatttgttgcagggggtatagtttgatcaactaccgtc

SEQ ID NO: 543221 - DNA, 231 bp, Homo sapiens
acgccgctgacggatcggtgttacttgacaatgacacaggctctggaggccaggctcgggggctccccgttcggaccggctggaacaggaaagacggagtctgtcaaagccctcggccatcagctggggcgattcgtcttagttttcaactgtgacgaaacctttgatttccaggcgatgggacggatcttcgtggggctttgccaagtgggcgcctggggctgcttcgac

SEQ ID NO: 543222 - DNA, 541 bp, Homo sapiens
atcagaagacagatttgtatctacatcacatctagtctctctgactctatgatgatacactgtgtattcacgagactccagattttcatatgtacatgctattctgtgttgcaagaactcatacatctgcatccactcatatcttcctgcgcggtataggtttgtcgtgctgtaatattaagtcacaagtcaaatcattatggaatgtccaaatattctcccaacactctagtttaatggtgttgaatatcattcaaaataaataggccattacctaaatattctgaaatctattcttaaggtttcaacttactgtacacaaacctaatatatgaatagccagatttacagagaagataaattggagagggaatgttatttacattcactgatggagttgaccagcaggatcccttcacaggaaatccctgtgattgaaaatggagaacccacaactctcaggtggagttccaacccctaggtgctatgcggcgtatacgtctatcacctgtagagggatcaaagagaaggatttatgact

SEQ ID NO: 543223 - DNA, 237 bp, Homo sapiens
agattaccatcaactaggattccagattagagtaaccatcaactaggagtctccagattagagcaacaatcaactaagagtctccagattaaccatcaactaggagtctccacattagagcagccatcaactaggagtctccagataaaccatcaactaggagtctccagattagagcaaccatcaactaagagtctccagattagagtaaccatcaactaggcgtctccagattag

SEQ ID NO: 543224 - DNA, 296 bp, Homo sapiens
tcgtgaccgtcagcactcttttcttttcttttctcgtgtgtttctcgagatggagttctgtccttgttacctagtctggagtataatggtgcggtctcggtcactgagcacctggccccttttctgtttttttatttttatttttatttttttggtgagacggagatttgcttttgttgcccagcgtgaagtgcaatggtgtgatcttggctcaccgcatcctctgcctcctgagttcaagtaattctcctgcctcagcctcccgagtagctagtattacaggcatataataccac

SEQ ID NO: 543225 - DNA, 461 bp, Homo sapiens
gggtatgcaagatccaaggaagacgtcgttatctaccctccccacttactcgatggagagaggtgagggggggatgacttgcgggttctgatcagtgcccctggagtggggaagtgggcacatgtgtccctcagcatgcttacgcccctggagtcttgggggtgccagcctgggcctggggccttttccagctactgtgcccttgtggcagctgcgtctggggctcaaacccccaatactgttaccctctcacagctgcgggtctgtagtgcagctgtcacatctgaagggtttctgcaaactggaccccatctgggtgtgggtcagaccctgtgaaccacatgacaaccccaccctccacagagcccccttgctgggacagacagctcacctccaaagacataccatcttggcttctcccacttccgagtctgcagagccgtgggcttctcttccgattt

SEQ ID NO: 543226 - DNA, 637 bp, Homo sapiens
tatgctcaggcttcagtaagaggctcgcgtctattgttctccgtgtggctggaagaaggtctggttagaccccattgagaccaatgaaatcgccaatgtccaggtcccgtcagcagatccggaagctcatcaaagatgggttgatcatccggatgcctgtgatggtctattcccgggctcgatgccggagaaataccttgggccgccggaagggcaggcgcatggggatagcgtaagcggaagggtcacagcctggtgcccgaatgccatagaaggtcacatggatgaggagaatgaggattgtgcgccggcgtgctcgagaagatacgcgaatctaagaagatcgatcgccagatgtatcacagcctgtgcctgaaggtgaaggggaatgtgttcaacaaagaagcggattctcatggaagatatgcacgagctgaaggcagagaaggaccgcatagaagctcctggctgaccagggtgaggccccgcaggtctaagaccaaggacagcaaggcaagcgccgtgaatgagcgcctccaaggaccaagaaggaggatgatcatcaagagttatatccaaggagtgaagagagcaagaattaaaagctcccattagtcgtgtgcatactgggctctgg

SEQ ID NO: 543227 - DNA, 4541 bp, Homo sapiens
ggcggaggctccgggacggcgagcggcgggcggcggaggaggagacggcaggtcgggcattaaaaaatatttaatcattcatgtgttgagactcattcttgagttatggatgacaaggcttctgttggaaaaatcagtgtctcttcagactcagtatctactcttaatagtgaagattttgtcttggtttccaggcaaggagatgagacaccatctacaaataatggaagtgatgatgagaaaacaggactcaagattgtagggaatggaagtgaacagcagctgcaaaaagagctagcagatgtactgatggatcctccaatggacgaccagccaggggaaaaggagcttgtgaaaaggtcacaactggatggtgaaggagatgggcctctttctaatcagctctccgcttcatccaccattaaccctgtgccattagtagggctccaaaaaccagagatgagcctaccagtgaaacctggacaaggagattctgaagcttcaagtcctttcacaccagtggccgatgaggacagcgtagttttcagtaaactgacttacttaggctgtgcctcggtaaatgctcccaggagtgaagtggaagccttaaggatgatgtccatcttaagaagccagtgtcagatttcactagatgttaccctttcagtgccgaatgtgtctgaaggaattgtgagactcttagatcctcagacaaacactgaaatagcaaactaccctatctacaaaatcctcttctgtgtcagagggcatgatggaactcctgagagtgactgttttgctttcactgaaagtcattacaatgcagagctcttcagaatacacgtcttccggtgtgaaatacaagaagctgtaagccggatactttacagttttgccactgccttccgccgttctgccaagcagaccccactttcagccactgctgcaccccagactcctgacagtgacatctttaccttctctgtgtctttagaaataaaagaagatgatggtaaaggttattttagtgcagttcccaaagataaggacagacagtgctttaaactacgccaaggaattgataagaagattgtcatctatgtgcagcaaacaactaataaagaacttgccattgaaaggtgttttggtcttctccttagtccaggaaaagatgtacgaaatagtgacatgcacttattagatttggaatctatgggcaaaagttcagatggaaagtcgtatgttattacggggagctggaatccaaaatccccacattttcaagttgtaaatgaagaaactcctaaagataaagtcctgtttatgaccacagctgtagatttggtaataacagaagtacaggagcctgttcgatttctcctggagacaaaagtccgcgtttgctcacctaatgaaagattattctggcccttcagcaaacgtagtactactgaaaatttctttttgaaactaaaacagataaagcaaagggagagaaagaataatactgacactttatatgaagttgtatgcttggaaagtgaatcagaaagagagaggaggaaaactacagccagtccttcagttcgcctgccacagtctggatcgcaaagttcagtgataccttctcctccagaagatgatgaagaggaagataatgatgaacctctcctgagtggatctggtgatgtatccaaagaatgtgcagaaaaaattcttgaaacatggggagaactgttgtcaaaatggcatctcaacttgaatgtgagaccgaagcagttgtcatccttagtaagaaacggtgtccctgaagctcttcgaggagaagtctggcagctgctagcaggctgtcataacaatgaccacctggtagagaaataccgcattcttatcacaaaggagtctccccaggacagtgctatcacccgggatattaaccgaacattcccagcccatgactactttaaggacacaggaggagatggacaagattccttatataaaatatgcaaggcttattctgtgtatgatgaagagattggttattgccagggccagtcatttcttgctgctgtgctccttctccatatgcctgaagaacaggcattcagtgttctggtcaagatcatgtttgactatgggctcagggaacttttcaagcaaaacttcgaagatttgcattgcaaattttaccagttggagcgcctcatgcaggaatacattcctgacctgtacaaccacttcctggatataagccttgaagcacacatgtatgcctcccagtggtttcttactcttttcactgcaaaattccctctctacatggtcttccatatcatcgacctgcttttatgtgagggaataagtgttatttttaatgtcgcccttggattattaaagacttcgaaagatgacctgctgttgacagactttgaaggtgccttgaagttctttagggttcagcttcctaagagataccgctcagaagaaaatgcaaaaaaactaatggaattagcctgcaacatgaagattagtcagaagaagttgaaaaaatacgagaaagaatatcacaccatgagggaacagcaggcccagcaagaagaccccatcgagcgatttgagcgggagaataggcgtctacaagaagctaacatgaggttggaacaggaaaacgatgacttagcccatgagctggtgaccagcaagattgcactacggaaggacctggataacgctgaggaaaaggcagatgctctgaataaggagctgctgatgaccaaacagaagttgattgatgcagaagaagagaaaagacggttggaagaagagtctgctcagttaaaagaaatgtgccgtcgggaactcgacaaggcagaatctgagattaaaaaaaacagttctatcattggtgactataagcagatttgttctcagttgagtgaaagattggagaagcagcagacagccaataaggtggaaattgagaaaattcggcaaaaagtggatgactgtgagcggtgccgggaatttttcaacaaagaagggcgtgtaaaaggcataagctcaaccaaggaggttttagatgaggacacggatgaagagaaagagacgctcaagaaccagctgagagaaatggagctagaactggcacagaccaaactccagctggtggaggccgagtgtaagatacaggacttggaacaccatttagggcttgccctcaatgaggtgcaggcagccaagaagacgtggtttaaccgaacactgagctccataaagacagcaaccggggttcaagggaaagagacttgctgagagcagctgccgcctcccgacaccttcagaaaacacgacaccttttgttgccttctttggccagatgtgtgattctgtgacttgtcccaggaccagaatgtacctaagtcagatccatagacgcatgttggtaggtcactggaccagagcttgtgaagcaggcaacctctggggtaagactactgatactaacaggcctgctagctcagccgacgctctggacactctagaaatcactcctcagtgtgacctcccaggcctcttccccgtgtacgtcaacacctcacccagcctaaaggctgagtttacatgatcagagttaggggatccttcagtctgttgattttttttctaaaccttttttttttaatatacatatatatatatatatatatatatatatatatatatatatatatatatatatatatatatatagtgggggtggggcaagggatcagaaattcaaataattcttttctgcttcaatgccagcagaaggtcccccaggtagacatggagaagcactttgttttaaataggagggtttcatagttgcatctgaagccacctggttctgttaaactgtatcgtgcaggttttgggtttggcattattcatgtttctgatcaattctatgcaactctcatagttcctgttactttttagcattagctgccaaatgacttcaaaaggctggggtgggtgacttgactgtgagactggattataacatggacaaatcttattttgcttaatgtgtttgtgtgtgtgtgtgtgtgtgtgtgtgtgtgtgtgtgtgtatgtatatatatatatataaatatctttcccaatatgccccgttgacagtgtttaaattccagactaggactgctgatctgcacaatttaattatgtggttattcgagcacttaatttcactcaaggttcattgggctctgctctcctccctgccattacgggagctgtggacagagctccctcacttcaagattcctagtgtttttgcacaacaggttgtccaagtgagaaagactgagttgcgtgtctgtaaatgtctgcgcagggtgcacatgctgcgaggtctccatcctccgggcctgtccctcccagatgggctgggcctttgggccctcctcagagtatgcctgggtacaaacctcactgttcagatgggctgtaagttctcacttcaaagctatggaatggattttagcaccttt

SEQ ID NO: 543228 - DNA, 134 bp, Homo sapiens
gattgcttagacataatagtattattaaagaatcacaactgttaatattgaatacttattggataggctcttatgattctagggtcctttactggcactaatgatttcctatgtgctatgtctaaatgcaatca

SEQ ID NO: 543229 - DNA, 1023 bp, Homo sapiens
tgctacatcagagcatataggcttatatgttttggggttatgtctttgtctggttttgtatcatggtaatgcttgcctgtagaatgagttcagaataattcccttcttatttttctggaagagtttgagaagaattggtactggttctttaacattttggcagaatttagcagtgaagtcatgtggtcctgggcttttctttgatgggagactttttattactgattcaatctcattactcaatatttatctgtacagatttttaatttcttcttggttcaattttggtaggttgtatgtgtccaggaatttatccatttctttcaggttttccaattggttggcatatagttgttcataatagtctctaatgaccctttgtatttccgtggcatcgtttgtaatgtttcttattcatgtttctgatcaattctatgcaactctcatagttcctgttactttttagcattagctgccaaatgacttcaaaaggctggggtgggtgacttgactgtgagactggattataacatggacaaatcttattttgcttaatgtgtttgtgtgtgtgtgtgtgtgtgtgtgtgtgtgtgtgtgtgtatgtatatatatatatataaatatctttcccaatatgccccgttgacagtgtttaaattccagactaggactgctgatctgcacaatttaattatgtggttattcgagcacttaatttcactcaaggttcattgggctctgctctcctccctgccattacgggagctgtggacagagctccctcacttcaagattcctagtgtttttgcacaacaggttgtccaagtgagaaagactgagttgcgtgtctgtaaatgtctgcgcagggtgcacatgctgcgaggtctccatcctccgggcctgtccctcccagatgggctgggcctttgggccctcctcagagtatgcctgggtacaaacctcactgttcagatgggctgtaagttctcacttcaaagctatggaatggattttagcaccttt

SEQ ID NO: 543230 - DNA, 3549 bp, Homo sapiens
ggcggaggctccgggacggcgagcggcgggcggcggaggaggagacggcaggtcgggcattaaaaaatatttaatcattcatgtgttgagactcattcttgagttatggatgacaaggcttctgttggaaaaatcagtgtctcttcagactcagtatctactcttaatagtgaagattttgtcttggtttccaggcaaggagatgagacaccatctacaaataatggaagtgatgatgagaaaacaggactcaagattgtagggaatggaagtgaacagcagctgcaaaaagagctagcagatgtactgatggatcctccaatggacgaccagccaggggaaaaggagcttgtgaaaaggtcacaactggatggtgaaggagatgggcctctttctaatcagctctccgcttcatccaccattaaccctgtgccattagtagggctccaaaaaccagagatgagcctaccagtgaaacctggacaaggagattctgaagcttcaagtcctttcacaccagtggccgatgaggacagcgtagttttcagtaaactgacttacttaggctgtgcctcggtaaatgctcccaggagtgaagtggaagccttaaggatgatgtccatcttaagaagccagtgtcagatttcactagatgttaccctttcagtgccgaatgtgtctgaaggaattgtgagactcttagatcctcagacaaacactgaaatagcaaactaccctatctacaaaatcctcttctgtgtcagagggcatgatggaactcctgagagtgactgttttgctttcactgaaagtcattacaatgcagagctcttcagaatacacgtcttccggtgtgaaatacaagaagctgtaagccggatactttacagttttgccactgccttccgccgttctgccaagcagaccccactttcagccactgctgcaccccagactcctgacagtgacatctttaccttctctgtgtctttagaaataaaagaagatgatggtaaaggttattttagtgcagttcccaaagataaggacagacagtgctttaaactacgccaaggaattgataagaagattgtcatctatgtgcagcaaacaactaataaagaacttgccattgaaaggtgttttggtcttctccttagtccaggaaaagatgtacgaaatagtgacatgcacttattagatttggaatctatgggcaaaagttcagatggaaagtcgtatgttattacggggagctggaatccaaaatccccacattttcaagttgtaaatgaagaaactcctaaagataaagtcctgtttatgaccacagctgtagatttggtaataacagaagtacaggagcctgttcgatttctcctggagacaaaagtccgcgtttgctcacctaatgaaagattattctggcccttcagcaaacgtagtactactgaaaatttctttttgaaactaaaacagataaagcaaagggagagaaagaataatactgacactttatatgaagttgtatgcttggaaagtgaatcagaaagagagaggaggaaaactacagccagtccttcagttcgcctgccacagtctggatcgcaaagttcagtgataccttctcctccagaagatgatgaagaggaagataatgatgaacctctcctgagtggatctggtgatgtatccaaagaatgtgcagaaaaaattcttgaaacatggggagaactgttgtcaaaatggcatctcaacttgaatgtgagaccgaagcagttgtcatccttagtaagaaacggtgtccctgaagctcttcgaggagaagtctggcagctgctagcaggctgtcataacaatgaccacctggtagagaaataccgcattcttatcacaaaggagtctccccaggacagtgctatcacccgggatattaaccgaacattcccagcccatgactactttaaggacacaggaggagatggacaagattccttatataaaatatgcaaggcttattctgtgtatgatgaagagattggttattgccagggccagtcatttcttgctgctgtgctccttctccatatgcctgaagaacaggcattcagtgttctggtcaagatcatgtttgactatgggctcagggaacttttcaagcaaaacttcgaagatttgcattgcaaattttaccagttggagcgcctcatgcaggaatacattcctgacctgtacaaccacttcctggatataagccttgaagcacacatgtatgcctcccagtggtttcttactcttttcactgcaaaattccctctctacatggtcttccatatcatcgacctgcttttatgtgagggaataagtgttatttttaatgtcgcccttggattattaaagacttcgaaagatgacctgctgttgacagactttgaaggtgccttgaagttctttagggttcagcttcctaagagataccgctcagaagaaaatgcaaaaaaactaatggaattagcctgcaacatgaagattagtcagaagaagttgaaaaaatacgagaaagaatatcacaccatgagggaacagcaggcccagcaagaagaccccatcgagcgatttgagcgggagaataggcgtctacaagaagctaacatgaggttggaacaggaaaacgatgacttagcccatgagctggtgaccagcaagattgcactacggaaggacctggataacgctgaggaaaaggcagatgctctgaataaggagctgctgatgaccaaacagaagttgattgatgcagaagaagagaaaagacggttggaagaagagtctgctcagttaaaagaaatgtgccgtcgggaactcgacaaggcagaatctgagattaaaaaaaacagttctatcattggtgactataagcagatttgttctcagttgagtgaaagattggagaagcagcagacagccaataaggtggaaattgagaaaattcggcaaaaagtggatgactgtgagcggtgccgggaatttttcaacaaagaagggcgtgtaaaaggcataagctcaaccaaggaggttttagatgaggacacggatgaagagaaagagacgctcaagaaccagctgagagaaatggagctagaactggcacagaccaaactccagctggtggaggccgagtgtaagatacaggacttggaacaccatttagggcttgccctcaatgaggtgcaggcagccaagaagacgtggtttaacgtggtccacctcccctagggaagctgctgcactcagaggctgtgctgcccagtggcccctgagccgtgtgagcctgcaggaggcgtctgagcagagcctcaagcccggtatggcgccatcttcatgttgccatcactgcgttctcacctgaagccttaatctttgcgacatctgtcagtgagcgctcggcttgaataccaaagtgtgtcttcatcttctccctgtcttttagatgcctgtgtcataggaaaatctgaaatgatatccaggatctttgatctggctacaaca

SEQ ID NO: 543231 - DNA, 547 bp, Homo sapiens
taaaagccaaaaacttatttaattttatttaaaaaaaaacatggaagatcccccatttcccaccacccaaaaaaatttttgaagggggaaggttaaaaagccaacccatttgggggggtaacaaaaccagaaaaaaccccagttgccaaaggagaaaggttggaaaaaagtttggttttaaaaaagctgagcacctacgggaaaaattccggggcaaaatgctgaaaaaaaaatttaatttcggcacagaaaataccattaccttagaacccttggctaaagggggggataaattccccaggaagtcagaaggagacaataagcagcattaacttcaaaggcacacagaactagggcccaaacggctagcaaaaattccaacagagtaaatagggcaaagtcacaacccaggggtcaatttccaccaaatttagagaccccccctaggcacctaggggaaggaattaccacggaataaaaaggcccccaggaaaaacggaaaattcagttagggttaatttagccaaaagataataggggcaagtac

SEQ ID NO: 543232 - DNA, 211 bp, Homo sapiens
tgggcaatatagcaagcccccctttttccaaaaataaaaaaataaaaaaattaaaaaattagccggggggggtgacaaacgcctgtagccccacctgattggggggttgaggctggaggattgctttagccccggggtttggggatgcagtgagttatgattgcccccccatactttgggggatgatggcagaatgggccctactccccga

SEQ ID NO: 543233 - DNA, 717 bp, Homo sapiens
gacttgttttctaaagccccccggtagagttgccccgcatggtgtaatctcgctttcgtggatctttggtgatcatagggttggggggtatggcaaagcgcgtgcctattcttttgtctgcgtgaaaagattcttttcttctaagggtcgataaatagtgaatgagtgtcacgagatttcctctatctgataatttttttcagtagttcctgggtaattattccagtggttcgaattttccccctggagaaaatcttgtggggctttccttgaagaccatctattcccccgagtgtgtcataactccagagtagggggccagtatccacctgcagtctgttcagtggtgtgagttctcctctgcttatcatggagtgcctctgctaattatgggtgcccctcaggtagaaggtcccatcttgtgggatggtggaagaacacttttttattctccttgtagaagtcgaatttttttctgtctatgagaaagacttgctaatcagtttttttttttttttttttttttttttttttttgttaaatgctaggcttgtagaggcttacttaaccgttaatggagaacgctggcaatctcgcagggggagggagaggggaactgttatctcactgtagcatttaaccttcacttttgtgaaaggtaaatgcaacaaggtgattacctggtttatcctgctcgagtacactctgtgccatggg

SEQ ID NO: 543234 - DNA, 738 bp, Homo sapiens
  misc_feature (427)..(428): n is a, c, g, or t
  misc_feature (430)..(430): n is a, c, g, or t
  misc_feature (443)..(444): n is a, c, g, or t
  misc_feature (578)..(578): n is a, c, g, or t
  misc_feature (634)..(634): n is a, c, g, or t
  misc_feature (645)..(645): n is a, c, g, or t
ttgttttttccaaagggtggatataaaaaacccccggcccgcccctaaaaatttttccccacaaaagattaaggccccccgggttttttcctggccctttttccccaagggggtcgcgctgaagggatttggggaaaacctgggtttaaccccccttaccaattttaaagtaaacccctgccctggaatttcaagacgggcaaatttaaattcggcctgcaaaaaccaagtttggcccttaaaaaaagggaagttttcctttcccttttccaagggttttcctcctcccttatattccccccttccttcccttcttgccctgaaatgactccttctacaaggatgtctaatgtgggaaaaaaattaaactcaatgccaaggacaacgggcattatctgttgaatatgaatgctgagtatgtctatcnncnagcatctgtgtgnnatgagcggagctcccatccctggagtatcagcgagctgatctgcggtgaatgtaaattgtgcccgattggtaaatccatttttggcttcccagctctctgcccctgtggcatttctctcttagcgcagatattngatataacagtgggaaattttccatctagaatgctgtgatgccagacccttccccntagtccgaagnatgtgtttgggaaattctcattttccgtggatcacagctgagctatatggcctgagggaaaccgtgcgctgctggacaaatgccttggattgg

SEQ ID NO: 543235 - DNA, 222 bp, Homo sapiens
attcctttcatttccaggttttcagtttttgcctgggcaatggccaggggccaggagtggggaaagttttgatggaggggaaaggggtcaccccccccccccgcctggttttagggtgttgccccccaaggcccggcatttgtttgctttgcaaaaatgtttttttggagttggaatttcattatatgttaagaaaataaaggaaaatgacttgtaaggtca

SEQ ID NO: 543236 - DNA, 907 bp, Homo sapiens
gtccatgctggctgccttcaggaagctaaagtatgttggacctagtaaactagtcagtgttggaaacggccttgaaatatttaaaacatatttgtaaccagtgaggcaaatacagaagttgatgtcggcagtaaatggaaaacaatacgtatgtcatggatattgtaggtttccttatgctgtttttactgtgcactttttaaaattaggttttaatttcagtatgtaagaacaaatatttgtatactttcaaactcaattatatggtaatcgattggtatctatggaatagatatatgtttctggaaaaaaatgcttaaatgtcaaactgtcattacttcttattatagttgaaggcattctccagattctttttaaaagattgttcatatttctctctctctctctctctctctctctctctctctctctctctctctctctcttctttctctctgagggagagggagccctccaaactacagatcgtgtgggtagagtatcattatcttcagctcttagataccgtgtgtgagagtaatagctaaaggaagttcatgtcaataaatgcatacttatatcacaaaaaaaaaaaaaaaaaaaaaaagagcacaccaagccaagaaaaaggaggctgggcgccacacacaagatgactaccccaggggggcgcacaaatagaggcacccaacattttatgaaaaaggagcgccacaaagaggggacctaattaaaagaaggcgacgcggcagtatacacaagcgtgaggagaaacagcactcggaagaagtgaggagaccaccatgcgggcgggacatagaggaccaccacgagaagtagaggcgagagggaaaacagcgaggatgggagaccaccgacgtcgcgcaagaggctagttatagcaacg

SEQ ID NO: 543237 - DNA, 835 bp, Homo sapiens
cgcggtggctcatgcctgtaatcccagcactttgggaggctgaggcgggcagatcacgaggtcaggagttcgagaccagcctggccaacatggtgaaaccccatctctactaaaaatacaaaaattagccaggtgtgctgacaggcacctgtagtcccagctactcgggagaccgaggcagaagaatggcctgaacctgggaggtggaggttgcagcgagccgagattgcaccactacatgcagcctggatgatagaccgagattctgtctcaaaaaaaaaaaaaaaatttaaggcccgtttttacaaatttattttcacggtcctgttcccacggtctagaaaaaatctgtcgttttctacaacattaattactaacatacggtgtttccccttcaatggactggccacacccagggcagctgtagcttggggtgaaattctgacgaatgtgtgttcatcccctgtacattctccatacggatcggtcaaagattgttttctaacctttcttctcccaactcagctaacactagcgggactcctggttgttcctatttctctcccgccggggggggcgaccagagcaatatatggacaaaagagccaaaaaaatcataaaaagcaacaagagaaaacatggacagttaaaacacgaacaacaaaacttaataaacgcgagcacaacaatagatgaacaaacaaacacaaggctacaacagaataaaagacacagcagcgacaatgagaacaacagacaaaaaagaagacaacacggagaagaacaagcaaaaaaaaagacaagcacaaaaagactagagaagcgtacagacaga

SEQ ID NO: 543238 - DNA, 583 bp, Homo sapiens
agcggacgtggcctctcttccgttcgtgtgactgctgtgtgtatagtgtcgtgtcgtcgtgtgggcagtggcggcagaatgttggctaccaagatatttagcctagattggcaagctgagcaattatccaccgtctgtgtgtgtacagagcatcatgaatagtgttgtgaatgatgcagaatgacattttcagcgtcccagctttatatggatcggtgctgtgaccaaccccattgcctgagaggtggccccgatgtcggagcagcctgtctgccagccgagacaggccacttgtaagcgatatatgtgagaaaggccgtctccttgggaaggccctaggctccctccttccccaataatagtgggcaatttggcaacggcaaaaaaaggtctgccagttttggtaatctgcatatatacaaaggttttccaaaacgtgacagtgagccgtttgtgccatagaaaggaaatagggaaaactaagtgggggtgcatctcacacacatgagatagggcgaaatcccaggggattagatatgaggagccaggggtggcccaaaattaggattatcttattcaaatc

SEQ ID NO: 543239 - DNA, 295 bp, Homo sapiens
acaaggattttggacccttccttcagctgggcagccgtgcagtgctcttccagcacccgctgcaaagcgagtacattatcataacaaccacccacacaagcaccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccactccttgtccagc

SEQ ID NO: 543240 - DNA, 341 bp, Homo sapiens
  misc_feature (147)..(147): n is a, c, g, or t
  misc_feature (185)..(185): n is a, c, g, or t
  misc_feature (193)..(193): n is a, c, g, or t
tgcctccatccccgcgggcactcggggggggggacgatggcgggacgggtggcgccggggttccagccctgcgcctgttctggatcaccgggtttttctcgctgaccccctcgtcccaggaccccgcatgcccgagtgcctgggctngtcctctttcgcgcccgctgccaggtgccagggccgcncaggcggncggaggtgggcaggaagcgccacgccgaggagccggggactttgggagctagcgggagacgccggcgtccgtccagccgacccctctgggccgtggtcgacggctcccggaactggccccccgcgggtaaaggcctaccggccttgat

SEQ ID NO: 543241 - DNA, 326 bp, Homo sapiens
tcccactgtcgatgtagatttcaatatagatcatcctaatgtgtatggtggtcccttgatatctgtagggggttggttccgggaccctctgcagttaccaaaatctaggaatgctcaagtcccttatgtaaaatactttaaatcatctctaaattacttacaatacctaatacatacaatataaatgctatgtcaatagttgttatactgtattgtttagagaataatgacaaatgaaaggactgcacatatttagtagagatgtaaccatccattttttccaacaaatattttcgatctgcggttggttgaatccacagatgctg

SEQ ID NO: 543242 - DNA, 259 bp, Homo sapiens
ggcaacaggaagaccatttggaacgcttccgggggcaagaggttaatttcaaaaccatcattaagaaattcctgacgagggaggtggagcgggccaggcttggcatcacatagtgggccctgcttcgggatcaggtgaggcccctgggccaactaaaggcggtacatgcgttcaggacgcatgtgaaatctacccccagttgtctctccagggttcccagctcttaatgtggtaccactgtatttctgttgcccatgtc

SEQ ID NO: 543243 - DNA, 754 bp, Homo sapiens
cggacgcgtgggtccgcagattaaccccctaataacaattaattaaccactcattcatcgacctccccacgcccatccaacatctccgcgatgatgaaaacttcggctcactccttgcgcgcctgctcatgatcctccaaatcaccacaggactattccttatgccatgcactactcacctagatcgccttcatacccgcctatttcatcaaatcgcccacattcactcgagacgtacatattatggctgaatcagtcctgctaccttcactgccaatgtgctgcctctaagtattcttgatctgcctcttccgtacatcatctgggcgaggtcctatattactggatcatttctctacttcagtgaaacctggaaaccatcggccattcatccatccttgcttgacgaacctgatcagccatacagccgtgtcagtcagggcgtagtgtccttcccgttgaggccaagatatcgattctgagggggccagcaggtaatttacaaacttactactccgccactcccatacagttgggacaggaccgtaggttcaaatgaatctgatggaaggcatacatcagttagacagtcccatacacttcacagcggacttccttttaccactttcagatttcattcgtttaccccttcaattgtttgacaagcaccttagcaagctacatccatccatccttaattcctaatgcagcagaaatacggggatcaaacgaaccccctaggaatcacctcgca

SEQ ID NO: 543244 - DNA, 516 bp, Homo sapiens
  misc_feature (12)..(12): n is a, c, g, or t
ttcgtggaggcnaatatacaacacgttgcaggtttgtagactcaatcctaactatatgaataatcacatcaaatgtaaatagtctgaatatcctaattaaaaaacagagattgggctgggcttagtggctcacgcctgtaatcccagcactttgggaggcagagatgatatttttattttttctttttttcagctctaactccaatggatgatattttgtaaagacccaaatcatacttctaaagattggaaaatataatcactaaagggtggaaaaaaacagtgggatgagattgaattggcaattaagacattgcagaaagaaagatcagtgaactttgaagacagcgatatatattattccaaaaataaaacagagaacaaaaattattttcaaaaaacaagttaatcagtgagctgtgtgacaggatcagaacagctaatatatgtgcaaatgggaacagggagcaaggagtaccagaaacatagtcaattgttcagactttttatgaaaca

SEQ ID NO: 543245 - DNA, 529 bp, Homo sapiens
agacagcaccagtgaataaggaagaggaacgaacaatgaccacaagcgtgaacggaccagaataaacatgccagggcaaatatcaaggcacaatcgtgggaactaagaacataaagcacatggatttttaaatcatggctagcaaatattcaagaatgtcagcacaggtctttgaataaatcttgcttctgagagaagttactatttattcctaattaaatggggaaaaaagtttctaaacgaggaacctctgctttacttattacacccccaaacttaaattcccttttttggcccactttccacaatattttcattcatttttatctttagcatctattaactcacctacatgcttgtcatggtgattgtgagcttgtaataaaacctttactcgatccaatggagcacctgttgtttgggcacagcatccagcaatacctaaaaatcttccacaaggtcaggaagaaatggcgtaccatttctttccagatggaaatcataagtggcccgccactcgggtaccgag

SEQ ID NO: 543246 - DNA, 279 bp, Homo sapiens
gcgtcttccaggccccctctcttcctggacccaccccctcagaatggccaaaaatccccaagtcgtccagcagctctgctttctaagaagcagtatgtatagaggcctgtgcttatgtcacccaacagaggggtcctgagaggtctggctgcctgggatgcccctgcccctcctgagctctcagagatgactggctgggagcagatcttgctggcatgagctatgcagtgtctgacactgagcttctgtgcacagatacgctctctcagatgtgctgct

SEQ ID NO: 543247 - DNA, 322 bp, Homo sapiens
ttttggcacaaaagactggccagggacatgaccagcagtgggctacagcctcgatttatatttctggtggggggtgaactgatttttttaaaaccaaagttaagaaagaggttttggaaatgcctatggtttcttggaatggtaaactggagcatcttttcactttccagtagtcagcaaagagcagtcgtgaatttcgtggtcgcttcctatcaaaatattcagagactcgagcacagcacccagatttcaggcgcccggggaaggctcaccataggtgggtcgaagcggccgaccatggacttggtgagggtaccgagct

SEQ ID NO: 543248 - DNA, 379 bp, Homo sapiens
cttcctatggtgccagacccttgggcggaacttccagatgaagcagattgattcttattgctcctggattaaagaaaagagctcaggttctcccaggaggccctgggcagccccccccaagccttacaatattttaagtgttgggtgtaggggtggcttctcttttctctccaacttgacagcactgttgaatcattgtcttcatttgcctatgagatggttggcattgccctttaaagcgggcccgcttgagctaaagctaaagggcggtgtgcagcagccgggtgaccctttgtttttactttgccttccgtgctaagtgttgacttttgatgagtttgatttcattcatttcagataaacatgtatggtgaataaa

SEQ ID NO: 543249 - DNA, 481 bp, Homo sapiens
gagaaccgagggacatgagcaccacacaaagagatggtttagtttttaaaagcatttctactaattgatgcaaatgtaaatagccttttaggtatgttataaataaaatttgatacttgtggattattttgttacttgttttgtttacagggatgattgtgtgtgaacttgtaaagtaagagcaaatgagaataagattctaccacttgggtgataattaaattcacacagaggaataccttacactggttttaaaaagagtgtaataaatcatctatattatatggatagacttcttgctttgatgcttggcacttggtctcctctgttttgaggtcttaaggtgttgaacacagagttatgttcattgcagataatattgtccatttatttttcctccagatgcatccgttttattttgaacagcattgtgaacttatttgtaacgcctgtttgctttcaaatacagaacaagaattta

SEQ ID NO: 543250 - DNA, 422 bp, Homo sapiens
  misc_feature (8)..(8): n is a, c, g, or t
  misc_feature (28)..(28): n is a, c, g, or t
  misc_feature (386)..(386): n is a, c, g, or t
  misc_feature (419)..(419): n is a, c, g, or t
ccccattnaactgctgggttcccccaanccccctgccccccaggcttgccacgaacctagccgttccaggtgatgattgcccccaaggaatgaacctgccttgctggggcagatgcctgaaatcaacccccattagaactttgaatgagggcccgggagcagcagctcctcatctgtaatccccagcactttgggccaaggcgagaggatcacttgaggcaaggggttcaagaccagcctgacagtgagaccgcatcactacaaaaatttaaaaatttgccgggcatagtggtgtgctactgtagtccagctactcagaaggctgaggtgggaggatcgcttgagcctgcctgggaggttgaggttgcagtgagtcgagattgtanccactgcgctccagcttgggcaacagagcgagnccc

SEQ ID NO: 543251 - DNA, 992 bp, Homo sapiens
tggggcaagcttaccgaggagcagcttaggacaagctgatgggtacgctgaggaacacgaagcccaactttgtccgctgcatcatccccaaccacgagaagaaggccggcaagctggacccgcatctcgtgctggacagctgcgctgcaacggtgtactcgagggcatccgcatctgccgccaggggttccccacaaggtttgtctcccacgagtccggcacagactatgagatcctgactcgaaactccatccccaaggggtttcatggacgggaagccaggcgttccgtgctcatggctcaaagccctggagctcgacagcaatcctggtcccgcattggccacagcaaaagtcttccttccgctgcacgagagtgctggcccacctggataggaggaagcaaccactggaaggatcacccgaagtcactcctacggtacaaggcctgcctgcatcggtgcttaccagtgggcacagggccaagccttttgcccacgccgcgccccgcccgccaggcttaccggcccactgacaggtcacccaagcgggaaagtgcgccatgccttaccgaggaaagactgcggacaccatgtggtcatggaaggaccgacacctacacccacggctcaagaccgcatggcatgcaatgtgacacccggaagaggcaggccgctcgaatccccccaatgaaaggcaggacaacctggcgaaagcgcagacgaacacgcagctgccgcggaccaaaccagcgcccacgggaaatcggtacgcctggaagccaccacgagcacgagacacacatgccggcgaccgacacacgacccaggacaaccacccaagcccgaggtacccagagacaagcgccccggaccacctgacccgcacacaccccgcataccagacgacagcacgcgacgtaaggccaggaagcgagaagacgcacccaaacacaacacagaaaacgacagccacagaagaccacacacgacg

SEQ ID NO: 543252 - DNA, 368 bp, Homo sapiens
atctggaagcaacaagatgtctttcagtaggtaatggataactgtggcataagcagcttgctgaaaaggaacaagtcgaatatctgaaaaagagaaggaaaacaggcagcgccatgtggcctggggccaacaatatggggaatgaatccaccatatggaatgagtgtaagatgagtgtccttctggaggtccacctttccctggtgaaactgtatcaatccaggtccatggtgagagcaccttgatctctcctcaatctcagatatcacactgtaaatgagcagccacgcgaaaccatgagaagaaactgcacgagggtgtgtcctatgtgctctcacagaaccaggcagctacagtaagatgccatt

SEQ ID NO: 543253 - DNA, 238 bp, Homo sapiens
aacgcccagctaatttttttctttgtatttttagtagagacgaggtcatcatgttggcaggatgtctcgatctcctgacctcgtgatccaccgcctcggctcccaacagttgcttgggacttaaccaggtgtgagccactgcgcccgggcccccaggctaaatcttttacaaaaaaagttggtttttgtaagagatggggtctccctcattgttgcccgggggggttaacccggaagg

SEQ ID NO: 543254 - DNA, 617 bp, Homo sapiens
gtccaagtcgggcgctgcaggtggaatccagctgcaagggagttagggaaatgaaggtctttctgtaaaagcttctcagccttcctagggaacagacatggggggagccaatctgcaatctgctacgacaggcatgagaccagttagatgatggaaatattatagagagttatgaacacttaaataatgatagtggtatgacatgggatagaacatgggatactttaggaagtggaattgacagggcatattagtggaggaagtggagtcatttgagtctcttaatagccaggtatcataattaccaagtgaagctgggggcacatatggtctccatgttacagttggggaatataatggagagattagtatggttctctgtcatgcccacaagccctttgtacggaagagggccctactatagcagttgttatatgtgtcaattgatgagtataatgaatgagagttcgggtacctcctgtctttacaaatatgggtgttgccagtattggtccttttgaaccatgccaatcggggtgaagggagtgtccattgtgggttcactgtgtatatccctgataggtataattgggtcctagaaatctttatacatgcag

SEQ ID NO: 543255 - DNA, 379 bp, Homo sapiens
  misc_feature (179)..(180): n is a, c, g, or t
  misc_feature (274)..(274): n is a, c, g, or t
  misc_feature (295)..(295): n is a, c, g, or t
  misc_feature (323)..(323): n is a, c, g, or t
taggttacaaaggtgacccgtccaagggggctttttctaatgaagtgagcctcagtgtggattttgtaggttttagttcaatgtttaagtctcataatattatcaatgtaccgggctacgattttcaaatactgatctactactctcttaacatgtttatagtttagtgaacatgtccnntcacagcatgaacattccagagcctcaaatgactgtaaccaaaccaactgaaaatactcccaactttaggctgagtattaccctgctctacagnacccctagagaagggtgtgtnaaagcagagagagtcagtaataatcaanttttatttccacatttaaatgggctgataagggagaggggatccgtgcacgttaac

SEQ ID NO: 543256 - DNA, 874 bp, Homo sapiens
ccccattaaatatctctcaactctaaacaggctcccatcatctattatccccaccccacctacaccctcatttaccaccgcaaaactttaaaacacacccccgcgccaaataaaaaatcatcacaacccactctcccactcaccctactctataaacctccatacacaacaccactcaaaaacctcaccaaaacccctcccccatcctactcctaacacccccaccacaaccaccctcttacacatcaccctcctaacacaactccactccccaaccccaccctctcaccccccccccaaccacccacaatcaaattcctcactacacccactacaatcctcaccccccacctcccctctacaacactccacacatcttacccacctcccaccacttcactccaccaatcctccccaaccccattccatctctccaccctcacacatccctaaaccctctcaccaaatacctcacaaactcccaacactcccccttcttcacaccctacaccccacacacccccactccctctcacccaactccacacccctcactccaacatactctcaccactcaacctctcccaccctcaaccccaaccctccatcactcatccctatccaatccactccccccctatcccctctacacctactcacctactactcacctcatcaaccctctatccactctcccaattctctctccaccacccaaccacatcaactaccctcactcaccacactcaccacacctcactctatctcacccctcttcttccaccctcaccacatcctcactcacactctactctcactctacctcccaccctccctcctctacccatccacacactctctacatccaccccct

SEQ ID NO: 543257 - DNA, 169 bp, Homo sapiens
atgcagacacgatcccgagcatcccagcccccaggacaatgagagtgactcggactcgtcagcccagcagcagatgctgcaggcccaggcccccagccttgcaggctcccactggggtcaccccagtctccctccgtcagctcctccaggggaccccatcagactgccc

SEQ ID NO: 543258 - DNA, 520 bp, Homo sapiens
  misc_feature (44)..(44): n is a, c, g, or t
  misc_feature (372)..(372): n is a, c, g, or t
ccaaatcattgagttagggttcggggttgggttttctttctttncgcaccaaatttaacccttcaaagggaaacctttgccgtcccccgagggcgcataaaggtccctcgtggtgagggtccatgctcccccccttccccccgtagagaggggaattccttaccacaaggacctcccaaaattagggtttggggcgcttccgttcaccttttaaggcccgggggggccccccgtgggtgggggcctttttccaatgggggcccgcccttgggggtttttaatttttccccccccagggggggccctttttttaaaaaaaaaaaggggggtttttttttttttttttggaaaaggaattttggttttctcgtncccccccggggggatccttttttcccctggggccaatgtgagaacggggggttttccctatttttttcccggggttgggggttggacccggggcccccccccgtaatgccttgcctgttcccatgtaataaaaaccccctttttttta

SEQ ID NO: 543259 - DNA, 186 bp, Homo sapiens
cataatattatagatagaatattagtgattacgggggaatatacagccgatgttccccataacaatgtttcagtgatgaacctcatatgtaatagaggttttcctaaaattataatagatatgtttagatacacaaatatatacactgtgttaaattgcctgcagtattcagcacagtaacctgct

SEQ ID NO: 543260 - DNA, 1148 bp, Homo sapiens
tctatggaggtgatcctgtgtcttctttccattctagtatgttgttatgcctcgtgctcttttttcctctctctgcctcctggttgttatttcctgtattctgtctttttcatcttcgtgtcccctcatccttcttttcacgtgctagtcctccaattaattggtatcttgtctatctctttgtgtccttgctctttacccatgcatatgctggcgattattgtcatgtgtgtgccatagtgtcactatagtccgctccctatcttaatgcccacttgtgcgttacttcggtgttatccattgagatgtatgtccattagcctccaagtcattcttcaactgccttcttgcattccccttctgcttttctctcccttgcttagttcatccaattgtcatcttttgggttattcttgtgtataggatctatattatccatcatcgtccatgctactctctggtcatccctctgttatgttttgttgtttggctccatttccctggtgaattcctgttgtgtcgtgattgtcgcggtggtctttctcagaatcatttcagttcctggcttctattcttggcgcttgctcaatgattcttgttgtggtcattaggtctattcccatgttgtctgatcgggaaagctctactggcatggccttttcgtgtccctcactgcctacgtgtcatgtggtggacctgactctgccgtctagaaaataacctgctcattatatgatgtacaatcaagaaggtggtgaagcaggcgtcggagggcccccttaagggcatcctgggctactctgagcatcctaggtggtctcctctgtacttcaacagcgacacccactcctcctacctttgtacgctggggtctggcattgccctctaacgtaccactttgtctagctcatttcctggtatgtacaacgaatttggctacagccaacagggtggtggacctcatggcccacatggcctccaaggagtaagactcactggaccaccagccccagcaagagcacaagaggatagagagagaccctcactgttggggagtcctgtcacactcaggtcccccaccacacttgatctcccctcttcacagttgcaatgtagacccttaaagtagaggggaggggcctagtgac

SEQ ID NO: 543261 - DNA, 234 bp, Homo sapiens
tgccctggggaactaaaaaggggcctcctttattggaaaatttgctttattactttggtttgggactgcccccccccatttttgaaggatgcatggatagcttttcataacccagatatcccctttggcccgatcctattggttctggacaatgttgatgctaaccttgatgatatccatccctattactgggatccttatccacaaatccataaatattttttgaacctttta

SEQ ID NO: 543262 - DNA, 215 bp, Homo sapiens
aaataagcccaccaaggaaggaaatcaaagcgcatcgcatagtggtttccatccatccatccatccctttctctcgttgctaggcagctagatcttgatcttgtgttgcaggccggccatggacggcgggaagaagggcggccgggaccgcaagccggcgcaggagcgcagcgaccgcaagtcgggcaccgggatgagcggcgacgccaagaagg

SEQ ID NO: 543263 - DNA, 666 bp, Homo sapiens
cgtttttaaggagaacacaggccccctgagttcttcaccttcgaggaggccctccctatttggacatggtgattgcagagccgctaggtatgtccccgccagctttcagattcacccggaaggcagttcaggattgcgaggtgttggggcagggcatccccgcaggcgctgtgctaaagatggccgtgggtgccctgcaccatgaccctgagcactggccaagcccggagaccttcaaccctgaaaggttcacggttgaggcccggcaacagcaccggcccttcaagtacctgccctttggggccggcccacggaactgcctcggggtgggtttagggctgcttgaggtcaagttgaccctgctccacgtgctgcccaagttccggttccaagcctgcccttagacccaggtaccgctgcagctagaatccaaatttgccctaggtcccaaaaatggtgtttatatcaagattgtatccccctgacacaaaagggtgcccggggggggggagggcccccccaaattcaaaaaaaaccctaagtgtggatgttcagaattttggaaaaatgtccctgaagtgattgaaaaagggcctggcatgcaaggataaaaggttttttacataacatttcctaaatgcttaataaacgtttgttgcccttgga

SEQ ID NO: 543264 - DNA, 841 bp, Homo sapiens
cgtggtggcttacgcctgtaatcccagcacttcggggggccgaggcaggcaaatcacgaggtcaggagatcaagaccattctggctaacatggtgaaacctcgtctctactaaaaatacaaaaaattagccaggagtgcttgcaggcgcctgtagtcccagctactcgggatgctgaggtggagcttgcagtgagccgagatcacaccactgcactccagcctgggcgacagagctagactccatctcaaaaaaacaaacaaacaaacaaacaaaaaccctgaaaccaaaaaccaaaacaatcctaaagactgctgtagcctaatgagaggttgatatagttgggtctgtgtccctgcccaaatctcatgtggaaattaattcccactgttggagatggggcctgctgagagctgattggatcacaggggtggatttccctcttggtactgtcctgagttctcatgagatcttttgtttaaaagtgtgtagcacttaaccaccgcacccagaccccatcttggtcctgctcctgccatatacgaacctgtcctgctttgccttcaccacgagtgaaagctcccttgaggctccccagaagcagatgctgcatgcttctatacagctgcagaactggtgacaattcacctctttcttataataccagactcagtattcttttgcaggggggatggctaaacgggtgaaacccggctcggggtttggctaaaatttcactggggggtctgaaacattcccctttttttggggccaaaggaaattggggctaaaccggtccccggggtcgaaattcccgaatggaaaaagataattgggcaagg

SEQ ID NO: 543265 - DNA, 112 bp, Homo sapiens
gaccgacggggtccggcttgactatcgggacggactcctacttggtgacgaggggcttagtactgacttactggcgcgttgacttacgtacgtacgttacctgggttgacac

SEQ ID NO: 543266 - DNA, 320 bp, Homo sapiens
atagcgacaccgtactacttaatgatacaagattagtcatccctcagtattaatggggaattgcttccaggaccccctatggataccaaaatctacagatgctcaagtccctgatattaaatggcatagtatttgcattacctatacacatcttctcatatattttaaatcatctctagcttacttacagtacctaatacaacataaatgctatgtaaatagttatactgtattgtttaggatataatgacaaggaaaaaatgtctatatatgttcagtatagacacaaccatttttttttttttctaaaatattttcag

SEQ ID NO: 543267 - DNA, 201 bp, Homo sapiens
agcaggatcctggacagcatcctaaccagagaaccaggggtgccgtattatcttacaagaaaatgcactgtagggatctaataattgtagactcagtagagactacaactccccttctggccaaaggtgttctttcttttacactctattcatgaagttccacatggggaatacagaagcttcataattctttcccccccc

SEQ ID NO: 543268 - DNA, 178 bp, Homo sapiens
cgatctgactacgcggctaggagtcaataaagtgattggctgagagggcgaaatattatgctttgttgtttgtatatatgacaaatgtcaattattcgctaggatgacgtatttatagtcatacgtgtaacggacgcctcctagttagctaggtactgtacgctcgagtcgcagcaca

SEQ ID NO: 543269 - DNA, 143 bp, Homo sapiens
  misc_feature (59)..(59): n is a, c, g, or t
tgagctcggtaccgctggtacagttgtgggactgcatgctactgtctagagctgttccntggatctagaacttcatcgcccgctgaatgacgcacaggatggcgccccgaatgcatgccgccgaatgcattcggcgcgcagaa

SEQ ID NO: 543270 - DNA, 301 bp, Homo sapiens
ctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacgggcccaaatcttcttgatccatatgtttaaatatatttttt

SEQ ID NO: 543271 - DNA, 299 bp, Homo sapiens
  misc_feature (53)..(53): n is a, c, g, or t
  misc_feature (55)..(55): n is a, c, g, or t
  misc_feature (102)..(102): n is a, c, g, or t
accccggggtgtgtgtgtgtgtgtgtgtgtgtgtgtgaaaaaatacatagganangcagtagttctctttatctgtgcaatcacattctgcagtttcaggtnctgtggacaactgtggtgtaaaaatatgtgagtacagttcaatgagatattttgaaagaggccacactcacgtaacttttatgacagtatattgttataaatgttctcttttattagttattgttcatctcttactgcctctaatttatggactttatccaaagtgtgtacatataataaaatacatagtatataaa

SEQ ID NO: 543272 - DNA, 718 bp, Homo sapiens
ctgataatggcattatgatagcatggaagggtattgaaagactacgtgctggcttgggcatattacatgacatagaaggcatccgctatgaaccaagaatgtcctcttggagtagacatatcaaaagaagttggagaagcttccataacgagtaccagcaattaaaaatggcagattatgactttcgtgcgtgttgcaagaaaagtccctaagagggtctcactctctgacctcagctggagtacaggagccagatcacaactcactgctagagcactgacttcctgaactcaagaaatccgtcctgcgtttaggcctcttgaatagcccgggactacaggtgtgcatgtccatgcgccagccaagtttatttctattttttgtagagacaggctcttgccatgttgcccgggctggtcctgaactgctgaattcaagtgatcctcccaccttgggcctccagaagtgctgggattatgggtgtgagccaccatgcctagccaaaagtgtttcttaaggtatacattctgggtcttagaagacgttatacatttgtaatatttattactaagatatcgtcaaagtgattacaataacatgttgaccactgtgagctacgtttgaatcatggcttctgtgcacaccaagttgaaaaatgttaaactctgtgatatatacactagttataccagctcatgtcagtcaataaattgaaggt

SEQ ID NO: 543273 - DNA, 204 bp, Homo sapiens
tatagcatcctaagcagactgttcactgtattgtggacagtgcatggagaggcagtggtgggaatcttcttgtgatatgtgggtggtggctgtatggagtggagtggtggtgaggctggctcagtcgcgtggcactccctgctgactggctggatgcggtcctggatggaataatgccttcagtgagccacttgaccctgcaca

SEQ ID NO: 543274 - DNA, 431 bp, Homo sapiens
  misc_feature (40)..(40): n is a, c, g, or t
ggtgtgtgagcatggggaagttatttgcactttctctgangagcaattttgggattccggtttaacaagatcttgctttacatctctgagtattgatgtaatttgatctgtaggagtggccagaagaatatcatccataaaatgaatgatatcgcagtgggaaacatattttgagactcctttaatgctcttcctacaaaatggtgacataatgtaggactgttaagcatgccttcaagtaaaacttgtcattgatagcaagaaacaggttctctatgattaatagaaggcatagagaaggcaaattgaggcttatgcttctcgtgtaatggtataataaagaaacaatccttaaaatctattaccacaagaggccagtctcttggaatggccgccggggaaggtaaaccttgctgtaatgcacccattgg

SEQ ID NO: 543275 - DNA, 351 bp, Homo sapiens
cagttaaaaaaaaaaaatcaaggataaaattaaactctcttctaactctccagtataaattccaattatttgttaaaaatagaagttctattactagcactttgggaggccaaagtgggtggatcacctgagatcaggagttcgagaacagcctggccaacatggtgaaaccctgtcccgtctctactaaaaatagaaaaattagctgggtttgctggtgcgcacctgtaataccagctattcaggaggctgaggaatgagaatggcttgaacccggtaggtggaggtgcagtgggccgagattgagccactgactccagcctgggtgacagagtgagactctgtctcaaa

SEQ ID NO: 543276 - DNA, 520 bp, Homo sapiens
  misc_feature (2)..(2): n is a, c, g, or t
  misc_feature (69)..(69): n is a, c, g, or t
  misc_feature (110)..(110): n is a, c, g, or t
  misc_feature (122)..(122): n is a, c, g, or t
  misc_feature (130)..(130): n is a, c, g, or t
  misc_feature (259)..(259): n is a, c, g, or t
  misc_feature (263)..(263): n is a, c, g, or t
  misc_feature (265)..(265): n is a, c, g, or t
  misc_feature (278)..(278): n is a, c, g, or t
  misc_feature (308)..(308): n is a, c, g, or t
  misc_feature (319)..(320): n is a, c, g, or t
  misc_feature (353)..(353): n is a, c, g, or t
  misc_feature (365)..(365): n is a, c, g, or t
  misc_feature (369)..(371): n is a, c, g, or t
  misc_feature (377)..(377): n is a, c, g, or t
  misc_feature (380)..(380): n is a, c, g, or t
  misc_feature (388)..(388): n is a, c, g, or t
  misc_feature (392)..(392): n is a, c, g, or t
  misc_feature (395)..(395): n is a, c, g, or t
  misc_feature (398)..(398): n is a, c, g, or t
  misc_feature (400)..(400): n is a, c, g, or t
  misc_feature (403)..(403): n is a, c, g, or t
  misc_feature (405)..(405): n is a, c, g, or t
  misc_feature (409)..(410): n is a, c, g, or t
  misc_feature (416)..(418): n is a, c, g, or t
  misc_feature (420)..(420): n is a, c, g, or t
  misc_feature (424)..(424): n is a, c, g, or t
  misc_feature (431)..(431): n is a, c, g, or t
  misc_feature (436)..(436): n is a, c, g, or t
  misc_feature (440)..(440): n is a, c, g, or t
  misc_feature (445)..(446): n is a, c, g, or t
  misc_feature (449)..(449): n is a, c, g, or t
  misc_feature (451)..(451): n is a, c, g, or t
  misc_feature (483)..(483): n is a, c, g, or t
tnggggtatagggctcctgcatccctctgggatctgagcatagaaggctcgggcagagttcggcgagtncataaatggaagcggtattttctggctggcttgaggttgangtgtgtggcctngatctgcncggcctcagggttccgcacatctttgaattgctcccctttggtgctcactacctggttgtcgatgtttcggatcagcttcttgggggcctccttgggagccatgggccggtgaatctactgaacctctncgcnanccaccatcatgtncttctgcaggatgaaggactggagcgcagncttttgggggnntgtgaggggtgtgggcaggggctggttggggcnctgccagggtgngggnnntgtgcnttngcctgtgngagngtntgngnagngngtgnnaagtgnnngngagngtggggnagggncgantgggnntgngncaccgaacaggtagggaacaccttcaggagtncatgcacccctgggagaggctcctgctcagcgccagt

SEQ ID NO: 543277 - DNA, 406 bp, Homo sapiens
cctccttggatatggtcatgccatcttgcacttctccaaacacagtggtctgaatagagtacccgcggtcaacaccattgcccccaccacacagcagtttggccccttcttgcttccccgtgttaatgaacccgagtatcttcttaacttaagtttcatccacttgcggcccgtgctcgttcttgcatatcaaaggggttcccgaccacccaagacttggcgcgggcaacgttccgctccacaacctcatcatagatgtcctcgtgcaaagaggtccggaaggcggcacagcagcagtggctgtggttaaagcacagggcgaagtgggcgtgttacgcggcactatacatagcggcatctcacatgattatgttggcgctcttcccctcgtgccgtctcctacagc

SEQ ID NO: 543278 - DNA, 356 bp, Homo sapiens
  misc_feature (13)..(13): n is a, c, g, or t
  misc_feature (106)..(106): n is a, c, g, or t
  misc_feature (112)..(112): n is a, c, g, or t
  misc_feature (114)..(114): n is a, c, g, or t
  misc_feature (125)..(125): n is a, c, g, or t
ccgtgagttaatnccagggaagatatttctttgatactcggaaatgacaaaaatggaaaggaagaagtcataaagagaaaaattccttatggtggggggggggggntgtatnanaataaacccanaagaccctacatactcaaaagagattcttactattactgagagaataaatcatttatttacatgtgattgtgattcatcatcccttaattaaatatcaaattatatttgtgtgaaaatgtgacgggggggggatctgtctcttctacaattagagagaattgaatgggatttttctgcactaatataaattagactaagtgtgtttcaaataaatctaaatcttcagcatg

SEQ ID NO: 543279 - DNA, 143 bp, Homo sapiens
gctgatgtgatctagaggatcccgatgctctctctgtggggctgccaggctccaaaggccccgttggagagggcagccaaagaggcgaagcttgtgggacgcccaaagggatcaatgtgggtgctgggggctcagtgaatggg

SEQ ID NO: 543280 - DNA, 225 bp, Homo sapiens
tcgatctagaggtcccggtgttatcgatgccacttcacaatattttatcaaaaaactcacctgagaaaactcaaagaatcacaagtattaagcgggagcccagaaggtctgagtgaaagggaggagaccactgggtagatatagtccagtacgggacgcatatcctaagtggtctggtggccttcattgggcccatggagacacagagggaactgtggtgagtgt

SEQ ID NO: 543281 - DNA, 339 bp, Homo sapiens
gcggctcggcagacggtcggtcacgaagcagtcatccattagcaggtccagtgacacctgacgccttctgtcgtctcctcaatatgatacaaataccttcaagacctcaataggacatgactgcaggagggagtcctacattcaagttgaactcggaagtgcaatgactgctagtgcagcgaccgcctcactagatcgtcgggattgcatacccccgtgaggttttagttaacagctaaacaccctaatcaactggcttcaatctacttctcccgccgcaggaaaaaaaaggcttcccacaataattgtattatcaacactagtcctacctataacacc

SEQ ID NO: 543282 - DNA, 219 bp, Homo sapiens
ttttttggggggggggggggggggaactttctttttttttacccaaacccggggggggggtggggggggggggtagttttcttttttttaaggcctttaaaccccgggccccgggtttttttttaaatttccttgggtccccccccctaaatttggggggaattggcccaaaattcttttttcgtttttttttttattaatccttgggttttcccctta

SEQ ID NO: 543283 - DNA, 375 bp, Homo sapiens
gtgtccattttatgcatgtttgaaatattttatttaaaaagaaaaatagccctgccctgtgcgtgggggccactaacggcccaggtccatccattctgaatgggaaggcggagactgccagcacgttccgtggtcgtccgttggtgtgcgatgaggtgttgttccctcatccctcccatccatttcactgtgtgtgggggggtagcagggggtaccacgcaggcgttgaggcagtcctgtataaatccagagtcagttgtttttgtattttaggctattcttccaaagccaggagatgtttggaaattaaggaaaaaattaaattctcgtcgatggtggctgttatagggaaatcagtaaagatcttgagtatcg

SEQ ID NO: 543284 - DNA, 738 bp, Homo sapiens
taacccctctttagtttattgccctcaaaaaccaatttaaaccccccccccttgtaacgggggggcggggacaaaagcaaaaacgccgcaaacccggctgggaaacccccatgtgttcgtggccccccgccatttatcggccctggatggggttttgggtgtttccatctggtccctgtggctggggtgtgagatgttgagagggtgtggagacgcctctgggggggcgcatctggcgccattggtagcccctttgggaagaatgttcagaagggggatgtgggcaacaaggggcattggtccgggcctggggctctcgggggagcaccagggggttgggtccccccagcaaggttctcgtggaggggcgggaggggggggttggggcgagggtctctctcgagggtggttccgcgggagggttgtctgcggagaggccccaacgagggagggggctccccgtggtgtggaccgtgaaaggtgtgaccgcggaagtggcacagagcgggtcctaacccggttgggtgttcatcacgagggggggtcccccatccgagggcgggggccgaggggggggcgcgtctctttcgcgaaaacctttgtggaggaaaccctctccccttttcccctgggggggaaccatcttgtgcccggccctctagaaaaccctgacttgtgtctcccaggggggttccgaagctccgggggggaacctctggggggcacagggggttttac

SEQ ID NO: 543285 - DNA, 443 bp, Homo sapiens
  misc_feature (5)..(5): n is a, c, g, or t
  misc_feature (11)..(11): n is a, c, g, or t
  misc_feature (69)..(69): n is a, c, g, or t
  misc_feature (87)..(87): n is a, c, g, or t
  misc_feature (158)..(158): n is a, c, g, or t
  misc_feature (163)..(163): n is a, c, g, or t
  misc_feature (208)..(208): n is a, c, g, or t
  misc_feature (243)..(243): n is a, c, g, or t
  misc_feature (337)..(337): n is a, c, g, or t
  misc_feature (350)..(350): n is a, c, g, or t
  misc_feature (363)..(363): n is a, c, g, or t
  misc_feature (376)..(376): n is a, c, g, or t
gactnaaaaanggactccaaatccctgaaggctggggaccctggggaatgggtttctcaaaacccccanatgtctgtccccttgganagggtgaggctgaagcacccagggagaaaatatgtgcttcttctcgcccctacctcctttccccatcctanactgnccttgagcccagggtctgtaaacctgacactttatatgtgttcanacatgtaagtacatacacacatgcgcctgcagcanatgcttctgtctcctcctcctcccacccctttagctgctgttgcctcccttctcaggctggtgctggatccttcctaggggatgggggaagccnctgtgcaggtcancttccaggcaatntgaagataggganccacgggcctggcagtgagaggtgtggccccacaccgatttatgatattaaaatctcaactcccaaa

SEQ ID NO: 543286 - DNA, 411 bp, Homo sapiens
  misc_feature (28)..(28): n is a, c, g, or t
  misc_feature (238)..(238): n is a, c, g, or t
ttgtttttttgcccccaggctggtcctnaaaactcccctgccttcaacccaccctccctgccttgcccccctaaagtggtgggattaacaggcgtgagcccactgagccctggtggatgtttttttttgttgttgttgttgttttgagatggactttcgctctgtcacacaggctagagtgcaatggcacgatctcggctcactgcaacctccgcctccccgggttcaagtgattcancctgcctcaggctcccaagtagctgggaccataggccgtgccaccacgcctggctaattttttgtatttttagtagagacggggtttcgccatgttagccaggatggtctcaatctcctgacctcatgatccgcctggtggatgtttttaatgattatccttttgtactgtac

SEQ ID NO: 543287 - DNA, 183 bp, Homo sapiens
taggctgcagtgctccacggaaaagcggccagtataggtgatggggggcagtcgagtggtacggctgaggtaactggtctccaccagcaccttctcgctagatcagagagatgtcaggaaaaaactctgccaggagcacagagaagcgggaggccatggcttactgagaacgcaatcacctgg

SEQ ID NO: 543288 - DNA, 1528 bp, Homo sapiens
  misc_feature (304)..(304): n is a, c, g, or t
ggtgggatcggagtgcattggttttcttagttgcttgcccagtagccccgaggctcggcctccacccaggataagacagtgccctggcggacctggtgggctcctgtgctctagcgagtgtgttgtgcacgtggttagacccagtggtggccgaggtggagtgtttaaccagttcgtcctgatcgtcccgtgtaagtagacgagtcctctggtaagagaatgtataaatagatagagagggcatcgaccgcgtccttcgcagtactcattctctctcgaggttcttagtgtgtacaagcgtccnagcatgtattggtataaccactagttgataccaatataagtatagattcgggctaatgccacatggatggtcgattgctgtttgtgtaagcgtgacacatcttggccttgggcttgacagctagtaggaagcccgtagtaatcaaccatgggtcgtgtgtgatggctcaccagtagaatggtggtgggaccatgtctaagctcgagggatcggaattgctgaagccaccaaggcttgatggtgttgtagtgagactccgtcgccccagtaggaacggctcccatggaggggtctcgcaaggtttgggctaccttatcgtccctctttgacaccggctcaatttggtcaggcaacagatcttggtttgcgtacccttgccgaaggtcggtacacgcgtaaccaggtcaccaatggtgggtcccccgtgttgtggaatagagcatcactttaagacgttccattgcttgttccataaccggacggcatgtactactacctcgggaactatgtttgtctcaagcggggaaggcctttaggaatccttcaccaaagttgtccgcgtcacctgtgtggacaaggttggcgaaccttgtagcacatatcaaagggcacaccgtccacccatactgaaggcaaagactttttagaagacacccattttgtgatactgcggaattatgggaagattatcaagcgcaagggggacacattcggggcttgaatatcttacactagggcaggcggagagttcatagggagggtccagccctttagagaggtcgcccttgtgggttagaagtcccacgcattgcgattacagaggaatgctagggccaaggcccgaatggccccgcaggggaaatctaaggaaacggggaatttttccacttcttcccccctatttgggaagcattcaatacaagtcgcgtatggcgggagaagttcaaaggcctcccaaggtttggacagaggcatccactggtcgaggcataggtagtatccgattcaagatcgccgcagggaacaccatcgggcttggcactagagcggtgtctctgggtagcacacttaagaaccttttaggctttacgaaagtgagaacggccgggaactatacacttgggtggggaacttgacagcaatgtggctggacctatgtgccaagggccacaagtgagcactgtgaccccgtaacacagtatagatacattcaagctgtgacca

SEQ ID NO: 543289 - DNA, 316 bp, Homo sapiens
agagacaagatgaaagggaaaaaaatcagattggggtagcggaaagacctcaggctgagcattttcggggtttcttgagcagtgctacaatgaaagaattggagggacgataaaggagattggtaggaaggcttggttaatggggtttacaaccttagatgttatttaaacaaatcttttgagaaaaagcacatcaaggactgaggattcccttttaaaattcctttctggaatgctgggactggtggctttctttggtattgcaaatttctggcagaggattggccccacctggggcctttaggcattattatgg

SEQ ID NO: 543290 - DNA, 125 bp, Homo sapiens
taggtcggtcctcactaatgtcacaaccagtcccatttttatggccaaactgtattctgaaacaaaatgaaactgcaaactcgtgtgtcttaactccccccagggatgcactccattcctccggc

SEQ ID NO: 543291 - DNA, 439 bp, Homo sapiens
  misc_feature (95)..(95): n is a, c, g, or t
aggaacccctgtgggaaaggtttaaacctaaaacagtgccccctttggctcctcctcccttggcggaatgggttcctggaccatgtgcatttcantgggccatgggatttacatttccttgcatccccaggtggtttgatccctgccagggccccttccttcctgctcatggttttcagggggcctgatcatggaaagtaagggggttgggccttcccttttgggggtgaaccctgactccatccccctattgcccccctaaccaatcatgcaaacttttccccccctggggtaattcaccagttaaaaaaagctttttttaaatgttttgttttggggggggggcagggccccctttttgtttttttaaggagttggttttggtttttggctgatgttttgttttttaacatgcccccagtttgtaaggccaaaggta

SEQ ID NO: 543292 - DNA, 392 bp, Homo sapiens
ccagcaccaacagctgggataattgtagtctgctgacaaaagtctgaagaggcgacctgtattaccatccctgaatgggaacgagacagaacgatccttggggtctcctcatggtcggaagagcgggctttcacttttggaaccaacatctaccattgcccaagctgtatattcggaaaatggctcatgtataactcctagcctgggttaaccatttacagccacacacaaccatagtcactgacgtacttccgaaaaccctctgtatattcctgtgtagcatcaagggggccaatccagaccgtaacactttctcgctggtacctctttaggagtagtcacttcccttaggaatatcctcaggaatcttatgatcccacaagataacctcc

SEQ ID NO: 543293 - DNA, 649 bp, Homo sapiens
ttcggtgctgttgttgcaggtgcagctgctttattgttataaaagggaaccttttacaacaaatatttgaaaaattacctccattattataccttctctttatgtaattgttagttcgaaaattttttcttcattaatataatcaacttctaaaactttctaaaaacgttctctttttcgagattagtgcttcttcccaatccataagaaatgtttcctttcttgacaattggcaccagctggctactcgttgctcgaaaactactctcttttatttttaatttacgaacgattatctttcgaaggaacgaccaaacgagctaaatatgggcatcgccaacgttaaaaaaatggaccctaccgaagacgttattatgccaaggcgcagcgaagagtctgtctccttgagaaaaaatatgcatgaaacaaaatagacacgaccagaccctcttcgggaaaaaaagtcaagatttaacacgtggctacaccggctggcttacaaccaaccaacataagatcaaacaaccctcaagtttagaaaatccctaatagcaacctctaaaaccatagacttctccattttcacgtactaaaaaagttcgggtatgatgtcatacaaatcctttcaacaaaagatgcttcaagatca

SEQ ID NO: 543294 - DNA, 978 bp, Homo sapiens
gtcgtcggggttccctgcttcaatcgtgtgcttggactggaacccgtcgctcgttccccacctcggtcggcggtccataggccagcttctccgtcacccgcaatctccgccacctgcgtccatgtgcgcccactgtgagatatagccccacgccatggcgaccaatcacagtctcgcaaatgaagtcttatccagcatatatgaacattcatgcgcgtcccttctcaaatataagtcaaactgaaggacctggtagagatgcattgcgcttttctttgccccccaagtgcattaatagcttacattcgaccgactttggtacacagcaggtactttatacaagattggaattctggcgcaagaaggtaacattgttacacgccgggcaatcttaaatctcttttacgtatggctccaaaagctttaacagtagcgactcgattgacagatgggggcacgatttttagtgacctcttagggatcatagaagacgttgttgctagcagttttcctccaaatatgggattgtcgatgatatcacgcgtaagggtttggtgtgtgtaactttatcattggggacccacttgtatgtaggaagtcgcatgagaatacgggtaaaagggatagaggcagactttgttgagaaccagggacagctatgtggggccaggaatgaaagtggccagacattacatccaatctattaggtaggctgccacttcaaaactaaacacagcagcataactattgttaattcccaaggagatcactttattgtaaaccattagcagacgtttgtcctatcaggtgatggctgattaggctgcatttactccgggattgggagctagtgtgagttgtgtgtcatggtacgacgaagacctgctgcttaaaactgcttgggttgcgttactggaatatagtcgagccaaagaaggccccctttagaagatatccaaacggatgtgcgatggactg

SEQ ID NO: 543295 - DNA, 350 bp, Homo sapiens
tcagacgtgaactatgtgttaaaattcaggctggagtgcagtgtcagaatcataggctcactataattttgaactcctttttgcccttttttaaactggattatttattgagttttaagaattgctaatattttaaaaacagtttttcttaatgtttctattttgagtggggcattcaaacttttctgagccttgttgaacattattagatctgtgggctgaataatagtttccaggcaattaacatttttgtttttgcttgttttagatagtgactcagacatctcctctacaagtacctaacccatcctggatgcaccaccattcataccacatagttcagcgtctga

SEQ ID NO: 543296 - DNA, 119 bp, Homo sapiens
gccggtaccatctctccacactggtgggaggcagataataatcatagaggacaatctagtttcattgtttaaagacagacagcatataggggaatcttgagtaattcaacacgcggttg

SEQ ID NO: 543297 - DNA, 552 bp, Homo sapiens
agagtacagtaattcaaatatagcacagtacagagtttaccaaaaacacataaaactttgctagatagacagtgaggtggaaaggaactaaaatgtatctctcttgaatagcatttggggttcaattgaatttgttgtgtttacaacagcaaagcaccgttagcctggacagttgcttatggcatcgatagggttggataatattctgggatttgttgcagcagaattcctctatctgatgatcagcagttgaacataaacttcataattatagtaaaatttaggaaaaactatgagtgtgaagagtatgaactgattgggtagattaggcagagtgcattatgggcaagacaaaggttttcgatattaacttcttttaaaataaactttttattttcaaacagtttcagttttacagaaaaaatgtgaagctagtacagagaggtctcatttaccccacacccagtttctcctgttattagcatctcacattaatatgtggtatatttgttacaattaataaaacacattgatatgttaatattaaaatta

SEQ ID NO: 543298 - DNA, 184 bp, Homo sapiens
cacggttgctcataaacctccaaaacattacgctacgtcaaagaagccagagcacaaaagatcacgatcatgtatgatgccacttacatgacaatatccagaataaatcaatccacagagacagaatgcagattgatggttactccggggctggaggcacgggcagaactaaggacacacctgc

SEQ ID NO: 543299 - DNA, 318 bp, Homo sapiens
  misc_feature (164)..(164): n is a, c, g, or t
  misc_feature (293)..(293): n is a, c, g, or t
  misc_feature (297)..(297): n is a, c, g, or t
ctgacgcgggaacataagttcgacaacttaaaaaatgataacaagtccggtttatccccgctgatgcagggaacataataaaaactttaactagttcggtttatccctgtttttacaaggaatattaactacactcgatgtctttagaataaaagacaatacgnatcgcactttatcaattttcacttaaagtatgaactggatatctttattcataagaactattcatcaacagcgtatagaggcggttatgtaaaaccactcattagcctcaaaacaagacaaacttccanattnttacttaaccaatgaataaca

SEQ ID NO: 543300 - DNA, 456 bp, Homo sapiens
tatactggagacggctgcacaacagtgtgcgtgaagctttaaagttacgagcttacgcttaaaagtgcttaaaatgttgtgggctttttgtttgtgtttgttagagagtttcactctgtcacccaggctggagtacagtagtgagatctcggctcaccacaagtccgcctcccgggttcaagcagttctcctgcctcagcctcctgagtggctgggattacaggcacgcggcaccaggcctggctaatttttgtatttttagtggagacggggtttcatcatgttggccaggctggtttcgaacttctgacctcaggtgatccgcccacctgggcctcccaaagtgctgggattacagatgtgagccaccacgccaggccctctctttgaatttcatagaacaagaatttttgtgctagggctctttggctcaacattatatttgagatgcatctg

SEQ ID NO: 543301 - DNA, 594 bp, Homo sapiens
cggacgcgtgggtcgacccacgcgtccgcagcaaaaggtgggatctaggacgaaagaatccagtgtagaagttgagaagaacttgaacgtttgggttctggataaggtccctgacgcggccggcctctcacaaacagcacaacaacaggacacagtcgcacaaccacgcgccgagagttcacagcacgaaccacagaacagccggcacgcgcagagagccccagcaagacgagcccacaccgagtaacggcagaccactcgtaagcaccaagacaacaacacacggaagagagagaaaaaacaaagccgcaaacacaaccgagcccaccaccactcgagaacgacaagaggcccacaacccacacaccgaggcaaaccaagagaaaaaacaagaaagagaacacaaaccaagaagaccgaacagaggagaacgacagagccaacacaaaacaaagaccagagacgaacaacaccgcacaccagaacacaggaacacaggcagccgaccagaaccagacggccagagagacaagacacgccagaaacagaggacaaccgagcaacaaacaacgaccgccaacaaggcaccacaca

SEQ ID NO: 543302 - DNA, 698 bp, Homo sapiens
agctgttaatttttggtttcggtcactcttgatagcagacattgactgaagcaaaaaattaaaagctttatattcaaaatttgcaaaatgaagctgggtgtggtgtgtgcacgcctatagtcccagctacttgggaggctggtggctggaggattgcttgaggtcaagtattggaggctgcagtgtaccatgatgtgtgcctataggaatggctactgcagtccaacctggacaagcgttatcaagaccccatctcttagaaaaatgcaaagattaaatgcaaaagaaatgggctgggcatagtgattcatgcctgtaatctcagtaccctgggaggctgaggtggaaggattgcttgagtgcaggagttcaagaccagtctaggcaacatagtgagaccctgctgtaaaaccacactactaacaatatgttggcatatgggggcatgtgtctgtagtcccagccactctggaggctaacggtggggacggatcagtaacagccccaggagtcacaggctgcagtgcgccatgatccatgtcactgctctcgaacctgggcgatatccagaacctgtctcaaggacaaaggctgcggaacatgttcagacaagggttgtaaacggtttgagcattatattctacaagtatcacagtaacataccttgacttttgatactggtttctcataatgccctt

SEQ ID NO: 543303 - DNA, 582 bp, Homo sapiens
cccccctaggatgcagaaagtagatgacattccatccacactgtgtgagcaaattggagagattgccttgatagaggactgatgtttttcactgatgagatggtaggggttgtcttgctattggagaaatacatcatccctgaagaactgtgagcaagtggagcgagtgtgggctttgaagggtagcgagcttgcaccctgaccggggagggcccgggtcacacagttgttgatgtggaacaggtaattgccctgtttggagttgcctgttctgcccaggaatgtactccagggcctgatggcgatgctggaactcgcactacagtaaataattgataagaggaggcagttgtagggtccacttttagctggaagttcttaggggacagaaaaataacttggagtagtgagtggttctgagtaagctcaggaaacgtcaaataaaaactggatctggtcatttaacacgcagctcgcagatatccagtgctagaagaaaacaccaaaacgcggtaaaattctgtatgtgggtccacttcccgtgtctggcgattaaaataagaatatattcttgcgaaaaaa

SEQ ID NO: 543304 - DNA, 332 bp, Homo sapiens
agtcgtctagaggatccagttctggtccccactgctgctaagttgtcactatgtcccctatggctgcctgacatcttttctgggaaaagcagggctgtgtgagtgttggctctctcctttccgtacccagccatgtagttctagaagtaaggataacggcctcctaggagatgtctcgagaaggaaggtcgcacaggatgtggcatgatcgcccctcactggaaaggcagcacaaggtctaaaaaacctagaaaataggcagggccctagacattgggggacagccagtccctggcatgacccgtctctgctgtactcatctctgccagcca

SEQ ID NO: 543305 - DNA, 535 bp, Homo sapiens
  misc_feature (39)..(39): n is a, c, g, or t
caagtggccctgggatttgagattgcccctacaggaaantttttggagggaaggaaacccggttgagtttggaatgcagaacatagtattttaaaaaagacccccacgggttatgcaggtggtttgagttgggcctatgggggcttcacaagccccggccttaattaaaacttgggttccagttttggttttggggggggttccagctctttaaaccgccccagttcctccagggccggggttgtgaaaaaaatcaaaacacgttatgggaaggtggggtttgagtcttttaaggtcttgcccaagtgaaaaggtggggaagccccttcccggcctaccctttttggggttgcccaagagcttgggaaggagccccttttccagggtagccttgggaacaggaaacccccttggggtttagccctagccctcagcccccttggggggttttttacttggggcccccccttgcccaggcctccaggtaaaaaaaaattcaattggtttttttttttggtccaaaaaaaaacctcag

SEQ ID NO: 543306 - DNA, 142 bp, Homo sapiens
aggatcataaatgctgtggatgaatactaaataatgattaatagaaagattccatctcaataacagagtatttccgtcctggtgaagggttcctgctgatattaaattgtccaaatggattacttggagccaggaggaaaac

SEQ ID NO: 543307 - DNA, 1920 bp, Homo sapiens
  misc_feature (1920)..(1920): n is a, c, g, or t
gtcggactcggagatctcgttactctggtggtctgaagactctcctgcaagggcgaggcataccctagtgcgatgtttgtaaagtgctacggggagccgacggcgagccaaacagtgtcgagagcctccaatacgacacgaggaaagcgaagggtgtgactatcacacgtgaagaaacgccaatgcggatcgtaggacttagttttgccactggaccatatgatgctcgaggacgagtatgtgacgacgagtcctcatcaagcaaatgactacagcagtgcgagaatatatgacgttgacaaccatgtgagacctagttcgtcggacagcctattactcattggtcgcgctcttgaatatagacgccatgtgctacatgcgcagacacagggatgagggcgcaagaaaaaatagcggaagcgtttccggtaactaaagtagtggactctttgaccgcgataggtgacgtactggcgttcgacgtgtctataacacgttcggataggggtcgtccttgaatttggctaggtatatgaacagagagaaattgctagaggtcaacgggaacataattaagcacgtaggcagattccacgaaaattaaaagtaagtggatacaaagaagtgcaattcggatgggtggcatcttcctcgtattggaaacgcgggacaatgggtctttacgcttaggccacaaaggggcgcccaaggggttgggggtcccatagcggaaaagcttttcaaacattaaaattaagtatgtgtctgcgtgaatgcggagtataaggaaggaaagcgtacgtcaatgcgggccattgcaggttcctagggatcttatacgcgtgcgttagtggaacagaaatgtggtagtaggaggggaaaattaaaggaaagtgtctggggcccgcgccacgcaggaacagcggcacggacaacacacggggctcaaaacaaaaaggcgggccgagttgagcccacgattaagggaattacctcgccccaaccactggggcacgcaattctgtcatgaagacacaaacgcgcgggggcaccccaattggaaccaccaaagcacacagcccttggaaaggggcgatcagggaaagacaggacttcccacatgggaccgcagttggggaacaccacggaggacatcacgaatgcgcctgaaacccagagtaaatacaaaaggcgacaaattatttcacgcaacagggcaaagcacagtacggttccgacgcaaacgacgacgacaccggccaaacacgcgtttgcgacaccgacgttgcaggttccagacacacaaaggggaccgcccagacaaactcaccaaagcacatggaaccgggtcagattaggtcttctctcgtgacgacggagtgacgttgataacacggaaaatcccaagaagacaagattcaacagggaccgacgaccagggccacctgtgtgtcaaacgagatccaaacacaggtccccccaaaaaaagaaagcccgacgagacagtgtcgcaacggatgcactccccaggacaggccaccacacaagacaccggcgatgcggccaacatcgatactaaccacacatgaacgaacgggcgaaagcacaaagagaggagacacaacgcaaaccgagagcactgggtaactacaaataggcacacacgttgcgacacgggtgaacacagggaggcgtagcccgacggaacagaggacgcacctagtaggtgacgaacacaagcgaccacccgtagagagcagtatggcgaacgtcccaccacaaaccgaccaccggcagaaagcgagataagcaacgggagctgcaaaatcaaagaggcgaacagcaagaaccacccaaataggaatcacgaaagactagacggagaacgcacgaaacgaccacatgcgatcacccgacacn

SEQ ID NO: 543308 - DNA, 904 bp, Homo sapiens
  misc_feature (319)..(319): n is a, c, g, or t
ggaagaatccggcgataaatacgggaataaccacgacgacagtgagcatcgtggtctgatctcagtgatcacatggcctgaaggatggagcggagcggtgggcacggaggagccagaataagaacagtgagcgtgtgcatgtggtactgtgtgaataagcattctaaacgtaggaacgagagtatgctagagcgatgtctgaattattgagagtcgacataatcagtcagtacgtgcgtaaggatttgaacggaattatgaaggttaacattgtagagataatgttgatagcactcttcgtggcgcctcgcgtcgcaanaagtatgtgaagtataggactgcagttgatacatctggcaggagctacagagtcttcgagagctggatctttacgacaaccagatcaagaagattgagaatctggcaggacgctaacagatgctggagattctacgatattatcgtgtgttgaatctgctgagaaacatcgaaggggttgacaagttgacacgactgatgaaaacgtcgttcgtgtggtcaactaataaaatcaagtcaaattgagaacttaagcaacgttacagtcaactacagaatgctagagctgggatcttaaccgcttccgggcaatcgaccaatgtcgactaccttaaccaacctggagagttagatatgaggggaaaaacatagaattactaatacttcagaacctgtgatgcgcgtcaccgaagctgacagtcctcagtatgcagagcaaccggctgaccaagatcgagggtctgcagaacctggctgaaccatgtgggagctgtaccttaggcaccatgggatcgaggtcatccgagggcccgggagaacaataacaaactcacgatgtggacattgcatcacattcgaatcaacc

SEQ ID NO: 543309 - DNA, 1488 bp, Homo sapiens
ggcgagcggcccccttttttttttatttattcttttggcttaccttcttgcttaatgggaattggttaatggtctaagcacattagaaggccaaaaaaggagttttcccaaacccagcaaactcaaggtgctgtggattctgaacgtgccaaaagaaaactgcatttcccctcttaagtaaaacgaaagtgagttttctataggtaaagtgtatctcattaagcccccagaatttaacacaacaacacaaaaacaacaaaacaaacaacacaaaacacaacaacacacaacaacaaacaacaacaaacaaacaacaaaaaacaaaccaaacaaagagagagaggggcgcgcacagactgaaaaaaaattccacccgagagagaggagcagcccacaaaaagtaaaacgcaagccacacacgcaaagaaacaattatgtacaccagagggagggacacaaaataaaaagagcgagagaaaattatcttacaaaaaaaaaaagagcagcacgggccagcacgattacaaaaaaacgataaagaaaaaagagagaacaaaaagacgagaacacagaaggaacaactaccattcaacgtcaaaaaaaccaacaccacaccatagcgagagggcgggacacaataaaaagtggcagaacacgacaaacaaccaacacaaacaaaaaaacaaaaaaagcagaaatacgagcaaaaaaacacaacaaacacacactaaaaaacaatcatcaatcatatctcaaccaaacactaccaaaaaaaaatcaataaaacataaaacaaaaaaaaaaaaaaatcaacaccacaacaaaacaatattatcctcattaaacaacaaaaatattaccaacagaacccatcctaccttaaaaataaaaaaaccatacaaaaaaaaaaaacaaaccaaaacaatgacagaagaaggcgagacacagagatggaggacacaggatatacaagaaggagagagaagagagaaaagaaagcagaaaacaaaagtaagaagtcagatgagagaaagcgacgaacggcgaatggcaaaaagcgcacggcaacggatacagcgaaaaggcggaaatagacaaagacaaacaaggaaacaacaaatgtacgcgggaagaagaggcgaaaacaaaggcggaaagcgaagatagaagacaacgaatgaaacaagtagcaaagaagaaaaaaacaaacaaaataactataatgacacaacctactcacaaaaaaaaacaaacattacacgaacgagacacaccacaccaggcacctgaaccgacccacacaacgacaccacacaaccatgcaaaataacaaaataaacatcaactcagagatgaaacaaacaacacacagatcgatctaaattcacgcaaacaacaatacagatcgacaacttacaacaaaaaaacagaaaaacgctaacaataacaaaacacaaagacataattattattttatatacagccacg

SEQ ID NO: 543310 - DNA, 266 bp, Homo sapiens
tcactgcagctatctctcgcctcagcccctcaagtagctcggactacaggtgcatgccaccatgccaggctaattttttggtgttttttggtaggagacttgggtttgcccattgtgaaccaggctgggctcttaactcctggggcttaagggtatctgtcccgccttggcctcccaagggctggggatacagagtgtgagacaccccacactgcgcccaagcgtgagaatttcacactctcccatactctgcgcatacccctggg

SEQ ID NO: 543311 - DNA, 300 bp, Homo sapiens
cggagtagactgatctcagcatattcaagcatcccggttgtatccgagtcgctactagtgaaccagtctctcagtttctacctaacccaaatcactatttctttcaatacacaagtttttcgtactcaacacagttatactgtcattagttttatttctatttctttctttttttttttttttttttggaaagggattcccgttctgtagcccaggcggaatgtgcaggggcaaactctcagctccagtgcaaccttcggctccggggtaaaagcaatttctcctgtataagcctcccaa

SEQ ID NO: 543312 - DNA, 1045 bp, Homo sapiens
ttctacttgtttataattttagagctgggcaccaattgtccggtgacccctcttttgcctggggaatgtgcaaccagaaggcctcttgttttagacctggggatttttgtagttagggaaaacaggtagatggtttctctgcccaattgtgacacacggaaatttgaaaaaggagatattttgggagacccccacttgtgtctaaaagttaggtcaaccttttcgtttaagaggacccctgaagggcaccacttggtgtccacagacccgacgtaattttggggcgccttaaaatgtatgcctgttgggcgccatgaattgtagaatatggtaaattggaatttactcccccccccctagtagcgcattggttaaaacaaagcgggttacctcatttatgtatagcactgtgagtcctcagattatatctgaaagtaattgggactaaccagtatgctttgcccttatgtgtccaccagtttgaactacccgttaaaataagggatttgtagtatccgcttgttgagccaatgactttgaatctagttttccagtggatccagaacgccgccagttatttgagtgtatgaatggaatgatgatccctgtgctataaatgtcactgaacaccccccattattcccagaaatatttactacataatttctcccatctgtagtttctccagaagggctatggattagtttgaactgtccaataccttgcaaacattctgtgaccacccctgccccttttctgtctttaattaacccaggtgttaggtgtgactgtccaccactgttatagttttcccagtaaactagaagtcacgatatttgataaattataatttgtatttcacccaccccaatgtaatgttgattcctcccagaatgaaatgaaggcacctaccacttgaaatatgttttgtataaatttgtccactgttgaaccacgcacttttagccctggtaagttccctctagctatatgaattttggcatgtttcagagagatccagtaaataaaatattagataaaatta

SEQ ID NO: 543313 - DNA, 1361 bp, Homo sapiens
  misc_feature (1204)..(1204): n is a, c, g, or t
ggagcctgaggaagagggcggctgactggtggtggtgactgagcggagcccggtgcacaggatggctgggcacagattggtgctggtattaggagatctggcacatcccacaccggtgcaacagttgggccagctaaattccaaaaaacctccctggttgccaggaaaaaaattccaggcgacaatttcttcgtggcagccagggaaaacctttgggcacgcaaaaaggaggcagtttcatggacgtattcttcaaaggactcttgggcgtggggttgaatggttccaatattgtggtggacgaaggggaagaacttccggagtggaggaaaattctgggaactttagttcccaggaaagcagggacacaagggttgggttgaactctggtctggggaaaccaaggttttccaacaaacaattgtgggctcttggaaattccccaatgtggggaagccaattccaagaggtctaattctccccaattgggggggcacgcacttatgggggaccacaagctcttttaacgacgcacctgggttcggcaagggacgggcaaaatttttggaattgtgggacaccattctccctttaagttcgcttccggggtggaagcaaagcaacacaacgcgaagcacgcataacatttttctgggcacaggcgcaccattcgctcgggaaggaccaatttgcaagatcatgatgtttaaagtgagtatcgttaagccaatttttaacagttccaccaaaggtggggtttatccgtgggtgcccaacgctgcgtgtgggcggagccaaatttaggttcacatcgggggcctatggtgtgggggagaaaagacgcaaaaggaacgaatttgttaagtatttgccccacagttgcaacattcttgtggggtatgggttacggggaagtgcgggagaatattaagttagcacagaagggaaagatttatacattaagcagagggtaggggagggttaaccagccccatttagtatggtattgggttcaagttacacagggggcatatcaatgatttggtgggtgaggatgagtcaatatggacaagatgggttgcgaacacacagtggttatatggaaaaaccgcgagaaaagattgtccgtggacagagaatacgcaggacagaagtaaagtcctttttacaaagaagtgtacaccacggggggcatccagtatgntgtcgcttatgggacgagtaggaagattgatatgaagtggggggaatgataatagtgaaagatttcagcaaattgtggggttaccacgttggggtatgggagagacaattcaacagagtggttcataagttgtataaatgcactttttgtttcaagc

SEQ ID NO: 543314 - DNA, 1123 bp, Homo sapiens
ggggaccctgtacacgtatcctagaaaactggagggccttcaaggctactacatcgcatgctcagtacagcggggctcaggtccgcgatgctctaccgcaccaccaccacttaccatttaggccaaagccaaccgacacccctcgcattatactaccgacaaattatcctagccggcaacggtcccagacatattgagggtgactgactggatctctgtagtagtaatgacgagcaaccgccattcgcctactaatagtgagcacatgcacgagactgcaagggaagtacatccagaggcacgcaggccccaggtggatgcagatggagtagagctactgcatgataaccgacatatagtagcccaccagaccagctacctggcgatgatcccacacacatcgaggccatacatgcaaccagcaacaaaccagagccactgacgacatgcaacacgacggccgtgcaggcgccatcctagagcgctgcctggcatgctaaacctacgcacgaccgaaggaccataacatggctagggccgaaccgacgtgacaatagggactgaccaatcacacgaacagcacctgacaaccactgacagatgagactactactagcagacaggagtcacaaagaaagaccacaactacaacgcgggcaagggcccataccacaaaagtaaccaaagacacggacagagacagcacatccaacccgagacaaatgaaacacaagacccacaagagtacgcagagccatggacatagagacgcacacgcgcggaccaccccagcggaggtgaacgcaaccgactcggagcccccacgctgcaggcacaggccaccaaccgcaacgccacggggcacgaaacagacaccccacacaagccctaacagcacacgcggcaccaacccacaccagcgagccgaccacagcaaggagacgacgtgaacacaaccgggccgaccacacaacgaaaccgcccacagaaaagcgccccccacaggggacaatgacaacccctgacacaacgaggcagctgcccacaacacaccacgaggcggatccctggagccaccactgacaccaccagaagacgaccgcaacaaccggcgcccgccacg

SEQ ID NO: 543315 - DNA, 272 bp, Homo sapiens
cagatcatgggagtggattctaatggtttagcaccattccctcggtgatgtcctcatgatggtgagctatcatgagatctggttgtttgaaagcgtgttgcacctcccctgactccctctcttggtcccgcccctgccatgtaggacacctgctccacttcaccttttgccatgagtaaaagctccctgaggcctcccaagaagttgatgccctgtgcttcctgtacagctgcggaaccgtgagccaattaaacctcttatctttgtaaatt

SEQ ID NO: 543316 - DNA, 294 bp, Homo sapiens
  misc_feature (118)..(118): n is a, c, g, or t
  misc_feature (120)..(120): n is a, c, g, or t
  misc_feature (143)..(144): n is a, c, g, or t
  misc_feature (218)..(218): n is a, c, g, or t
gaatggagtgttctggttgaattatattaaattggaagtatgaaggtgaaaaaaattcagaagttaaatttcctttgaatgcaatttgaaaatatagccaataattccacttttattntntagtaagtttggacattatgatnnaattggtgtttcatgagagaacccctagtgtgcctgagacttactttgtgaagagaattttttaaaactttagntgtaagaggatgtaaatgactttggatgagagcaagctggatgagaactaagacttgtaaagagactttgtagatt

SEQ ID NO: 543317 - DNA, 263 bp, Homo sapiens
tcagggcctagttagagaacaggactctgagcagcctaattaaagttggtcaaggagtcttggtcacatagcactggcggtctccccaatataccaaacactttctctacatatgccagcataaagtgtatataagatacggtataaacaagcgctttcaggctggtatgtggtggctcatgcctgtaatttcagcaatttgggagacagagatagggtggctcgcttgagcccaagagtacgaaaccagcctgcacaacaga

SEQ ID NO: 543318 - DNA, 313 bp, Homo sapiens
gggggaggggggaaaaaaaaaaaaaggtgttcctgggggaaaaaggttctggataaaagttaccttccacccttggggggggggccctaaaaccaaaatcccggttttttttatagaaaattttttcgggtttaatcttttttttttaaccaggggctccttcttaaaaaaaggtttggcaaaaaaaaaaaaaagttggggcctttttattttttttaggggcggcaaaggccgggggaattttttaatttgcggttttggtaaaccacttggttaatagaaaagcagagaaattaatttccctccccttcca

SEQ ID NO: 543319 - DNA, 388 bp, Homo sapiens
  misc_feature (7)..(7): n is a, c, g, or t
  misc_feature (15)..(15): n is a, c, g, or t
  misc_feature (172)..(172): n is a, c, g, or t
  misc_feature (342)..(342): n is a, c, g, or t
gtatttnggtttttnctgagacagagtttcgctcttgttgctaaggctggagcgcaatggcgcaatctcggctcactgcaacctccatctcctgggtttaagcgattctcctgtctcagcctcctgagtagctgggattacagacgcatgccaccacacccagctaattttngtatttttagtagagacggggtttcatcatattggtcaggctggtctcaaactcctgacctcaggtgatccaccagtcttggtctcccaaagtgctgggattacaggtgtgagccactgggcccagcctggtcaatgtttttaatatttacccacataacacatatttgncacattctttgcagttttattctccattgtgttccaggccttcaat

SEQ ID NO: 543320 - DNA, 223 bp, Homo sapiens
atcctcacggtagtccaatagcagcaaccatgccatctggattcatagttttcaccaataaacaactggtagatttaagaaattagcaatgatgtgctagatatgttctgcaacccctgtcataaaaggttttaatctttctggtctctgtacttcaaattaccctttgattgatctccatgtaactctttgatgtacttcttgtacgcttctttccatattt

SEQ ID NO: 543321 - DNA, 162 bp, Homo sapiens
tctataagtacccagaccgtagcagcagtgggctctgacattaagctgacccccatctctgtaggtttatgccatatacctgtgttgctgttgagctgcccttagttgtaattttttttattttttctttttttaggaaagcgaaaacggcatcttcatcgg

SEQ ID NO: 543322 - DNA, 220 bp, Homo sapiens
cgactcatacaggatcccatggagagcaaggcccaggatgcggatcgctgtgctgagaaggcgggcttccatctcaaagctgacgaggatctggtcagcccctcatgctgcacattgcacatgtatctctattcctctccaaaatgcaccatcacaggtgaccacttctggtcagttccatatcctgcaggccttgctctccacaacctccgctagttcc

SEQ ID NO: 543323 - DNA, 235 bp, Homo sapiens
tccaggctgagcgcaggggccaatcatggctcagtccaacctcaacttcttgggttcaagcaatccttacatctcagcctcctgagtagctgggaccatatgtgcgcaccaccatgcctagctaattaaaaaaaatttttgtagggatagggtctcctatgttgcccaggctggtctcaaatgcctggcctcaagtgatccttgcaccttggcttcccaaagtgttggccgataa

SEQ ID NO: 543324 - DNA, 260 bp, Homo sapiens
  misc_feature (39)..(39): n is a, c, g, or t
  misc_feature (81)..(81): n is a, c, g, or t
  misc_feature (86)..(86): n is a, c, g, or t
  misc_feature (91)..(91): n is a, c, g, or t
  misc_feature (138)..(138): n is a, c, g, or t
aaggccttgtcagctcatcaacaggcaggccggactcangttatcccaccattatgagaacttctaggcccctgccggggnttctncccantgtccagttgagcagaggtttgagcccacacctcacctctgttcttnctatttctggctgcctcagcttctctgatttcccacctcccaaccttgttccaggtagccatagtcagtcaccatgtgtgggctcagggacccccaggaccagggatttgtctcagcctggg

SEQ ID NO: 543325 - DNA, 156 bp, Homo sapiens
acgttctcttctgattatgtatcataaaaaggtccactgtcttactatacacatgtatactttgttacattccatcactgtgaaaagttccctctgtgcccgctccctcaaaataagtttcagtctagcctccaaacttggaaagcggcgctcgct

SEQ ID NO: 543326 - DNA, 371 bp, Homo sapiens
cattagaaatgggcggatgggcaggattagctttatctacgacttacactcatggatttggaatttttccatgccacacattttattggggctaagtgactactttcttttctctctgtaaggaagtatatggaggctaacactgtatatcaacttgtttacatacccggaaagaggagagtgggggacccaggagagtggtgaattctcttttatcatggagcttagaaattaacaatttacacatgaaatatattccgatgcaaagtacctggagaacaccctaaagttcattcagaacaccttatgaggatgcctgtcttcaggagtgtacaccggaaagaggagagtgcgggccaggggagagtggg

SEQ ID NO: 543327 - DNA, 310 bp, Homo sapiens
cagagatgatgccactgcactccagcctgggcgacagagcaatgactccatctcaaaaaaaaaaaaaaaaaggttgttgaattcgggcagggcttttaagattccgggcccgggtgatttggaaactcgtgggcacccgggatagggcccttcataggcccggcaatttacccttcttccttccatttaagcacttgggcccatggtctcttaacattctcctttacccagtttttaacaggggccggtgtaaagagccttcacccagtgggaacaggtacaacctggccgggtggggggggactcctct

SEQ ID NO: 543328 - DNA, 254 bp, Homo sapiens
tgacttgaggcccatacttcactctttgaaacaagcagtcagcattctaagtaacgggtttctgttctgttggatgactttgaaattattctttgtttactgttggagttgtacaaatgttccttttaacagatgagttaatgatcttcatcatccaagtttatgaatgacactaatcacacatagagctcgatatatattttatgaataagagtcttgttattcacttaaattggtaattccattccatttat

SEQ ID NO: 543329 - DNA, 243 bp, Homo sapiens
aaatttttttttaaaaaaaaattttggccggggtgggtgggtttttccttttattcccccccctgtggggcccaaattggcgggtttcttttgggtccagcttttaaaaccccctttgcccccttttttaaaccccttttttttttaaaattccaaaaaatttttttttggttttttttttttttcctttttttcccccaaaaattttaatttaatttaaaatttaaaaccaaacaaaattta

SEQ ID NO: 543330 - DNA, 286 bp, Homo sapiens
tagagactaagcgcccatttatccataaaaaagataagcagacttttccccactgtactataaagttagagtttggggctgggtatggtagcttccgcctgtaatcccagcagtttgggaggctggagcgggcggatcacttgaggccaggagttcaagaccagcctggccaacgaggggaaaccccgtctctactaaaaatgcaaaaatcaagtcaggcgtggtggtgcagcctgtaatccctcccacggaggctgaggaatgagaatcacttgaacctgggagg

SEQ ID NO: 543331 - DNA, 1516 bp, Homo sapiens
ggaggagtgatcatggctacctcagagctgagctgcgaggtgtcggagcgagacactgtgagcgccgggacgcgccttctgggcacgacctggaaggactctgacaactgtcccacacagagcccgacggacgggctgactcccctgacctgacggacgcgacaacccaccacgacactgagaccctacccacacacgcacgcgggcacgccgcccacggccgctcggccgcaaccgcctcggaccctagcgcctggacgcgactcggccgcgactcgggggcccttcccatccgtgccccgggagagcgcgccatcgcccaccggacgaaacccaccaggacttggcaccctacacccaagacacgaggataaaaatcgtaccggcatgaccgcgccatagacagccaccccaccatgccccaagcccactcggggccaggacccacacccacatgcgccgcggcaagccgccgccagggacaacaaccacccccaatccccagcccatcacccagcgcacgccccgcaccgggccacacccgcggacaacacacgaacccacggcagaccctaggcgcacaccgcaggacctccggccccaccagcccaccagcgaccgcacggccagcgacagaagatcacgacgacaaagcccacgaccaaagccccccaccctggcgaccaccagccctaagcacacaccaaccagcaccccgcacacgcacaccccatcacgccacaaagggaacacaccgaaaccccacgaccaccgcacaacgacaaacaacacaaaagaccgaccccacacgacacgcacacacgccacaaccccggcgcccacccggccacacactgcgacagcacaccccgcgctacaggatacgcaccaggcccgccacgtacgaactgcggcaaccacccactcacaaatgggaataacacaagaaacaagcggcaaaagccgacacagtcaactctacgtacacaccagtgacaacaccgatacgcgcccccaaccaacaccacacacaccacggcgacaggacccaacaagccacaacccacaagccaaagccacaaccgcacaaccagcaagaacactctccatataaccacacataccctaaaaacacaacacgagaaaaccactaccacaacacaaccgaataactcaccactataccgtaagccttaaactgagctatcaaataaaaaattgataacaactcgccttatccccagcccgccagccagctccgcctacctcccctagcttctacgtcattacgtccgacctctacgtctcacattgcacttcatttcaatcctatctcatactaatcatcaacatgatactgacatctcaatctacataaaaaacactgacatcccaacccatcccctccatcatcactaccccccgccctacagcgccacactagccctccgcctccccctctccacaaaactcactcaccaaccactcccccactcccctctcacccctgtccttc

SEQ ID NO: 543332 - DNA, 291 bp, Homo sapiens
cctcaactcagcagattaccaacccgttagcatgaatagaaagtgcaccattcaataaaaatatcaccttgttctaaatcagggctaatctctgtcaagctgaattggggaaatctgtaaatctgagagtaaggataccttcctgctaaaaacacagaatgcatgttttaaaaaatcagtttacatatgtgacgcaaacaaaatggaaatattaaggaaataccaggaacagagggaatttcaaataagagtaggaaacaaacagactgacactctaattgcctatggaga

SEQ ID NO: 543333 - DNA, 212 bp, Homo sapiens
agtaccccgcagcatgcccatggccagaggggcgcctggcgctgtagcagtgatcctcccgcactatcacgtgcgtcacgccagtgacctgacgtagtggctggtcctgtagtagctgcgtgacatacgtgtgcctcgatgtgcacttggatgggcaccaccatcgtagtatgtcttgtgtacgtggctgtagaccgcgcaccagggtgtgg

SEQ ID NO: 543334 - DNA, 206 bp, Homo sapiens
ttccacacatgttcctattatcatcctaattcagctctgctggattgagctctggttaagtctgcaccctgttcaaaaaccagcagctgcaaaagccctcacagtagtcaaacatccttagcttgacatttgagggctctctggccagagcgcttaccatgctgcagacccttcctgcccatgatgccaccacaattcctgcagga

SEQ ID NO: 543335 - DNA, 355 bp, Homo sapiens
  misc_feature (350)..(350): n is a, c, g, or t
cggcacgaggccttcctgcacttcacaggaggcaaccatgagctctgtgtctcatctgcacctgggcacgtggtcatgttggataacccacgtggcaggaactaagggcacctctaggagctgaggtggtctctgaacaacaggaaattgaagccttcagtccaacaactgcaaagaactgaatcttgcccataagatgagtgagcttggaagtggatcttttctctggttaaagctcaatgcaaacttagccagccagacaccttgattagagcttggctgagacccaagcagaggactcagtgaaacatgcctgtgctctatttattatgtaagcattaaaaagctgntaaga

SEQ ID NO: 543336 - DNA, 180 bp, Homo sapiens
tggaccacacagccgggtagatccatcatggcggctcaggaactccttgaacagagcaagtttcctgaaatggcagactctgagcccacaaggaccaaagctgtacctagaggatacagcaccctgggcctcagctgtgcctttcctgcgagtgctgggtgtgcgcccccagcacatccc

SEQ ID NO: 543337 - DNA, 374 bp, Homo sapiens
attacagggaaagaatcccttatcccaaatgctgggggcccaaagggttttggatttcggatttttcttttttgggttttgggatcctcctaaatatataataagataatttgggggtctggcaagaaattcccttttgtttcatataccccttagacagggaggtttttccagggacgcctggattaaatggttcccttttgaaatccaggttatttcccggttgatgcggcaaaacccctggggtgaagggttttgggccattccttttgggggccattggactttggggtatatttttaagggggaaatggccccagcccaagggatgaaccttggtcgggctttcaataaaggctgcccgattttttcca

SEQ ID NO: 543338 - DNA, 420 bp, Homo sapiens
  misc_feature (2)..(2): n is a, c, g, or t
anggtactgttccaaacacctaaattaaattgtaattttgccacataggaaaataacaaaaacccttatttaccttattatattgtgaaccttccaggtttgtcctttatggcctgagagataaaacttgtgaaacatccttaataacctaagattatccttggccgacagcactttgggaggccgaggcgggaggattgcttgaggcccaggagttcaagatagtgagactctgtccctaggtggttatggtgatgtgcacctgtagtctcatctgctttggagttgaggctgcagtgaactatgatcgtgccactacactctaggctgggcgaaagagcaagaccacatcttaaagaaaagattatcctttttcagtacaaattggaagaaacatgattaaaataattattaagtgtt

SEQ ID NO: 543339 - DNA, 115 bp, Homo sapiens
cagaactactatgtctgtccaccatctgtgcagtaccactcctctgtgctgtccaactgtccagcctctgtgctgtccacctcctctgtgctgtccacctcctctgtgctgtcca

SEQ ID NO: 543340 - DNA, 241 bp, Homo sapiens
  misc_feature (230)..(230): n is a, c, g, or t
tcaataatcagagcgaacagagtcgtgaggctttgaatctcttagaaaaaagggaagacaggaagctccagaaacgaagagaccgaagggctgaaaagaagaagagggaggtggtggggacgggcgtctcccggttgaggagctccagctcttggattattttgttgcttgtggtccaccggtccgccgcagggtgtggccgtgaagattgagtcgccggtgcggggtgngtagagagcgg

SEQ ID NO: 543341 - DNA, 120 bp, Homo sapiens
atcgcgttttggctcctcgtgtggctcgtcggggagttgccattgccgcccggttctacggtattgacatctgggagccaagggaccacggtcaccactctcctcagcttccaccaaggg

SEQ ID NO: 543342 - DNA, 717 bp, Homo sapiens
  misc_feature (401)..(401): n is a, c, g, or t
  misc_feature (434)..(434): n is a, c, g, or t
  misc_feature (454)..(454): n is a, c, g, or t
  misc_feature (460)..(460): n is a, c, g, or t
  misc_feature (475)..(475): n is a, c, g, or t
  misc_feature (525)..(525): n is a, c, g, or t
  misc_feature (554)..(554): n is a, c, g, or t
  misc_feature (585)..(585): n is a, c, g, or t
  misc_feature (687)..(687): n is a, c, g, or t
  misc_feature (704)..(704): n is a, c, g, or t
aaaaactagagaactctcacctctctgaagtggttgtgtatgaaactgtttaaagccgaggatgcactcagtgacctcttcaggcaaccccagatttactcagtcagccatggcacacatgctagagaagtaaaaaaatgaattgagacttgttctgaaaactcttgagcaggggctcttaaaagttttttgtttaggaattatgtcagggttggggtctggagagcagataagtgttttgtgtgagaaaagtaaaaacttagttattttcttcccgtattcagtaatccttgcatttttttcctcctcctttatacatacatttttgccagttactgacttctctcttgtacacatttccgggttcctaaattaaccaagagtcctcagccaacaaggantccaattgacaaagccacaaggtctggaaggtnttgaagtaaggggcatttcntccccnatgaaatcagggcancagggggaagcggtttggggttgggccggaacaggaggagcaaaaggacnagagggccagaggaagaaagattgcaggntaagaaaacgggatggccacccctgagaagnggacaagcaaatttggggcttagagtagaattgaggaaaaacccagggcagaggccaggaatgctgtaggactgactgggaccatgattgatgtaagttganatgggttggttgatccntggaaggccaagg

SEQ ID NO: 543343 - DNA, 166 bp, Homo sapiens
tagagagcgtgttgcaatggacagttggcagcggctctagatgagccggagaagaggcctgcccttgggttgcggagtttccgctccgcaagatgctcccatgcgtccaatttgcacccgaaggcgttttcccgctcttccaagtggagctccttcaaggaaggct

SEQ ID NO: 543344 - DNA, 320 bp, Homo sapiens
gcgactctacacggatcccccccgagaagctgaggcgccccacagctcagagtccatatacgccagtgcacgttgggttattcttgcccatctgcaaaaagcacttcacttctgcctccaatctgtctcatcagaagtcactgtccacttgctccaacatcttctttccccctgcgaatcgccatgaccaccttggcatgctaccagctaagacctcattgcggcacgcggttgtcccgtccgcgttcctctccacatgatccacatactttcatcctctcacgaagcctcgtaattgggtcctattgctctcaatctcc

SEQ ID NO: 543345 - DNA, 207 bp, Homo sapiens
gtgggcgctggatgcaggattgtttgacgtccagagtttgagcacagcctcaggaaatagaccccaactctagcaaacatttaacaattagccaggcacgatggtgtgcacctgcggtcccagctacttgggaggctgaggtgggacagactcaccttgcgcctgacgacggtcacggcacgcagtgacgccgtgatcatgcccctg

SEQ ID NO: 543346 - DNA, 571 bp, Homo sapiens
aaggcccactgggaaatgtcagtgagggcacatgagaaaacactctaagaacctattcttccaaagatctttacagtatcttatgacaacacaggaaattatacccactccaactgcgaaagctgaaactactctgctttgtcacttacctacacttttgactttccaaatacatttctctcttcggatatgagctgcaaactccttatataaaggctccaactctgcagccctaattattctagttggcccaagaaaaatcctaattgttttatctaaggagacggaattttccaatactgaacaagcatgtgtgtgtgtttgctttaaagaagctgatttggtaataaaaaaaccctgaaggtcataaattcatgttaacacatccagtgtacatgaagttggcaccgagttaaaccatttggctactatatagcacggcaccttaaaaacctattttttttcccaaaaaattaaccttattcttctcccctgtaaaatcaaaacaccggtaaaaatgtgcccttcctccattttctgggaaatacctttctaacaaaaatatcctttt

SEQ ID NO: 543347 - DNA, 707 bp, Homo sapiens
cccgaattcggccattatggccggggattttgacgcacgccagtattaggcgatatctgatagaacaaagctctcatgagaactgagagcaggcgtgtgagcacggacagactagcttactctattctcggtctttaggaactaaacagtgattaagaattaatcctcgcccgtaactggcataatactaggttcaatagacgccgtcggactacgcattttcccagcgcagcaacacatccgctgactacccataacacgcaagcactcacttctttactgacctggcgagccccttccacgtacaactggacttcaaaggttaacctactatgcctacacgttctcccacagctcacctcggccaagtgtgctcttgcttagaatacacgccatccaagggccccatgatctcccattctatttagcgaacacgatctggcgcttctctactcctttgcagtccgtcgcgttttccttcttatacttcaaccattccccccgtcggccaacctgacaccacgacctggactaagtcctgtggaacacgggctcctcaagatccctcctttatcacactcgcctacctcctatgactcctctcttcaccagctacttaacttgcacagctttcactattctgtatagaccccttccgtctcaaccctcacatccttctgcagtcacctccttcgcccttctgctcc

SEQ ID NO: 543348 - DNA, 174 bp, Homo sapiens
  misc_feature (1)..(1): n is a, c, g, or t
nctattccagcaggactggccgttagctcctgtggggcgctggcttctgcttcggaattctgggatcttgagttccacacctgaacttcagaaggcctcacgtgttcccatttcacagatgaggacactgagggctcagaaatgtgcaggaacgtgtcctcagtcatgaagctg

SEQ ID NO: 543349 - DNA, 325 bp, Homo sapiens
  misc_feature (30)..(30): n is a, c, g, or t
  misc_feature (63)..(63): n is a, c, g, or t
  misc_feature (280)..(280): n is a, c, g, or t
  misc_feature (292)..(292): n is a, c, g, or t
  misc_feature (319)..(319): n is a, c, g, or t
tgaatatggggaatgacctgagagccacantcagttcctcaagggcagcccagcttggggctnacgcctgtaatcccagcactttgggagtccaaggcaggtgggtcagttgaggtcaggagtttgagaccagcctggccaacatggtgaaatttcatctgtactaaaaatacaaaacagccaggtgtggtggcacacacctaaagtcccagctacttgggaggttgaggctggaagatcacttgaacctgggaagcagagtttgcagtgagccaagatntcgccactgcantccaggctgggcgacagagtgagactntgtctc

SEQ ID NO: 543350 - DNA, 239 bp, Homo sapiens
tcattgcagccccttcattcccccagagttgcagctttaccagagtggagggtgagagcacaaaggcggggctctgtcttcaggaagaagagctttggcagaagcctgatgagagtttcaggttcacccccaggatagcccttccagaagcagaagggctgaggtggagaagctaggcttaccaagagtgtgtaagtactcggcttggatcaccgctctgtaccgctggtgaatcccgg

SEQ ID NO: 543351 - DNA, 217 bp, Homo sapiens
tgcaaagtgcactcttctatatctaccaataagctaaaactcacctgagttgtaaaaactccagttgacacaaaatagactacgaaatgtggtttaacatatctgaacacacattagctaagaacccaacggggattagataccccataatgtttagccctaaaacctcaacagttaaatcaacaaaaattgttcgcaagaaaactaacgaggccac

SEQ ID NO: 543352 - DNA, 571 bp, Homo sapiens
  misc_feature (320)..(320): n is a, c, g, or t
  misc_feature (359)..(359): n is a, c, g, or t
  misc_feature (377)..(377): n is a, c, g, or t
cttctccaggttcccaaaaatatcacccaggctcctgtattagtttcctatttctgctgtaacaaattgctacaagcttagtgatttaaagcaacacaaatacagcatcttacagttctacagactcaacaggggtctcactggctaaaatacaggtgttggcagagctgtgttccttctgggggtttttgggtgaatctatttccttcccttttctggcttctggaggccacctgcattgcttggttcatggccctgtgtgactctgacttctacttccattttgttgttgttgttacttcgtcccactctgactcacnctatctccccactttcaagttaaagtaagggccccttgntgacttacaacttggggncttccaattttaggaatttgaatggccaggggaattacaactccttccccccaattttccgaagcaattcctttacattcaacccaattccttaaccgcgaaaaggcttccccccttatatttccgggtttccaagttaaattcaaaggcaaatttaaaaccccaaaactttaattttccccaaaccaaggggg

SEQ ID NO: 543353 - DNA, 1013 bp, Homo sapiens
ggctcgaggaggcgagcaggttgggtgggaggcgagcggtggggcggggagaggggtgggagcggcggacccctgggtgagcggagagccggggtggacgtgtgggtggggggtaggaattccacggtgtggagggagggcgcgggcggaggcgcggtggagggctgggcggagaggggcggtagagagcgtggggcggggaaggggggccggcgggggtggtggggtgcgcgagaggagggggggggcggtttggagcggggagggagggagggtggaggaagcgagagggggacggggacggatgggagagcagggggagacggacgcgggggggaggtggaaggggaggagagtgggtccggggtggggggtgtgtggggcgcgggagtggcgggggagcacgcggcgggggtggagggggggggcggtggggtgttcggcgggggtggtgcgcgggggggtgtttgggaagagaggcggggggggggggtgggggcggggtgggcgcgcgtgggtggggggtgggtgggaccgctgggtggtgcgggggtgtggggcgtgtgtgtggtggggcaagtggtgtggtgtggtcggcgcgcggccgtgtggtggtgtggatggggcgtggggtgcgggctggcgcgggggtggggcgcgcgtgtgggctgggggggagcggaagaagagggtggtggttggttgcgtcagcagggtgaggtgagggggtgtggtggacaggcgccgctgtgggtaggcgagcgctgtgttgcagtagttgggatggtgcgcatggtggagggtgggccgcggggtatgcgttggtgtctggtggtggtgagcactctctctcgatggttggagggagagtgtatcacccttcctcggcttgatgaggaggtgcttactcgtactccgttttctcacttatgcagccccctgttgtgtgggggaggccgtgccggggtttgaaaatataaaaaaagggggggttaaaagccccacattgtaca

SEQ ID NO: 543354 - DNA, 185 bp, Homo sapiens
  misc_feature (79)..(79): n is a, c, g, or t
  misc_feature (91)..(91): n is a, c, g, or t
  misc_feature (129)..(129): n is a, c, g, or t
  misc_feature (155)..(155): n is a, c, g, or t
ttctaatcgattctttcaaagtgaagatcaaggtgcgccaggcctggagggaagcccaggctgagggtagcacctaaantgatcataactnacagcccctgtccaccctatgtggccccacatttgagntttagagatacaaccccccacccttntccggcatttttccctactcccaacccact

SEQ ID NO: 543355 - DNA, 808 bp, Homo sapiens
gacacagcagcctcctgaaaagtgcaggttccttctcaccttgaggaataatcctagaaaactcacaagatgtgtgaggcttaagtaggtaccgggaaactctgtgcctgcgcagtgaaaacttgtatgattagtagtgaaagaggtaggagtggggttgcgagcggaggaaagtggcgggcatggccgaacctaacatgatcatgagtgtagaatggggatgtgatcaccatgtgaagtgtggaaagtacctttagataatactgagatttcgttcatcagtgggccaggtaatggttgatagaatggtcgactgctagatgacgaggaaagtcaaggagcaccataacctgtagtagtgggggtgtcctggctgcatgtgcgagaagatgggatggaaaagatcatagcaccataagagagaaaaagcgagaggatgataaacgtggtggtggaatgcgtctagtgaaaggtgtcacttgcgaccgaggagtttatgaaagagcataagcacaagggtagcgtggagctggtacgtgaagttcgccattgaagtctaccaacgattctgtgggatatatcgttcaaaaagatatgtgttttccatgatttagcaagcaactaatttcatcccaagctgattttattcaatatggttacgtggttaaataaactttttgagatttaaaagacacaaggagattacgggaaaaaaaaaggggaaaaaatgggggggggggggcgaaaagttttaaaaactgtggggggggggggcaagaaatgaatgggaggggtggagaaagggaag

SEQ ID NO: 543356 - DNA, 842 bp, Homo sapiens
  misc_feature (196)..(196): n is a, c, g, or t
  misc_feature (327)..(327): n is a, c, g, or t
  misc_feature (336)..(336): n is a, c, g, or t
  misc_feature (380)..(380): n is a, c, g, or t
aataattaaaaagaatagtgggttctcctgggtaagggattccaggttgatgaaacagaacaagctttggctaatgagaggaagaagttacaaaaccgcagctcttgggtctacaaagaatcacgatgatgagagatggtggcagttggatattggatgagaccaaattggaaagacatggttttaattccaaagnaagaaaagagtaaagggatatgggctggctcctgggaaccatcaagtggttcctggctcccaactggcagggaaatggtggagaaaattagcaaattggctaagcagaattgggctccttagaaaatcaantggcccagnaaagaaactttggggcaatctgagagtctcagaggtatgaatgntgaatggccggcagaggccaaccaaatggccaatctcttaagaggggtgtggcaccacattctggagcttccaactgggtttctgggccaaaaaccacttggccagaacaaacttggctgtagaaaggatctcatgggcacaggctccaagttagtggtggccggttaggagagaaaccacggaagaaggagcagaccggggtgggtgtgacaggacatgagatccttttaaggaagatatgagaggaagaacttagaggatccagggagctttcccacaggaacgggtaaggtggaaaggtaacttctaagggaagctctggcggagaatccggggaatactccggaagccggcattacaatccgagggaacccattaccttccgtggaagaaaccccagggaaggggaggggggttcctggggcctggacaggcgcctgacaggggcgtgccagccgggg

SEQ ID NO: 543357 - DNA, 1246 bp, Homo sapiens
  misc_feature (16)..(16): n is a, c, g, or t
  misc_feature (232)..(232): n is a, c, g, or t
  misc_feature (294)..(294): n is a, c, g, or t
  misc_feature (382)..(382): n is a, c, g, or t
  misc_feature (821)..(821): n is a, c, g, or t
  misc_feature (873)..(873): n is a, c, g, or t
  misc_feature (954)..(954): n is a, c, g, or t
  misc_feature (1089)..(1089): n is a, c, g, or t
  misc_feature (1127)..(1127): n is a, c, g, or t
  misc_feature (1166)..(1166): n is a, c, g, or t
  misc_feature (1168)..(1168): n is a, c, g, or t
  misc_feature (1227)..(1227): n is a, c, g, or t
gagcggccccattttngttggtatccccaggaaatacaggacattaatggtcccgacgcaccccatatgccacgttattcgggggtctggaggtgtacgagagacggacggcatcgcgtggcgcacccactcacgccagcacatgtgagcgagccaaacaagcacccaccccacccaaagagagcgaggaacaagagcgacagagaatagcaacgagcacatacgaaacganaaagacttcattaaggaagataaagagcttaccctaggagtgaaagatatactatactaagntgaaaggaatagagcggagagagacacacacccccctcgcaactcacaacaggcacacggtggaagtggcctacaccgctcgacacanatggatatagagaataacaacgaattggcagtggctcgtaggaggagtgaggcggaggaacgatcgcgagagtaggactctactcagcgaatctcgacgccgcgatgccgcccactccactacctgccgcctaacgacatacgtcacgcacgacgatatcacgatatctgatggcgatactactacattatctaatattcgctatcgtctatatccttcttatattaatctttgtatcttctattgggttgttcattgtggtgtttgtgatgtgttaggaccattcgaatgaacgcggtatgtctctgcgtctcgaccagatacctctactcgcctctgctccaacaagacaagacagagagatcgcgacgcgcagtcggacacaaagctgacgggcagcgcctgcgtggacgcgcagacgcgtgacgccgtaccaccngacggtcacacacacatctgctctaccgcggctcttgcacgaagtagccgangtctcgcagcgcacaacgacatgactcttgttacaccactatacaacgtgatgtcactgacgtatccactctgataccctntctcgttctcaataatcgaacctgtagattgatacgcatccgcgccgtccacatctcttcatcagttacatactacacatgatatcgcgcgtgtcggcatactagtcgcagttcactgcagcaagagcagcatanctgcacggcgagatgacacatgctcgttcgtcggtgcntcttgtgtcgtattcgcgtaccagtgtgatgctctcttncnctctcaactgtcgtactgaacagcatcagcgccacacgtacctctcagagggacgtacncacacgtacaccgcgtgct

SEQ ID NO: 543358 - DNA, 150 bp, Homo sapiens
gtgtgctgaagaagaccactggccttgtgggattggctgtgtgcaatactcctacgagagctaagaatattgtacacaagattctgatgtcctgaggaatcctaaaatgcagcatatagaaggtatacagaccagatacaaatgagatgc

SEQ ID NO: 543359 - DNA, 174 bp, Homo sapiens
gtcaataaaggctctctcgggaggctgaggcaggagaatggcgtgaacccgggaggtggaggttgcagtgagccgagattgcgccactgcactccagcctgggcgacagagcgagactgtctcaaaaaaaaaaagaacggactgtacgggagatgtattagatacccaaggttt

SEQ ID NO: 543360 - DNA, 224 bp, Homo sapiens
tagaaatcctgtacttgttcatgcccaatttgtgtttcagaatgtagaactttattcagagcttaaatgaataattagcttacccctgagatgcttttattttcaataagaaaatatgaaaaaatgtgtaccaaccaatttaatgttatagaaaggaaccattcaaatttatgagttcatattccataatatatgtcatactattacaaactcaaagtacatct

SEQ ID NO: 543361 - DNA, 130 bp, Homo sapiens
cttttaaaggttttaaacctgcccaaaaattaccttgggatttaaagtttccctctgtctcctcctctaattaaacttgttatttgtcatgccccagcattggaaataataaaatttcttgttttgtgta

SEQ ID NO: 543362 - DNA, 308 bp, Homo sapiens
  misc_feature (205)..(205): n is a, c, g, or t
  misc_feature (235)..(235): n is a, c, g, or t
  misc_feature (261)..(261): n is a, c, g, or t
gggaagttaagtaacttgctccaggccagcctgctggtcattgatcaccctggtttcaaaccctgtttttagctccgagcttcctagttgggacttacttaatgtcacctgcattagaatgagttgtttacagtacagtctaggggcatcttatagtgatgagacactgcctttggaatatgcaagctaggtcagtctcgtctantacttattctacactttgagcagttactgnatctgtatacggagtgtgatagtagntctacattgtgagacaatgacaatgagtgtgatagtagctcctacat

SEQ ID NO: 543363 - DNA, 1337 bp, Homo sapiens
  misc_feature (217)..(217): n is a, c, g, or t
  misc_feature (284)..(284): n is a, c, g, or t
gaccataaacgtctccgccaaaacacatttatacccgcagatctcatagttatagcgcaagtgagtagatactcgaaacgctgtcgcaactacgattatatataccgtatatgcgaccatgatgcatgagaataaataaccaagtcgtactataccaaggactaaccccattagacctactgctatatacgagattgagcttggaacatgaactttngcatcgtgaagatgccgagatagcgtaacgaccccccctagagaggcgatgatcgcactctgacctnactgaacaggcttagagagcacgacgcccagatgtatgtccccctgattaccggcgaatctctataactgtgagcatgggcgaacaacatgcataactcgaatcccttggcagataccgtgcgtttggtacctagatcatccgaaatgcgttgggttcctacattgtcttgagataatgaaaccccatgagcacactcgctcgtgaaattcccctcgtatgtctcatacactcagaaaccttgtgtaggtcccacacttacgagaagcaagagtctctattgtcgggcactacgtacgaggccagaaagagttccctatgcctaacaaagcacgtaggttacaaaacttgattctttacccacgcggcccaactaaaggttatgtggggcctaaaaggaattgccccgaccccacacctagatgtgcagcgcgacactatgcaccgtggccaaggggtctttccggaattacccccacaacttattaaccccttgagaagaaacattccccccagagaacggagttcacttgagcattgggaaaagccttcgcgtatcgaacaatggcccaaattttgggcggaacccccaaccttccgtggattttcaacccccccttgaaattataagaaacagggaacagcctccacattcgggtttcacagagtttgattaacactggttaaagcccaattggtcaatcacccgccaagtttttccattctccatatccccggctccatttagaaggacccccgtgtccgtgttacccccgcacgtgttaaaccatattagtcccacccgttgtgtacatcctttcgggagcaaagattcacacccccaggctcccccgaatttacaattccttaattccgggaattctaagagaacccccaaagtgacgtatgcgtagcatagaagaactccttggatattacacaacacgcgattagccccttttccaactatcaaaaaagtgcgatccttagagccccacaactaagtaggtgttgtattcgtagaatgtacggaacaaggaaataacacacatat

SEQ ID NO: 543364 - DNA, 260 bp, Homo sapiens
cttaaggcactcatggatgaacacaatgcagctctccgaacagcaggatttcccaacggcaccttgggaaaaagacccagtggcagcttggcgaaaagacccagcgctccgctttagaagcaacgtgtatcacgccaactgagcatggccgctcgtgctcaacgcgtgggaccatcccaactagctccgccaatgtcacacagcgaagacaccctttggctgcaaacgcaccttctacacgcttccagcagcaactcacg

SEQ ID NO: 543365 - DNA, 987 bp, Homo sapiens
ggagctcagtgggcgggcagggggcgtggggaagtctgcatgccgagagtccagagaggaggaagctcctgccggtgagcgggctggaggaagtgagcagcggggtcctgcctcccggcctgtccccgaagaccccagaagaacccggaattgcttccaatacggaatccagggaccaccctttgcacgtcagtaggcctattgtttccctgcgtggacaggcggttgggcttgaggaagggcgatgggagccggagtacttgtacggaaccgtgctgcagctccccaaaaggggagttggagccccccaggggagggcaggagctcctcaaaaggaggaaagcgaagacaaataccttgccgacccaatttccgcggaaagggaccccaaactagttgtgaagcaccgtgccggacagggttgttgaaatggaaggtgcatcaaagggccacttcttctccccggaggccaccttggtggttcacgaagccgctggagggaggacattttcggacgggggttaatccctaacacagcgttattttcccagaaggctggggtgcgctcaaaagctgggaagcaggaggcaattcacgccccggacagacaagcaagaccagacagcaaacgtcacaggcgtgctgaagggccgtgacaccgggaggtctggcagcctcgacagagtgccggccaaaagtggagcgtaggagcagcatcttcaacaagggactgctgcaaccaggcgctcctggggggccggcaaagagctacaagcgaccagtccctccacacaagtcaggtggcgccaccaatcggcacccaagggccgagcccaaagggggcacagcaccgcaaccgacgaaccggcgaccccaaagacggtggaacaacaacaggccggaacgacccaacagagctagcgcaacagagcggcgggcagcaaaggccaggggagcaccggcgcacagagcgcgcgagaagacacc

SEQ ID NO: 543366 - DNA, 1554 bp, Homo sapiens
ctgaacctgtgtgctgctatgtgatgactttctgagactgatgatgcagactgaattttgtgctcacagcctgctcaagtgagtgtggatctgtgtgttttgtgccccgcaagcaccctgcatcactgccatgtcccatcattcactactgcctgtggagcggattgtaatatcaagcataccaacagacaccacgacgatgtgggtttgatagactttgaggtccatgcatatatggcttcaagtggttgtgggaaacttgtcatcagatgagaggttgggcaatctgagaggcatgctggatggcttggtgtgaccaccccaacggcataatcatggaggacaagaacccatatgatccatcatgggtgacatgactaggtgcaccttgacatactcccaacactgtatcgttctttgagcccgagtagtgggatatatataataatttgtggatgtggtatatggatggagggacatttaaatataatatagaagaaaagagagaaaaaaaggatacagtacaaaaagatatacagcgagaaagaggaaagaccacattcagaacatggagtataagtaggataacataagggtagctgacacggggaggacagcttaaactatcaccagtcaaagaccaacaccagcactagggctataggtgacaccggcacaacaggcgattgcgatgacacacctatgtcgcagctatccataaagctcaccctacgagagacgatgttggaccaccgacgggtcacgccgcaaagcgcagtaccagtccatgagcacaccaacaaaattggatagaggacaagctacaataggcattcgaacataatactagacacgtgtgcaagatatacgcaaggagatagcacaatattacgacaatagaaaataagttagcaccacaaggttgggtatctgaatgacacaaaccaaatatcagttcgacaacggcacactacctcttggtgcaccagagaggaaccaccaacaagctagccgcagggacacacgtatattacacaagaaaggcaggataaaaatatagacgaagataggtgagcaccgaacaacagaaagaccaaaccacaaacttcagagtaaacatgaccggcgacgtgtgcagcggatggagagaagacagaggacgagacactacgaagagcaagacaagaaagagacgaggcaagacgacaacacacacacgaccggggaggcgggcggcaaggacacaccaccgcaagccgccaacccaccataccaaaacaaagaaggatacacaagaccaccaacccacacgacagaatcgaagagaagaaagagcagcgaggaggagaagcaaccgacgaaatgagagggaagaatgagagagacacgaagaaggtgcagacacacaacagacgcgggaatgcacgagacgacgagagacgccgaaacgcggaaagcgagaggacagacgagtggaggcagtggcgagacacgccacgcagcaacaaaacaagaaagggacgcgcgggggcaagacgacaccggagacaacat

SEQ ID NO: 543367 - DNA, 217 bp, Homo sapiens
tccaaactgcccccgataacgctacgttagctgggccctgggccagaggcagaaaacggacggacgaaaaggagatgggtctcactctgtcacccagactggagtgcagtgagtggtgcgatcattgcttagtgtactccagtctgggtgacagagtgatcttctcgcctcaggctcctgagtagctggagctacaggtgtgagctacccagcatgg

SEQ ID NO: 543368 - DNA, 175 bp, Homo sapiens
taaaatagctttggaggtaaagggtgcatttcagcacagtgagcatggcctcctccagatgagtcgtgggtcacacacatgaagctgtcctcaatgctcttgatacgaagaaatgctcatattctccaaaacactctacagaagaatacagtgagataccgagcaaaatacgtaa

SEQ ID NO: 543369 - DNA, 445 bp, Homo sapiens
  misc_feature (27)..(27): n is a, c, g, or t
  misc_feature (172)..(172): n is a, c, g, or t
  misc_feature (348)..(348): n is a, c, g, or t
  misc_feature (409)..(409): n is a, c, g, or t
  misc_feature (420)..(420): n is a, c, g, or t
ccttcaaaaaatctgcctgacccctanctgctgctgctgctcactttaattcttgtaatggctttggtaggcatacttggagaacatatccccacattaggaattgatttaaacctgagagtttgagggctttaatcctttaaaacttggagaagctggctgggcgcggttntcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcagganaatggtgtgaacccgggaggcggagcttgcagtgagccaagatagtgccactgcacttcancctgggtgacngagtgagactctgtctcaaaaaaaa

SEQ ID NO: 543370 - DNA, 106 bp, Homo sapiens
ccagaaaaggcacttaacaaaatcataagttaatattccgtgtcttttcacacttttaacatatattgaacctgaggccaactaaaatttccatatgggtaccgag

SEQ ID NO: 543371 - DNA, 256 bp, Homo sapiens
atcgagctcggcaccctgtgtaggctgcagtgcaagctgtcagtagatctaccatctggggtctgaaggatggtggccctattctcacaggtccatgaggcagtgccccagtagggactctgtgtgtgggctccaactccacatttcttttctgcactgccctagcagaggttctccatgagagccccacccctgcagcaaacttctgcctgaatatccaggcgttttcatacatcctctgaaatattgacttctg

SEQ ID NO: 543372 - DNA, 1260 bp, Homo sapiens
taacatgtactagtataatttattctatgcttttaataaaataaataaagctttagaaaaaatgaaggtgtgatgggttccagcacaggagaggtgtccgggctgaggcattgcatttggtggaagacttcccatgtggggaggagagtgagaggagagctagagggccctgtgcctttcttcccctgtgtcatggaccaagcatttccacagtcttgcacttgttgccagaatagaagtgaagggtgtaaacatgtgggccctgtgcaggcttcctatagctctcgtgcttaacatgtggggcccccttatgaaacccatatagcttgtggtgtggccacctgtggcctgtggacctatggtgaggtggtgacagggggcccccccttgtgtttggcctcgtgggtctctctcacacaagagaggccagggtcgtgtttttgtgtccccccaccaaccccacacaaatttgtggtcccacactccacgggggtctctctctcccacaacatgagttgtggggggcggggaggaggaggagggtgtcccctctatcacgcgggtactagggacaaacaaaagtctgcgcccgtgagagagagacgaagcacaaaagcccccagcggtgaatgcaaaaaacaacaagagtgggcgcggaaacagttgtgtgggggtgcacacactgagcgcacatgtgtgaaaggagcccgtggggggaccaccaccccgggggggggcccaccacgcgaaaaatccccgcggagaattcaccaccataatttgttgttatgcgaatactaaggggggggcccccccgaacctcagctggagtaatacaacacacacactttccaaagaaaacccctgttgtgagtaggaggcaccccaaacacccaggaggaaatacccaccgggagtgaagcaacccaatcccagttggtcgagctggagttgaccccccacaactagcccgcccgagcaaaaatgggcgactgttggggggtggtctaccccccacttaataaacgggggcttccagatggtgcaccaaaaacaccgagctcgggtgggcataattcacacgcaaaagaaacaaagaaggagcccccaccacgaccagcgggagggggacaatccccccaggaaaaagaagagaggaaaaatactactcagccgtaccgacgagtgtagacaataacacggaagagagaacacaagaagacaagtagttgcaaaacagcggagcaggggagctgcccc

SEQ ID NO: 543373 - DNA, 315 bp, Homo sapiens
  misc_feature (140)..(140): n is a, c, g, or t
tttttttttgggggggggggggggggacatttttcccccgggacccccttttcccccttggccctttttggggccccctttaacccagttggggcaaaaaaaggggggggggggggggggggttttccggggtttttttncccccccggcgcccccaaaatttttttttaaagccccccccccttccccccggggttttttttttttttttttttttcccccccccccttttggggccccccccctttttaaaggctttgggggggggggttttttttttcccccccctaaaggggggggcccttttggggtgta

SEQ ID NO: 543374 - DNA, 149 bp, Homo sapiens
gtacatgacatctgccgtgtgccatgtgaggatccagcaaggaatgcccttatcacaccagatgtgggcaccattctgcttgagactttccagcctccagaactgtgagaaatacatttctgttctctgtaaaaaaaaaaaacagaaaa

SEQ ID NO: 543375 - DNA, 845 bp, Homo sapiens
agcgggagaagagcgtctagacccgtggagcagaggcggccatcgagacccaaccaaggcgtcggtcccctctggcggctcccagttgctcccaagctcgacagcaggcgcgcgtccccttcagctaggctcgcatcgcgtacggcgtcgtgcttacccactgctgtccgtgctgctgccactgggcggttgcgcgtctggcggcgctggacggcagatcgagaccggaccgtgcggtcaagggcacggtagccacgcctagatatgcacgcaattgcaagggataggagatacctgcgagatagccatggaagcagaacgttgccaagagatgaagtgtcttccccttccaagccctttaccgaaggcgaatgccattttttcctttgcctatgcaagacaaggcagacaaaggcgagtaaatttttgtgaaatcgtaacccaaacggggaacttggagcgtccctcgcggggctatataacccgagaaaagcgcacccgcgctaagtccttctaaccaggaattgtggcttagcggacttaatctagaggcgaattcgcttggccccccaaatggggttatacactttgtacactttgactagaccgcctagcgtacacgagtaatggcggaaccctcccgagacgcgtgagcccttggtgaaagcgggccatatagcggattaatgttccgccccccatttgttacacgcggagatatatcgcccaataggagacggaaacggcaaaagagacaactcgggaaacgggtggtaacgtttttacacacaggcttcgagcggcgcgctttcccgcgagccacaacactgtgaaaacatccccca

SEQ ID NO: 543376 - DNA, 201 bp, Homo sapiens
caggatccttccctggtatcccaccctagagagtacgatgtctggcatttgaggaagtaccactttaggccgggcacggtgctcacacctgtaatcccagcactttgggaggtcgaggcgggtggatcacctgaggtcgggagtttgagaccagcttgaccaacacagagaaaccccgtctctgggtggggataccagggg

SEQ ID NO: 543377 - DNA, 465 bp, Homo sapiens
taaaagataatcacccaccataagtataccaaactgctcttatcaactgcatactaagtgatatcaatagaagggtgaccgtataaaaatactgtagacaattgatagaataacaggttagagagagatatcccgaggcaattactaggatcatttgcaaaatgtgagactgtggatatttgaaatatcacagtaacaagatcatgcttgttcctacagtattgcgggccagacacttaagtgaaagcagaagtgtttgggtgactttcctacttaaaattttggtcatatcatttcaaaacatttgcatcttggctggctgcatatgctttcctattgagcccaaaccaaatcttagaatcacttcatttaaaatactgagcgggattgaatacttcgaagcagaacaggcaatgtgcagccctcatttatgagaaaaccctcaggaaactcccaggctgatgc

SEQ ID NO: 543378 - DNA, 467 bp, Homo sapiens
ttcatgccaatgctggttctggtcatgtatgacagcaggtgtatctcatagcagtattcactttcatgctgaacctcataatgcgtgtgatcagagagatcgagactcttcaggtcttctataccacagctctgggcaagtggcagggtggcgtcagtcacagggtgcagatgtgtgtggctcttgacacagagctcatcttccctcaagtcataaactcaagaggtatctgacgggtagaatggctgattagggtgtccatgaacctgtcagctagttagcttaaggtacactaatgaaagttaggagagctgaccagcatcccatctttccgatagagtattacatgacatctgtcagcagccttcttgacttcatgtcatacatgatgcctgacttaaggacagatgatctagtagcccagatgtatgctcagccgcttgcttcatgacagaccacgctcagtc

SEQ ID NO: 543379 - DNA, 710 bp, Homo sapiens
gtatttttggtagagacagggtttcaccatgttggtcaggctggtctcgaactcctgagcttgggtgatccgcccacctcggcctcccagggtgctgggattacaggtgtgagccactgtgcctggccttttttgtgtttttagtagagacggagtttcgccatgttggccgggctggtctcgaacccccgacctcaggtgatcacttcagcctcccaaggtgctgggattacaagcatgagccaccaagcctcgcatatccagtggcttttgatggctgaagtgcaagtcacaccccctctctgaattgcaccaggcctacaattcaccagatttgccaggctgggtggaaggatatgtaaatctgactcaattcacagcctctcttaacacttcaatcaaaattgcatctaattgaggttcattcataaacctcattgacgtaaacaactgcaaacatggaggagccctccccaaagcttgataattacttcacgatgaaaactcagctgtcagaacatcattgtggctatgacaactatgagagaagctggtttgcccaggttacccatgttaccagatgtcactggtgcttgagtgtcagcttcaaatgagcctcaggagcataatgagaaaaggcatgagaatatataaatgggtctgataagagaatgtctacatgactaaatattaaaactttaaacccccaa

SEQ ID NO: 543380 - DNA, 1050 bp, Homo sapiens
gcctcgtggccgattcggcacgatggcctgcaaactcgagcgtgcgcaggggcatgctgggagccacctgcggaaggtggtcctcccagtattggaccccgtacaggaagctccgggtgcccaggctgtggtgcacaggaccgcaggctgattgccgctcaggaggtggctcacactcatcgacaagagtgggcttggggactctgccctcgcctcgcccatgggcgcatggggccaaagcctgagactgaaggactgttggacctcagtcttcctggagcagaggaggagcaggaggccattgctggcgtcctccaacgagatgcccgcctgcgccagctggaggacggggcgggtcagcaagctccgggcctcagtggcagaccctgggcagctgaagatcctgacaggggactgggttccaggaagcacgctcccagcggcaccacaatgcccagttcggctctgaccttgtccgagcgtctatgcgcaggaagaagagcaccaggggagaccaggctccaggccacgacagggaggctgaggctgctgtgacagagacacggaagagggggccagagctcagggctcaacgagagactgaggcccgtcaggagcaggctcagggagactgagagcttcagcatcctgaggaggcgatccagtgccagtggcgatcctggacacaggacgagccacaaggtcatgcgccgacgagcgtagaccaggcccggagcacgagctaaaggaaaagcagcgcccaggaccagcaggccagaccaggacggtcccaaacggagacagggcaccagccccagggccgaaccaaacaccccggagccgcaccccagggacaaatacaaccagctagagccaaaatagaccggagacagggagacaggagctcagccacgagaagacaagaccaaacgggacagagagaaaagcaccaccagacggacaccagcacaggcactcagacaaccacccaaagcgacgaaaacacaaaagaccccacagcgaacgcccaagacaaacaaaggagccaca

SEQ ID NO: 543381 - DNA, 183 bp, Homo sapiens
tactcaggaggattgggatcacggaccctcatccattgagggctgaacgcaaagacccacgggggggggcacagtcggtgagcggtgaaggaagctggccatgtagatagccgagtagggggacagacacacacagaggaggcccacaagaaaggggagagaccacagtgagttgggcgcggg

SEQ ID NO: 543382 - DNA, 388 bp, Homo sapiens
ccacatagaggtgcataaagtgaaataacttgtgtcacgtggtttcacgttggtcattcctggcccaatcctttccccaatacttacagcttaatggccaacgttccttggaaaagttaggccctcaatttatagattcaataccagtggcccgagtatggcacaggaagtaaccaattatctgaatgcaaacttcttaagccttgggggaagacacttcaccttctccaatgcaaaggggcttgctgtgcttcacaggcaatgtgtgcttgcgcatttaatactctgtgcccgtgtgtgcacatttttctgtggaactctgtgttaagagtctctctgtgagttaagagagcctcacacctcgcgtgccatattcgtacagcccggg

SEQ ID NO: 543383 - DNA, 328 bp, Homo sapiens
ggaagatcctggtggtgatgactgagccaacacctaatgtggaaatgagaggacagcaagattgtgggtccagcctgtggtgtccacaatgccccaggcctctgagcaccgcctgggcctgtaccctgagagccaccttgttaatatccatgccccgatgtgggatccaatgctaccattttgcccaccagggccctgcagcaatggacgcgcatgaaacccatgcctctgtggccaagaccccaatgttactgaccctctgcgctccccgtgccatggtcttgcctagatgaactggctcaatgaaacgtggagcttgggactgggg

SEQ ID NO: 543384 - DNA, 271 bp, Homo sapiens
taaagacacagagttcttgctctgttgcctaggctggaatgcaatagcatgataatagctaactacagcctcaagcttctgggctgaagcgatcctcccacctcagcctcccaagcagctaggactacagacacatgccaccatgcctgcctaatttttaaattttttggtagaggtggggtctcactgtgttacccaggcttgtcttgaactcctagcctcaagtgatttttccaccttagcccccgcaaagcactgagattacaggtgt

SEQ ID NO: 543385 - DNA, 351 bp, Homo sapiens
  misc_feature (5)..(5): n is a, c, g, or t
  misc_feature (68)..(68): n is a, c, g, or t
  misc_feature (122)..(122): n is a, c, g, or t
  misc_feature (125)..(125): n is a, c, g, or t
  misc_feature (147)..(147): n is a, c, g, or t
  misc_feature (160)..(160): n is a, c, g, or t
  misc_feature (163)..(163): n is a, c, g, or t
  misc_feature (180)..(181): n is a, c, g, or t
  misc_feature (186)..(186): n is a, c, g, or t
  misc_feature (206)..(207): n is a, c, g, or t
  misc_feature (219)..(219): n is a, c, g, or t
  misc_feature (223)..(223): n is a, c, g, or t
  misc_feature (227)..(227): n is a, c, g, or t
  misc_feature (231)..(232): n is a, c, g, or t
  misc_feature (247)..(247): n is a, c, g, or t
  misc_feature (250)..(250): n is a, c, g, or t
  misc_feature (264)..(264): n is a, c, g, or t
  misc_feature (313)..(313): n is a, c, g, or t
  misc_feature (336)..(336): n is a, c, g, or t
ggggnatatactctgggggcatttgcggttcattttcagtcatcaaataacatacatcacttccaaancgtagcctcttgtgtgcagagaaattgccttcccacggcattcacaatgtaaanggnccttttggattaaagggtcagnctctttctatgtnacnaaaagtggaatgccagnnacagngggacttatttttgtgcagnnaaagcgtctggntgtntgcnaagnnttctccgccctcccngcnctttacatgctggnacctaactcaggtgctgggtcaccagcacgggggggcctctgataaggnaaactgtttaaagggtacctggnggctaaaagtcaggt

SEQ ID NO: 543386 - DNA, 113 bp, Homo sapiens
agaggatccgagtgtcgcctcatcattctatctgttgcggaatttaaaaagctagattgaacacctgatcttaacctcgagagccttaatcactattgttttggagagacact

SEQ ID NO: 543387 - DNA, 301 bp, Homo sapiens
cgttggggacgagccccaagttgagaacaagtaagtgaaccaattgttgtatgaaccacttgttacggaaacagctaatcataaacaacctgtggtgtacatatgtttttccctaaaaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 543388 - DNA, 270 bp, Homo sapiens
agggcccccccctttttcctttttcccccgtgggttaaaaaggggggttaaaaatcctttccctttttggggccccaaaaccccgccccctcccctggaggccccgaaatttattttttttggggggggcctgtgggggtccccggatttagtttttttggccccaagggcccctttggggtattgggggtttttttccactcccgggggtttcccctttttttagggggggcccgggggggcaaaaaaaatttttttggccccctggga

SEQ ID NO: 543389 - DNA, 169 bp, Homo sapiens
  misc_feature (13)..(13): n is a, c, g, or t
atgagacagctgngtactagtgagacctctctataaaattaaaactggccgcgtgtgggtgtgcttgtggtcaccgttatgtaggaggctgaggaaggaggattgcttcagccccggagtcgaggctgagtaagccgtgatcacccactgcatccaggctgggacagag

SEQ ID NO: 543390 - DNA, 151 bp, Homo sapiens
ctagctcggtaccctaactccattttaacttattacctcttaaagaccctaatatggtttggctctgtttccccatccaaatctcatgttgaattgtaattcccagtgttgaaggaggggcctggtaggaggtgattgaatcacggggggg

SEQ ID NO: 543391 - DNA, 144 bp, Homo sapiens
ttgatcccaatgcagcggaatcggaggcagtggcccaaggcatggcgcagcagacaatgagtgcatgtggtggctgctgcctgcaccagcctcagtggcagatgacacaccaccccccgatgctgtctggaacaatgacgcggt

SEQ ID NO: 543392 - DNA, 158 bp, Homo sapiens
tcgatgagacttttcatttttatttttctcttttattatcagcaggtcgaaaagaaccttgatcactttttatgattgccacttatgctttagtgccagatgcctttggagcaggtgcttggtgggatgtagctttttgacccttctgtcgtcttctc

SEQ ID NO: 543393 - DNA, 563 bp, Homo sapiens
gcttattgcatgtcttccaattaccggtctgcttagtggctaaggctgtcccctctcaccctagtttaagcaactaccggctgggactcaaaaagtatcaccaaaaaaagagttggagcaaaactacccatgtgtccctcaccttctgatttctcaaactgctccagcagactggacaggtccgatgcctcaattcctgtggaggcacacaacacaggattgaaaacgagcccctatcaacttagtacacaggtcccaggaagcccccaaatcatctcacttctccctttccactccccctgccctctgtactaagtgaaccaaggtagcagcacaaagcatgaaggattcaaaccaacccagggctctgcctctgaagaaccctccacagccaggtacggtggcacacacctgtgcctataaatcccagctacttggaaggctgaggtgggaggaccacttgagcccaggagttcaagtccagcctgggcaacacagtgagacctcatctcttaaaaacaaaaacaggccaagggcggtggcttgcacttgtaatcccagca

SEQ ID NO: 543394 - DNA, 991 bp, Homo sapiens
  misc_feature (336)..(336): n is a, c, g, or t
gaaaataaaaagaatccagcatcatcacgaaagaacctgtgcgtgaggggggaggagaaagcagtctctttctacaaaggcaatcacaacgaacttttgctgccaggatgcccttgacttgggctgaaagtgattctctgttgggcaagattgctggattatatgctgaggatgttaccactccaacccacaggatgctcgaggagagtcacagtcgacgtggtcgcccgagcgagttcggtcctgtgtcgactggcacgacctccgcaaaggatgtatcccaatctctacagtgtcagagcatggtaggaagagcggctacaagaaaagcactanttgtggataagcatatgcttgcagccttgaatgaaggagagccgtagtgtcaagcccatgcgctggttacccaaggcggcgcttcgtgaagcgcgatcagaaagcttcattgtgggcaaagtcggggagaacgggtatgtggagatagaggatgacattggaaggagggcagaaatgaatgaacttatggagcagacctcggagatcatcgacgtttgccgagtcaggaacagccaggaagacgcgtgcactatcgagatttccaacgaaggcagtgacctgtcagtggtggagcgtgcagaagtctggctctgcctaaaagtccccaaggccaacagggagcaggaccgaaagtcagcatccggctcttccagcagcagaagcacccgcagggcagcttggacacaggggaagaggccgaggaagtgggcttaaagggggagaggaagtgaacgtgtagctctctgacaaagtaagtaaaacgctccgggaaagaagcaccatgggatggtcttcgcctggtctccaagagcattccaaggggttgctgggaccagggccgaaaagtccctggacgttccggattgcctggtgaccaggtgccaggacaagttgcggcaaggtggttctcctgggcaagagaagaaggagaaag

SEQ ID NO: 543395 - DNA, 262 bp, Homo sapiens
cgccgttattaacctaatcgcaaagaagatagacagtgtactagaagagaggcgggtcaagaagtagtgaagaagcatactcagttcataggctatcccatcaccctttattttggagaaggacgagagaaggcaattaagtgatgatgaggcagcaggaagagaaaggtgagcaccgaagaggacgataaagatgatgacgaaaagcccaagatcgaagatgtgggtacagatgaggaggatgacagcgattagggttagt

SEQ ID NO: 543396 - DNA, 375 bp, Homo sapiens
ttagcagattcttactccttatttactagctagaattacaaaagcagatcagtgtatagttatgcatagcttaacgatgaggataccttctgagaaatgtgccattaggtgattcattgtgtgaacatgatagagtgtacttacacaaacctagatggtgtagcctgctatacacctaggttatatggtatagcctattgcttctaggctataaacctgtacagggcattactgtactgaatactgtaggcaactgcaacacaatgataagtattatatttgtgtaactaaacatatctaaatatagaaaagttacctttaaaatacagtattatcatcttatgggacaactatcgtatatgtgatccatcagtg

SEQ ID NO: 543397 - DNA, 198 bp, Homo sapiens
ccagggcacatagtatgctatgcatccatttgtcgtgtgacagcagtgaagtcagagtaacccgcgtcaggtccagagcctttgttttcctctgcggattcccttgggagcatttctgtggaggataaaactcgcacacggtgccttaaaataaatggctgtggggaatgcttgtgtacatcagctgcgtggcattcg

SEQ ID NO: 543398 - DNA, 967 bp, Homo sapiens
  misc_feature (31)..(31): n is a, c, g, or t
  misc_feature (86)..(86): n is a, c, g, or t
  misc_feature (101)..(101): n is a, c, g, or t
  misc_feature (117)..(117): n is a, c, g, or t
  misc_feature (147)..(147): n is a, c, g, or t
  misc_feature (150)..(150): n is a, c, g, or t
  misc_feature (220)..(220): n is a, c, g, or t
  misc_feature (231)..(231): n is a, c, g, or t
  misc_feature (287)..(287): n is a, c, g, or t
  misc_feature (289)..(289): n is a, c, g, or t
  misc_feature (292)..(292): n is a, c, g, or t
  misc_feature (296)..(296): n is a, c, g, or t
  misc_feature (299)..(299): n is a, c, g, or t
  misc_feature (320)..(320): n is a, c, g, or t
  misc_feature (349)..(349): n is a, c, g, or t
  misc_feature (354)..(354): n is a, c, g, or t
  misc_feature (409)..(409): n is a, c, g, or t
  misc_feature (451)..(451): n is a, c, g, or t
  misc_feature (463)..(463): n is a, c, g, or t
  misc_feature (477)..(477): n is a, c, g, or t
  misc_feature (481)..(481): n is a, c, g, or t
  misc_feature (502)..(502): n is a, c, g, or t
  misc_feature (506)..(506): n is a, c, g, or t
  misc_feature (510)..(510): n is a, c, g, or t
  misc_feature (522)..(522): n is a, c, g, or t
  misc_feature (524)..(524): n is a, c, g, or t
  misc_feature (531)..(531): n is a, c, g, or t
  misc_feature (535)..(535): n is a, c, g, or t
  misc_feature (542)..(542): n is a, c, g, or t
  misc_feature (579)..(579): n is a, c, g, or t
  misc_feature (591)..(591): n is a, c, g, or t
  misc_feature (598)..(598): n is a, c, g, or t
  misc_feature (677)..(677): n is a, c, g, or t
  misc_feature (704)..(704): n is a, c, g, or t
  misc_feature (723)..(723): n is a, c, g, or t
  misc_feature (742)..(742): n is a, c, g, or t
  misc_feature (767)..(767): n is a, c, g, or t
  misc_feature (774)..(774): n is a, c, g, or t
  misc_feature (781)..(781): n is a, c, g, or t
  misc_feature (785)..(785): n is a, c, g, or t
  misc_feature (790)..(790): n is a, c, g, or t
  misc_feature (833)..(833): n is a, c, g, or t
  misc_feature (877)..(877): n is a, c, g, or t
  misc_feature (888)..(888): n is a, c, g, or t
  misc_feature (906)..(906): n is a, c, g, or t
  misc_feature (936)..(936): n is a, c, g, or t
accacccagcacagggcaagacccagggccnggccaggcgagcgcacacaataagcggggcctgagccaggaggcaggcggggggnggggggagacaggcngaacggccaggccacngcaacagtgagagacccggggagcccctcngcnagctcagccaggaggaaggagagaccaaggcacagagcctgaaaaaagacatcctctcccggcctcccancccaaagcccnggccccgaggccagtgtagacagaaccaggaaagccaaaaacaaaaggcaccgagnangtnagtncanggggagaacgcaggcaggggngggaagcgcccacctccaaccccgggccngggcnacggggacagtgcgggcgccagcggcgtcaggacaccacccaccaggggcaggcngccagtgactagcacagggatggcagcggcctcacggagtangcgggccccacngtgagcgacagggngggngaggaggccctgggggggacnaggnggcnggaagagggggncncggcctnggcngagccangcgaggcatgtgagaggcagcggaagacgagggagcnggcactgcaggngtggggngggtggggcgccagaagcagggatgcggacccaccgggctctgggctgggggcactccagaggtccgggctggcctgcncttcgtccaggtggttccagttctgcnggtgttccaggcagcgganagggacctggtccagtgtnactgtgaagttctgtggggctgcgnggcctgnggatganaccnctgtnaggttagggcagaagacggcatagtcaaactggcagggctgcngccgcctcagcagggccgccgggtcccggtccccggtagcattnaagagcaagantcgaacctcggggccacngctcggcctctcgcggccctgcagcgcctngggggaaccagcgcacgcaggcctgcgcgct

SEQ ID NO: 543399 - DNA, 168 bp, Homo sapiens
agcaccaccaggtattaaggaattgcgacaataatgaaggcttcccacaagagaccaattacaagggtagcatgtacgctagcttgacttttgtgacaatcaaaatcacaaggacgaataaggaaagccaaaccttaattctgccaaggaaggctgtcaaaggctttt

SEQ ID NO: 543400 - DNA, 1492 bp, Homo sapiens
  misc_feature (243)..(243): n is a, c, g, or t
  misc_feature (253)..(253): n is a, c, g, or t
  misc_feature (505)..(505): n is a, c, g, or t
  misc_feature (606)..(606): n is a, c, g, or t
  misc_feature (831)..(831): n is a, c, g, or t
aaacaaagaatcaggctttattttggttatttggaatacaggttattgtattggtagacattctgtgttagtcttcattaatttcagtagtggccaacacacagaaatttaaaagtagaaacaaaagtgagggcacactttgcctccgtgtccttggcttgtggccccttccaaccttccaaaaagaactgtgtccttcccacattgtggtcattattcctttctccctgtgtccttacaganaaagaacaanaaacacaaatgtgatgtgcccacaaaggaaaaggttccacagagagggcctcttctctccacaggcaagtctcacgtggtgggaagtagaaagcaagagaacacactgtgtgttcacctgtgtggggttagaggaagtggcgacgacaagaccacaccagagggtcgtccaaatcaccccacagagagagtgccacacagagtgtgcgcgacagtgtggagaaaacgccacacccagagggtctcccaattnaccagcagcagggagatggccgccagcgtgtgtgtgtcgcacaaccgagtgtgtacgacgcctaaaaacctctgttgtgccaagtggggtgtgagacgaancaacactctcatcaccacacccagagtgggggagagacaccccgagagagacacttttattctctctttcacccgagtgtaaaatccctctctgagagtgtgtctcaacaagggccgcatatctcagagagttatcatgagggacgcgaagcccctgttgtagagaggcacaagagccccagggatgagggaaagagcccctgtgtgttccctcttctgtggggnggggagtttggctatagacttttccccaggagagagaaagggccccccaaggaggggcgcacccaggatatctttaccttcttccaagaaagatgaaggcggggggctctacaaacgccggcgggggcgacacaagaacgggcgggggggatactctccgatgataagagtaaagaggcccggtgtgctccacacacgaggtggcttcccacagaggcgggggaaacccctccaatacccgacctgtgtgtgtgccccaaaccctgtgtgtttttcccccccaaggaggagggacctttattaaacagtggttgtttggaacagtcatctccaccaaatcttggtagtaccccctttggagaggaaaactttggcctcttgggggaaaaaatttttgctctccaaaacaactcccaaactgtgtttaaacaacatggttggcgaacacacacgggggggaaaaacttctcgccagacaacaactaaacactaaagggggggtgcatcttttgacagaaagccgtgtctttctagggaagaacccagcctgtgtgacaaatttcttcaccaccatatatgtcagtgccaccgacggcgtgatcacaactgtgtcgttcttacactaacgcagcagacccacacgagcagcatgtgcgtcact

SEQ ID NO: 543401 - DNA, 168 bp, Homo sapiens
tacctctctcccacatgggcggcggtgctctcctctaggtgctgctcgcggtgctgtttctggtcacccggcggggtcagcatttgccgcgttccttttactttttttcccctttccttctgcgcatgcctgtgttgggttgcccgtgcgggtcatcctgccttgttg

SEQ ID NO: 543402 - DNA, 887 bp, Homo sapiens
  misc_feature (689)..(689): n is a, c, g, or t
  misc_feature (726)..(726): n is a, c, g, or t
  misc_feature (749)..(749): n is a, c, g, or t
acaataccaaaagaaccaaaacaacaagatacccacacaacaaaaaaacacaaccacactagaccacaaagacaaagaaaaaaccaaaaacaaaaagaagaaaaacgcacccccaagaaccagacccggagggcacgatccgcatcgtacaggcatagaggttctgcccgttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctcatgcagcacacagcttgccagcacagcatgcatcttcagcagttgttttctcaaggtgccatcccttgcgtcaggcaagctttcattcagacagccacaaatcaaagacagcactatgctggccttacaaagacagcaatttcgtcaacagcacatttaccaagctcagcaggaggttctgactaatcaagcacagcacgaccttcttggtggcaattctatctctcatgatcgattacctcatctggccctggtttgaacggctggaagcaatgaagttaaatgagtgtgtagancacactccaaaactgaaactgtggatggcagcatganggaagatcccacagtctcagccntgcttactagtgagaaagactggcaaggtttcctagagctctaattacagaacagccctaaggccaaaacataagggctctaaagggaacagagaacagcaataaagctaaaacagaaattttccatcactaaaaaaa

SEQ ID NO: 543403 - DNA, 318 bp, Homo sapiens
ctggccactttaggactgacactgatctcttatcctagtatcctcttatcatttctattgccacaagcgtaacctccgtcggagtcctgcttcattcattaatcatccaaccacctcaattatctatcaaccttgctatggtcgtccccttatgagcgggcgctgtgattattggcttacgcgtctaagattaatcattgccctagcccatgttcgttaccagcgaaggcacatcctactccccttatcccgcatactatttattatcgaaaccatcagcctactcattcaaccaatagccatggagtacatggggca

SEQ ID NO: 543404 - DNA, 577 bp, Homo sapiens
aaaacgtgggccctttttgacactcctgtgacctttaatcctttggcagcctccttatagatgcttgggcgctgttccaaccaaccgcatggttctgccgaacttatatagagtacaattgtgtgccccgcgatatttatgttcgctcataaccacatttctccgcgccatcgcaataaattaattactctcttgcaagcgcttcagttaactcctccctcccagtctccccgaatgtgtttccaatgccagaatttctcaccacgaactttatctcgaacaccagcatttcatcaaggacgccggagtggaaccctgtgagaaggtattgcctctcattatcccgtccaggacaagagttttcccacgatcccctggcgttgagggggaccaactcattgcagcctttcctctgaaagggaagatatttttgttggaattgttggagaaaaatcgggtgaagtatctggtctctcgaaaaaaggtctcacggcagctccgtttatagcgtgcggaactatccacgacggcgccacgggcattggtgccccacaagaagcacgtctcgtaagacgga

SEQ ID NO: 543405 - DNA, 1021 bp, Homo sapiens
  misc_feature (165)..(165): n is a, c, g, or t
  misc_feature (444)..(444): n is a, c, g, or t
  misc_feature (1006)..(1007): n is a, c, g, or t
cgatagaaacaccatcattctagggtttccaaatccacccaaaggtccagatggagcaagaatggtaccattccatttaacatggtatatccatgttggttacattcacagcaaatctttggacaacagggctgtgaacagagttccactctcaacattggaagnacattggatcctagacatattttccaattcatatccttctttaacattaatggagataagatggtagcattataggtggtaccataccaaggttggaccattcctggattccattccaacaatagattaccatcccctttggcttgggttttgggatggtcccagaagaacataaaatttaatacccattccataaccatagatattttccagataacaaagcaattcatagcagccaatggaaacaatccagacagatagggtccagagaagcccttnattaatcctccttaaattataccaccaccatattattaacccgtggcatattattcttccttaacagcaaaccaacattcttacaggtaatgcgttaatttcaacccaaatggcagcaacaacaactctctaatcacaaagtatatccagtttgccacttatcagaactaggaaagggtatatattcaacaaacataggttggtaagccacaaaaggtttgcttatactggactgagccgggtattcatctccttggaaggcacgcattcaattacggggcttataacagaatccatcggggaacttcttcattttcagttctggataattcccacagctgagacccacttccgaaatgggggagccaatattcgaagccacggtgaatatgcttccagttcttcccggttccaaacgtaaacgggtatccaacgtggaacgggcaaagtgatcccatcgatggttcgaaattatattgaaaggaactactaatgggcgcagagccttcctgacaacgcctgataggtttcgattttatttttattttttaataagattgcnnctcacgacgcgacc

SEQ ID NO: 543406 - DNA, 293 bp, Homo sapiens
tgagtgagcacagctcataatgagagggacacaaaaggtcccatgctgagagcagaagaagtaccctccatcggggaggcgtagaagtctctccaacaccaacagtaagagaaacatgcttggatgacgatttggtactcccatatcactgtctactgtattggctacagtaaccaactgtttgagaagaaaaggaatagagtacagggaaacgagagaaaaactctctccctgtcatactatatgtataggaatgtccatccttatgcccataataactccaaaaatacttg

SEQ ID NO: 543407 - DNA, 663 bp, Homo sapiens
gctaaacctagccctaaatccactccaacttactaccagataaccttagccaaaacatttacccaagataaagtataggcgtatagaaatagaatacctggcgcagtagatatagattaccgcgaagggaaagatgaacacttataaccaatgccataatatagtcaacggcatctaacccactatagccgtctctgtcagtacatgacattgatctaggaaagtaacgttgtgcaagggagagccaacaagtctaagacccccgtacaacacagcatcgagctacctatggaaccagctaaaagagcatacccgttctatgtacgcaaaatgagtcgggaagattctgataggtagaggagataaatctaccgtagcctggtgtatacgctggtttgtccatagatagaatcttagttcaacttctcaaatttgtcccacagaagccctctaacatcctcctgtgtaaattataactgttagtccaaagaggatacagctcttgtggacactcaggaaaaaacgctgtgtagagagagtacaaaaatctaaatacccatagtaggcctaatagcagctcaccaaattaggaaagcgttcaagctctaaatacccgatgtacctaaaaaaatcccaaaaatatgaactgaatctcctcatacc

SEQ ID NO: 543408 - DNA, 290 bp, Homo sapiens
taagagcaagagtgaacgagagagggagggagagagtgagagcgagcgagatctttggagagatttttttatgggcccccaacttctgtcttgaagccagacaatcgacttcagctctccctcccctccctctttctataagatcagctcccactcgctctcctagtccccttcccctcccctccaggaggaaagccccccgaaaccaacaaagatgagccgagagaaacaaacaaaacaaacacaccgggccaggatggagatcgacaaaactttgcaaaagcaaaaac

SEQ ID NO: 543409 - DNA, 561 bp, Homo sapiens
ggcggggcgcggtggctcacgcctgtaatcccagctctcagggaggctaagaggcgggaggatagcttgagcccaggagttcgagacctgcctgggcaatatagcgagacccctgttctccaacaaaaaaaaaaaaaaaaaaaaaaaaaaaaagttgtgtgtggggcggctgtgggcccgggaaaagttttttgaacccattggggcgggggggggggccccgtttgtgtttacaggtgcaccacgtgggcccaaagcgcggtgtccccaaaaggagagaacccggggccagcgagcaaaggcgcgggtgggcttctccccaatataaaaaaccgcccggggggacacacggggcgggtttctggtgacacaaaatctcccaagaggggaggtccaagagggcgccaaaacggggggctctataccaaacggggcgccacaaggagagcccgggaaattccaattaaccccccgcctgtgggggggggaaagcaaaaaaatcacaaaacgaaacaatcaacacaaaaaaacaacaaagacacaaaaacaagaagcaaagat

SEQ ID NO: 543410 - DNA, 930 bp, Homo sapiens
  misc_feature (696)..(696): n is a, c, g, or t
tgcccggttggcactcccgtctctgggggcatgagcttcaccactcgctccaccttctccaccgaatctaccggtccctgggctctgtccaggcgcccagtgtacggcgcccggctcggtcagcagcgcggcagtcgtctatgcaggcgctgggtggctctggttgcccggtatctcctggtgtcccgctccaccagcttcagtgggcggcgagtggaggtccgggggctcgtgtgccaccggagtatagtccggggggttctggcaggaatgggaggcatctcagaacgaggaaggagaccatgcataagcctgaacgacctgtgctggctcgtcttaacctggacagagtgaggagcctggagaccgagaatccggaggctggatgagtcatataatcgctgtggagctagcttgtgtagaagaacgggagccctcatgatcaggagacgtggcagcccatatacttcgaagagtcatcgtagggacctgagggactcaaatctgtcgcaagatacctgtggaccaatgcccgtatctgttctgcagattgacaatgcccggtcttgctgctgatgactttagaagtcagagtatgatgacagagcctggacatgtcgaccactcatgtggagtaacgacagtccatggagctccgactaaggtcattgatgacaccagatatcacaacgactngcagctggagacagagatcgaggctctcaaggaggagcttgctcttcatgaagaagaaccacgaaagaggaagtaagaaggcctacaagcccagatttgccagctctggggttgaccgtggaggtagaatgcccccaaaatctcaggactcgccaaagatcatggcagacatcgggcccaatatgatgagtggtcggaaaaccgagaggagctaaacagtactgtctcagcaat

SEQ ID NO: 543411 - DNA, 1026 bp, Homo sapiens
  misc_feature (1025)..(1026): n is a, c, g, or t
acatcacgggttctcgaatgcggcccttcagactggtgcagttcatcatcatggagacccgcaagaacagatggcacttggcccagcgcacagctgcatgtcatgaacaacaacatgtcggaagaagatgaggacttcaagggtcagccaggcatctgtgggctcaccaatctgggcaacaacgtgcttcatgaactcggcccttgctattgcctccacaattgtgcctacagctcacctgagatacattccttcaacaatagcatgctacctggaggagcttcaaggttccgacaagccattgggcatgaagggtgagatcgtcagaggccatatgcagacctggtgaagagctagagcgtgagtctggccaccaccgtccattgtgccacatgtgttcaagaacagaggttggccatttagcatcccaatttctgggctaccaacagaatgagtctcaggagctgctgtcattcctcctggacggggctgcatgaagaccttaatcgcggtgaagaagaacggagtatgtggagctgtgcgatgctgctgggtgatccggatcagtgcatgtgtggcacatgatggcgaatggctaaaagcacaaacgggggaacgatatctgtgatcgtggaacactttccacggctcttcaagtccacgctgatgtgccccgattagaggaagtgtatcttgtgaccgttcgaccccttttgttactctgtgttccctggctatcacccacatgagggtcttggaggtctcttttcccatggtccgcgctcagccgagcgctcgtctggtcccgaaggcaaaaccggtcattgtgggccggccaccaacgtcttccctaaaagagaagtgttggtctcgtccgtctttatttcgctttagaggctacgttgggccgggattccataggtggcaggccggccagaccgggctttcgggccgctcgggacttccggttcaccccttggcgcgcgaggagttctcccccaggcgagctccgcgtaccctactcnn

SEQ ID NO: 543412 - DNA, 371 bp, Homo sapiens
aaaatatcataggcacctcaaaggcgtgtacaactgttgaggtgacatttttgagaggaagagaaagccggccagagcattaagacagataaaatgagaaacacagaggccagtgttaggtggagaactccgctgcttcagaaagagaatagcagcgctcgcttaccgtgggaacacggccaggtaacaaaaggggggttggttttttgtgttgttttgttttaccatgtggtaataagatagttgacataagtggtcagaacttcgctgaatttgtgatgaagcgagttgttaagcgtgtaaaagtccgaatgaagagtcgtgaagaaagacaggtatggcgatgagcctagacattgttcaaaaaaaga

SEQ ID NO: 543413 - DNA, 115 bp, Homo sapiens
ttcccgggttcaggtgatcctcccgcatcagccttcctagtagctgggactacaagcgtgcctcaccatacctggctaagtgtagtatgtaaggtagagacaaggtagagccgag

SEQ ID NO: 543414 - DNA, 188 bp, Homo sapiens
tgtataaaatgttgagatagccatctcatgggcttattatggtctagtggctcctggtgctataagtagcagaagtgagtaactgcaacagaggcagtatggcctgctaaactgcaaggcccagaaaaaattggctgaccttggcttcagagaaataaaatgactatgaataaaatatattctatgtg

SEQ ID NO: 543415 - DNA, 598 bp, Homo sapiens
acacttacgacttctagtgtagtccacatctggagcatatgtcatgcatacgctggggatgctactgtgtgctgaacattatatttaagaaatgtctttgatcccatgtgtatggaccccatctattccctgtctccttgtttcctaagtgctgatagcatcatcattgttctactactgctgtgataataatgaaatgtttccatttttacatattctttgctttattcactcctgtggtgtgtagggacattatacatgtggttgcccagtgccatgaggaaggattggagagccacttgaggtcatatgttaaggtatgtaaaacacactgttctgatcacttacatctgtggctctccagttttccttctaaggacttattttttcacaagcctggttatttgaggatgtgcctgtcacgtatgctttctcttctatttctcatagccaatgcttgtacctcaatagggcaggtacgaagagggacagccattcactaatttactttattccattccttcaattatgtttctttgaatgggtttcccatataatatgactcaatgtggaagtttaaagaagaatttaagttgtt

SEQ ID NO: 543416 - DNA, 656 bp, Homo sapiens
ggcatgatcgagactcggtactgatggagtgctggttgagaaaaaggaagatatacattgttagtgggcatgtaaattacttcaaccattgcggaagatggtgtggtgattcttcaaaggcctaaagacagaaataccaatgggatggacccagcaattccattactggttatataccccagggaatataaaccattctattataaagacacatggatgtgtatgttcactgtagcactattcacaatagtaaagacatggaatcaacttaactgcctatcaatgatggattggataaagaaaatgtagtacatacacaccatggaatactatgcagccataaaaaggaacaagttcatgctctttgcagggacatggatgtagctggaggccattatccttagcaaactaacacaggaacagaaaaccaaacaccacatgttctctcttaaaagtgaaagctaaatgatgagaactcatggacacatgagaggggaacaacacacactgggacctagttgagagtggaggttaggaggagggagaggattgggaaaaataactaatgggtactaagcttaatacctgggtgatgaaacaatcggtgcaacaaacccacatgacacaagtttaactatgcaacaagcactccaaca

SEQ ID NO: 543417 - DNA, 155 bp, Homo sapiens
  misc_feature (31)..(31): n is a, c, g, or t
  misc_feature (55)..(55): n is a, c, g, or t
agtggacactgggcttgaacatcctacgggnggctctgaatggcttctgtcagancacaaaccgttgacccaggatatgtccactcataaggccattcagactgagaaagacctgcagatacaaacggtctgtgaaacaattcacaatctggttg

SEQ ID NO: 543418 - DNA, 365 bp, Homo sapiens
  misc_feature (133)..(133): n is a, c, g, or t
cccacctctttcatccacataccttatccattcccaacaaagtttagcctacatggaaggtgtttaggcaaaggtgggccgccttttccccttgtccttatttaccgaccccgccgggcatttaacacccacntggacttcagcagagtggttcggggcgaaccagccatgggccggtcacccaccagtcccgggttgggttttccggtccggtccacgggaaagcaggcctccagttggaaaggccaggcctggagcttgccttttcagtatttgcggcagtttcagttttttgtttttttttttttaatcacaaaacaatttttttaaaaaaaaagctttgaaaatggatggtttgggtatta

SEQ ID NO: 543419 - DNA, 1161 bp, Homo sapiens
taaaaataaatcatggccttaatttgggagtaacacaaaaagaccctacataacttcacattttagaaacttaggttgggtgtacattaacaatactgaattttgtgagaaagtataagcgtgtcaagctagctattgtctaaatacggaaatagaatatttatacacatagtggtttaaaccttatacacatgtggccctcaacaacgtgagaggacacatttataattttgcgtctctcaaatatacccaacggttagtgttattatagcaaactctaatctccgtgggttctcgtgctccacagaagacaggaaaatctccatttcttataagccattctagtgtgtgtgaaggtgggtcatcttaacacaaagtggtatacattatattattctatacacgtgagtgtgattgtgagtgaagtgggtggaggtctcaaggggcaggaacaaagcgaagtgaactcataaactggcgcttggatccaaacgaggctatcctagagaactatggttctcaatgtcctggcgcgcaaaatattctctggataaatacctataaagtggggtataaaggggcgaaactttctatgcgcgaacccaatatgaactatgcgaatattacacatcagataacctctttaacacaagaggctaacaaagtcgtacttttaccccccgcgaaaaaagcacaacgagaagaacggacactatcgaactacagtgttaccatcacaacacgtgggagatcactgatccagtgcacaacacaaggcactactgtgtagggatacaatactcaaacatccaacgcaatcattagacgaagcaaacattttataaccttcttggggggatacgcgtaaatactgcacgaatcattaatgggaagttagggtccatcacagggtattactggcaaatctgacatgggttaccagggtacgatgggcccgaacatctcagacctcagaagcaggtctagggtaacccactcctagggaagcactgggcaacatccagccccggggacaatccggaagtcgataacaagagcctgaaggaactagaacgcaccggaaaagccgcagaagaagcactacggcgaccacacaaacacagcaactaccaggcaaacagcgaacacacacccagataa

SEQ ID NO: 543420 - DNA, 200 bp, Homo sapiens
gcgcgagctgcgtgggtgcctgtagtcccagctactcgggaggctgaggcaggagaatggcgtgaacccgggaggcagagcttgcagtgagccgagatcacgccactgcactctaacctgggcgacaaagtgagactctgtctcaaaaaaaaaaagagcttcggcttcacctgaagtcaccagcagctcgcccctgagtt

SEQ ID NO: 543421 - DNA, 156 bp, Homo sapiens
gtggggtctcccctcccagtttggtcttcagctcattgtgtgtcagatatgttcaaagccactttcgtagtctcattttgtgtcacctggagttttttacaccctcaggtgagttttagctttattggggagggggtgatctagcggtgagggcgt

SEQ ID NO: 543422 - DNA, 406 bp, Homo sapiens
tggccccgggatatgagaaatatgccctggggattccgggaccggcctcaaccaactttttccgggggatttggggtggatttgggcaagaaaccctaatctccctccaaaaacggtgggctctttaaaaaatttcctggcttttaatacccttggtgtcaagaaaatgggggtcccagcccaggtgaatggccccaagctttggtaaccgggttttacagggggggggccccccccccaggtttttttgggttgggtttcccctccccccccccccccttaaaggcaaaccattcacccccgccaaagggggttgccctaaacagggacccatgccctcccctgttcccttgctagcggcaaaataaacttgttgttgccctggggggctcccggtggtttccca

SEQ ID NO: 543423 - DNA, 150 bp, Homo sapiens
gaaagttacaatagcacattgctgcctggggctacatctgggactgaatagcagcaatatggccctaggggactgtggataatgccactcatgctctatactctagatctcttccagagatcgagtatagcaagatcactatctataata

SEQ ID NO: 543424 - DNA, 434 bp, Homo sapiens
ccaccccctccaccctcccaggttttttttgcaccaaggacggcctccaggttcagcacgggccccctcagcaaccccgcagacgcaaggcaacccttgatggacgccatccgctccggcacaggggctgcgagactgaaaaaggtgcccttgcttgtgtgaatgaacagaggccagagaattgcagaaacccccctgtaatatgcccccaggggtccctcaaggaggtttgcaaagccaggaacatcaagttttggggttacttttttgtttacaggccaaaatgggcccagttgattttcggtgtgttcctgtataacggcttgaaaggaaaggagaaaatgctgggtcgctgcgcagctcgtgtgccaaggaaatgtgttttgcctttgaaaattttaagttgctaataaacgatttttgttggcgggtta

SEQ ID NO: 543425 - DNA, 422 bp, Homo sapiens
acttagaggaccctttctggtatcccacccctgcaagctttcatgtttttctatacttcaaggaatacatctttggcactgaactttctttatagtagaaaaggaagataatgggtaagtgtccttgttcattgctttggatcctcagacatgggtttcgcaactcaccagagttggcaaacaaaaatgtgagggcctggttgactctaacatactcctaacaattatcttacggtggagaggactaaatcctcacccagagcaaaaaacaaaaaacagcccaacagtaacacatggcaaacacaactggtaggatgttcccgtttgagaagggataccacggattcacctcacagattcctcctgtcctctactggcgtgtccgctacccagggcgggcaccgagcctcgaaacatcgtaa

SEQ ID NO: 543426 - DNA, 277 bp, Homo sapiens
  misc_feature (255)..(255): n is a, c, g, or t
cctgtatgctgggattatcgaaaggactacacgaggcagacaagtggcacccactcacagaatcagtgtgtgttattcacgatgtagccagcagttgagcctaaggaccttctacctacctggtattggcatttgaggtcggaaaccctctactggcccataagccaggaccagtgaatagagaacacagttccttgaagaactggcagcaaggcttgaggccttatgtatgtagctgagtcagtcaggtacatnatgctgtctgctatcaacagga

SEQ ID NO: 543427 - DNA, 901 bp, Homo sapiens
gcgcgctgtctctcatgagtaatgccatgtaattatggaaggtccacgtgggcggatcatcctgatcgtcggcatgatgtagcaggaccttggttacacagggtgcaatgccctgttcacttacctaaatagtagcagaaatacttaggcatgatgctggtgagcgagttgcatgggaaatcttacagacgtgacatatggagacggctcgagtacaagcgtcgaaatctgcgttgtaactcgccagggaagggtgagagaggttgcagtgaggcccacgaatccgcggaccatttgcctgtccgaacctcgtggctaaacgtacagctgatatgctgtcgtccaaaaagaaaaccccgaacagaagcaatcttccgagaaacagaggacatagcaaagtatatcagtgccgggtgatatcaccgtgcagcacgtttcccaatgatccaggtcttatgtcgtgtaacatctagtgccttcatcctaattgctgtttcctcattagcgctcagaagtccgtctaagacgaagacgacagtctcaatctttggaacacgtacataagtatgggatgaggcgccttggatgcttaatcaagattatcatatttcccgatgggtgaaaagaaaaatagaggtgaaaatcaaaaggagatatttcaggtcaccctcagtcaggtctaaatactttgttatgctgtaggtgtgtaccgttgtccaatccactgggggaagtatattctaccaatacctcactttaagatcagggaccaactcatgctatgtaacggaacccatttactttccatggggtctaaccctggtttttgggagcagactgtcagaaagttcccgcggtctagttgtaggacaaagacagttcccgtagagcttaaagagcc

SEQ ID NO: 543428 - DNA, 170 bp, Homo sapiens
cgaatactttgtctgtggctacaagaacgttatgggggccgccgcactatctggagggtcctcagtcgcattgagcagaagacatctgccgtacgggaatgagaagaagattgagatggtccgtgcgtaccgggagaagatagagcatgagttggacgctgtgtgccacg

SEQ ID NO: 543429 - DNA, 139 bp, Homo sapiens
cagacacacacacatacacacacacacacctacgctctgcacataatttgtgtgaagtcatatgacagattctataggaattgataagcatttgcttgtgacaaatagtactggtttgactgaatctgcctgtcgacgc

SEQ ID NO: 543430 - DNA, 135 bp, Homo sapiens
cccgactacccgacagcatgagggagatggggtaggtggagttgagggagatggggtagtgtggagttgagggaactgggcagtgacacagtcacattctgtctgggctagtctgggggggtacctgagctcgaa

SEQ ID NO: 543431 - DNA, 137 bp, Homo sapiens
  misc_feature (38)..(38): n is a, c, g, or t
ctcccaacgaatgaggaattgagggctgcaattgcaanatgcttaggagaaaaatggtctcaccctccatcatgcataaaaacagattgtctcagtttaccttagctttgaaaatgccatacccatgggagcaattt

SEQ ID NO: 543432 - DNA, 318 bp, Homo sapiens
  misc_feature (86)..(86): n is a, c, g, or t
  misc_feature (151)..(151): n is a, c, g, or t
  misc_feature (293)..(293): n is a, c, g, or t
  misc_feature (317)..(317): n is a, c, g, or t
gttctatcaagttacttgccttgatatcatcacatgctttgctgtctgcttaaaatatgagttcatccccctcatacttatttgtnttagggacccaattggaccagtgctggcacatgcccttcaaggtacaatttctgaaaagagactncgctgccaaacttatgtgtgcctttacctcagtccccccagtataaggggtgacttaatcttgataaatgagtgactgagcaccatgctagttaaatattgagaattaaaagcctgaacccaatggctctattttttttttnccaccttctgacaagcaaaaattnt

SEQ ID NO: 543433 - DNA, 337 bp, Homo sapiens
ctttctaactagttctgtgacgttgaatttattgtaccagttgtgcattttccgaggcaagaagtagtcagggtcaattaatcctggctttttctgcacaaaatacaaccagccttgttgttagaggtaacctaacaagtggtaatagctttaatcttgtttacacgaggtttctctgtagtattggtgatagcggaattagttgaagaggctgggtattttgttatcaacttcgattagaagggatccctgcatcacatatttaaagtgtgtcctcccaccacaaagggatccgtgcacgttaacgattactaggactatgcagaaacctcgtgta

SEQ ID NO: 543434 - DNA, 377 bp, Homo sapiens
tatttttatcctcagggaagggtagggaaaaggagaggctgataaggagggaagtgctggaacttgattttctccctccctagcaagatacacggattccatttagagataggctggcctcaatttgtcaagcttcagcgcctcagcacaaaatcttacacccttcatcctgccggaggaggctgagaagaggaagaggggaggaaaagtgctccatcagagaaggcttttaagccacaaaagtcagcaaaaatacttctgttgggacagccactgctaccagggttctgccaggaagggctggaggctcaaaacatgttgtgtgaacaggaatctcaattcagatgggaagcatttttttaaaggatggcatattc

SEQ ID NO: 543435 - DNA, 459 bp, Homo sapiens
  misc_feature (130)..(130): n is a, c, g, or t
  misc_feature (132)..(133): n is a, c, g, or t
  misc_feature (137)..(137): n is a, c, g, or t
  misc_feature (145)..(145): n is a, c, g, or t
  misc_feature (148)..(148): n is a, c, g, or t
  misc_feature (153)..(153): n is a, c, g, or t
  misc_feature (170)..(170): n is a, c, g, or t
  misc_feature (194)..(194): n is a, c, g, or t
tggacgaggatgtctgaagagcagatgcccttggagctctctatgagctctgtctcgtaggggctgccacgtgacacaaaaatgccccggctcatcttggcagggtcaagggcccagttggagatgcccncnnagcngacctttnttntgggnggcgggatcgtcttcantgcatccgtcttccagcagcgggngcagagtcttcaggggcattttgggtgagtcttccgccagccccacctcatctaacaccaccacagagacgtactgctgcaggtccttcccctgctgaaagcgggcgcactgccggaaggtgctgatgatgccctgtggggtggagtgcgggctgcactggaaggacaccaggtggacctgcttcaggctgcggaagagatctgagtaggcagccgggccctgcatggcgtctgccacgatggtcttgacggtgcgttggcccaa

SEQ ID NO: 543436 - DNA, 326 bp, Homo sapiens
  misc_feature (253)..(253): n is a, c, g, or t
ctagagatcccgggagccttatcctggagatagatccctgtcgagggcgtgattctacaagtcatcactcgtgccgctttgaggaatgtgtcagactcttctgagacctggagcggtgagaaagcctgcggatgcaagctggaaaggccagattcatgattcgtcctggggggagggtccactcgcatacccaaagtgcagaagttgcttgcaggacttcttcaacgggaaggagctgaacaagaggatcaancctgattgaggctgtggcctatgggtctgctgtgcacgcgggccgtgttgatgggggacaaactgtgagaaag

SEQ ID NO: 543437 - DNA, 669 bp, Homo sapiens
  misc_feature (494)..(494): n is a, c, g, or t
tcccggcctcaggttaattggtacaaatagcaaaggaggaccccagccccatgcagatggtagcccaggggcggggtgtgggggttcggcaccagtccttcgtggtcctcatggtggcgcagagatatctactctggaaggcctttggtagggcgcctggggtactgttgggggaagcctcgacgtctgggaacctggcaagcggggggctgcagcctggggcctgggttgagatccctgggcctgggccctggggccttggcgccttttggcgccggtgaaaacaaacgcctttagagcgccccccctttggggggacaaatataatcggggggcgcacccgaaaaagaccacccgggccttctcaccacaaaaagcttattgggagggggtgtgggccgccaatctgggttagcgcgacaagttatcaagatctccagacgcttgggcgtggtatagaacaccctgtgtggggaaactcctggggcgcttanacccctcctgtgggggcgcttacacagagggggccctttgaaataggcctttcggcacggtgacacatcatgggcctgggccattggtgcggcctgcaactcttctataagggcccctttatgggatggggcattcgtgggccaaaggcgcatgtgtccttcagggaacctgggg

SEQ ID NO: 543438 - DNA, 284 bp, Homo sapiens
  misc_feature (18)..(18): n is a, c, g, or t
  misc_feature (50)..(50): n is a, c, g, or t
  misc_feature (65)..(65): n is a, c, g, or t
  misc_feature (168)..(168): n is a, c, g, or t
  misc_feature (172)..(172): n is a, c, g, or t
  misc_feature (283)..(283): n is a, c, g, or t
ttcttttttgtgacggantcactctttcaccaggctggagtgcagtggcnaatctcagctcactncaatctccacctccccagttcaagtgattctcctgcctcagcctcctgagtagctgggactgcaagtatgaaccaccatgactggctaatggtggttttgttnaggnagcctgtttgtttgtttttttttttttttggcagcaggtcggtgggtgggcaagtgtttgtagagacagggtctcacattgtgcccaaggctagtctcaaactcctgatgng

SEQ ID NO: 543439 - DNA, 244 bp, Homo sapiens
  misc_feature (27)..(27): n is a, c, g, or t
ccccccttttttttttggggggaaaantttttttttttagggggggccccccccccccccgggggggggcccccccccctggggggattttcccccgggggggttttttttttttttttttttacccccccccccccccaaggggggggggttttttccccggggggggttttttttggggggcccggggtttttttcccccccccctcccccttttttggggaaaaacccttttttttcccca

SEQ ID NO: 543440 - DNA, 1426 bp, Homo sapiens
  misc_feature (128)..(128): n is a, c, g, or t
  misc_feature (155)..(155): n is a, c, g, or t
  misc_feature (160)..(160): n is a, c, g, or t
  misc_feature (257)..(257): n is a, c, g, or t
  misc_feature (263)..(263): n is a, c, g, or t
  misc_feature (269)..(269): n is a, c, g, or t
  misc_feature (306)..(306): n is a, c, g, or t
  misc_feature (433)..(433): n is a, c, g, or t
  misc_feature (950)..(950): n is a, c, g, or t
  misc_feature (956)..(957): n is a, c, g, or t
  misc_feature (974)..(974): n is a, c, g, or t
  misc_feature (978)..(978): n is a, c, g, or t
  misc_feature (992)..(993): n is a, c, g, or t
ggcttgagtctatggaggaaaaactccgcggggtcctgcgattcccatggccgcagccgcctgcggcaccaaggccatggccctcttcaagcgcaccttggtgctgagtcccgccgcggcgcccatgngcccgggcgcaggcaccgccccgcggngctgntgcttgcctcctgccgcctggccctgcaaggactggcctcgtgggagagggcggcaggctgtggagccgcctgccccagtcccactcccactcccantcccantcccanctcctgctcctcgacgtctcccaccgccgtgtgtgtngtctgcccgcaggactcgctcagcagcagcctgaaaacttgctacaagtatctcaatcagaccagtcgcagtttcgcagctgttatccaggcgctggatggggaaatgcgcaatgcagtgtgcatanttaatctggttctccgagactctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttcggataagcatgtgacctctgaacaggagtgggacaagtactgccactatgttgctgggctggtcggaattggcctttcccgtcttttctcagcctcagagttgtgaagaccccttagtagggtgaagatacagaacgtgccaactctatgggcctgtttctgcagaaaacaaacatcatccgtgactatctggaagaccagcaaggaggacagagagttctggcctcaagaggttggagcaggtatgttaagacagtnaggggnntttgctaagccggagantatngacttggcgtgcanngcctgaatgaacttataaccaatgcatgaccaatccagatgtcatcactacctttcgagactcagaaaccagagtgtgtttaacttctgtgctattccacaggtgatggccattgcacttggtcggctgttaataataaccagcaggtggttcaaggggcccgtggaagatccgggagggcaggcagtgaccctggtgatgattgcaccaatatgcagtggcaagcatcaatatacgatttggagggaattacatagatccgatcggcctctttgcaaacaggatttcccatcgagagaattccaaggagggtccaaaccaaccatacggtcgcgtggggcggggacgcacctccgacaatgtagacagacttggggcacaggtttacaaacacaaaaatcgcgtcggcgcggtaccttcgtcgcatgtgaag

SEQ ID NO: 543441 - DNA, 640 bp, Homo sapiens
ccccaccccccagagggctttttgatttttcgacttgtctttaagggccagtttggtggggcaccagaagtcacccagcccccttatttccagggtttttgggatcaagttgcccaaatgtataaagggttccaagctttaagggatgccgcttcattcgggtttttgtaccccccccccatggagagtggtttgggatattctcccaggtcccccaaccccaaggaggagttttttattggtggaaaaatgcaggatgggtttttgcccatccccacccgcagttttgtgggtccctggaacagccttagtttagttcagggccgggggtttcccaaaacctaccctgttgggtgtgaggaaagcccagggttttcctgtttttccctcccccgcaaaatgcaaagggggcctcattgtttgtgggggggccagctcctccaagggttttaaaaggggtttcagttccgtccccttgcctgccttccttgggagccaggggtgggcccctggcagtcccttgggttccaaaaagccttaattctgcccggggggggaggttaagcctggccaggggcccccctgtttcccctcccttttttttttcgggcaatgaaataaaaggtttcccccccgccga

SEQ ID NO: 543442 - DNA, 1263 bp, Homo sapiens
  misc_feature (72)..(72): n is a, c, g, or t
  misc_feature (136)..(136): n is a, c, g, or t
  misc_feature (270)..(270): n is a, c, g, or t
  misc_feature (787)..(787): n is a, c, g, or t
  misc_feature (793)..(794): n is a, c, g, or t
  misc_feature (811)..(811): n is a, c, g, or t
  misc_feature (815)..(815): n is a, c, g, or t
  misc_feature (829)..(830): n is a, c, g, or t
cgcctggggaccgcagaggggagagtcgcgcccgggagtccgccgccggcgccaggatggagtgcgtgaaangccttggccaccccgaagagttctacaacctggtgcgcttccggatcgggggcaagcggaaggngatgcccaagatggaccaggactcgctcagcagcagcctgaaaacttgctacaagtatctcaatcagaccagtcgcagtttcgcagctgttatccaggcgctggatggggaaatgcgcaatgcagtgtgcatanttaatctggttctccgagactctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttcggataagcatgtgacctctgaacaggagtgggacaagtactgccactatgttgctgggctggtcggaattggcctttcccgtcttttctcagcctcagagttgtgaagaccccttagtagggtgaagatacagaacgtgccaactctatgggcctgtttctgcagaaaacaaacatcatccgtgactatctggaagaccagcaaggaggacagagagttctggcctcaagaggttggagcaggtatgttaagacagtnaggggnntttgctaagccggagantatngacttggcgtgcanngcctgaatgaacttataaccaatgcatgaccaatccagatgtcatcactacctttcgagactcagaaaccagagtgtgtttaacttctgtgctattccacaggtgatggccattgcacttggtcggctgttaataataaccagcaggtggttcaaggggcccgtggaagatccgggagggcaggcagtgaccctggtgatgattgcaccaatatgcagtggcaagcatcaatatacgatttggagggaattacatagatccgatcggcctctttgcaaacaggatttcccatcgagagaattccaaggagggtccaaaccaaccatacggtcgcgtggggcggggacgcacctccgacaatgtagacagacttggggcacaggtttacaaacacaaaaatcgcgtcggcgcggtaccttcgtcgcatgtgaag

SEQ ID NO: 543443 - DNA, 116 bp, Homo sapiens
ttactcaatttccttccataaaatatttttctacctctatataacttctttttttatttttttgagatggagccttgctctgtggcccaggttggagtgcagtggcgcgatctcag

SEQ ID NO: 543444 - DNA, 1828 bp, Homo sapiens
  misc_feature (144)..(144): n is a, c, g, or t
aactatggtggttagtcatgcttctcgttcacgatggttatgatacgggctctcttgttttgttataatcaatctaatggttgtttggctgttgcgctcgtcctctctcgtccttcgttgaggtcatcattgtttttccgcccngaccacacaatgggtgttctcgtctcccttttgtatagggaggatgtggttgggtggtgacattatcttcttgcgctgcgcgtctctccttgaagtaagtaatgtgtcggtgggtcctatccacttcgtcctgtggctctcgcctaaatcggttcctccaagacgacacgcgtgcttctgttgggtggggggcccaaccacagggtggcactacaatcattctggggggtgttaaccacacaattatttggacctcgacgaattgtttctctgccccccccacggccgttcgtggttgggagaataattaatagtggggtttttttggcgaacccttctttcttccccccagcgtggtaaattttcccagttgtgtttccccgaggaggccgaacaattggtgctcacagcggtctccttttctatgatagcccccctatatttctgcccgtgttatgtgtgtcgccacaggttccaaatttggggagagcgccaaaattgtggggggtccacatgatgcgcgtggtctccccctacggtgctccaccatggtcacccccttctgcggtgttgaagtagtccacaagggttgtctgtggagtctccccccttcctgggggggtttgtgggccacaatattgggaaaatagttggcgcgtccccacatatactgtcgccaaatctaatcctctcacatgggatatatttggtcgttggggccccctttgttggggggcacggggccctcccccacaagtgccgcgtaaactaccgccacaggtgggttgacacaaacagggtgttttcaccagaagagtttaaaattgccacccgggcgcgtctttttttggtgtgtgattttcaccgcggttatcatatcttgccttcgaaatttgggagagggagaaattcccccacaacaaattggtgggggtatacacattataattgtggctgtgaataaagccccctcttgtggaccccctcttgggggggctgctccccaacacacagcttcactagtatattggggtctctctctctctcactcgggatctcgccccacaccacactttttgagaggccccccccctgtggtgaaataacactttctgtattttctcacgatttggggagatctccgcgcgtataaaggagaaatattgtctcgcccgcgatatatgggggttctctctctctcagagatgtccccaaattggagcccaaaagcccactcgtctctcacggcgcacgctcccatcgagacacagaatatatttctacagtgagaagctgtacccacaaagtcacacaaggtggccacacagggagagtttcctggtgtctgttgtcacaggacacacaaagggtgcacaatccaccacaaatgttgtctccctgtaaccctgagatgtgcttggcacatccacaacacactcaatgtccacaggaacacattggtgccacaagagagcttgagaccccaagtctcgagagccactgaatgtaacttctggggagagcttataagtttgaagaaagagagaaacgtcctcacagcccacaggtggaaaggtggccgtccacatatagacctccctatcgtattgagacacccgcttttttgaaaaggggtcccagccacccctcctcggtttttttttccaataaaagtttagaaaga

SEQ ID NO: 543445 - DNA, 741 bp, Homo sapiens
aacatggggattacaggtccctctctcaacacttgagggttacaatttgagatgagatttgggtggtgacacagagccaaaccatatcaccctctgtcacctctcctattcaacacagtactggaagtcccagccagagcaatcacgcaagagaaagaaataaaaggcatctaaataagaagagaggaagtcaaattttctttgtttgcagattacatgcttgattctgtatccagaaaaacccatagtctctgtccaaaggctccttgatctgataaacaacttcaggaaaaccccaggatacaaaatcaagatacaaaaatcactagtagttctatacaccaacaacagtcaagccaatagccaaatcaggaacacaatctcatttacaattgccacaaaaagaataaaatatccaggaatacggctaaccaaggtgaaagatctctaccaagagaactacaaaaccctgctcaaagaaatcagagatgacaccacaaactgaaaagcatgctcatggataagagcatggataacgaatcagtatcatcaaaatggccatattgcccaaaggaattctataggttcaactgctattcctatcagactgccaatgaccatccttcaccagacactagagaaactattttaacatttatattggcccaaaagagctcaattaaattcaaggcatctaaggcacaagaacaaagctgggactttgttactgacttcaactga

SEQ ID NO: 543446 - DNA, 1426 bp, Homo sapiens
taccagggggaaaataactttaattggaaaccccaccaagctgcaaaatctgtccctggctataaagcctcctttcttctcctttgtgcaacttcggctctttctttcaggtggccccattaaatgtgcttttctttctctcctctccagtggctctgagaagcgggccatgtggccaacacttgtggagggtgggtgctcaagtagaactataagggcatcacatctctatctctctcacaagaggcccccgcccgccttctcggctctgtgcaccaccacgcacaagagagacttgtggcgagagggtgtgtgacgcaccccgcgactctctcgtgtgagtctctcccacaacacaacacacacggctctattctcacgcacatgtagcacccaaaaagcctacaatgtgagggtctcgaccttctcctcacgcaccatatacgagtgacgaacccacaccacggccgccaacccacacgaaacgggaggtgtgagaacgtcgccctcctgttgctgtagcaccacgacaatatagggagacatacaatcatacagacatcagacgagtgacgcagagagaccaatattgagcctcctccagtagtagaaatctccacagcgctctcgttcgccgcagcggctcacctcttagtagcaccatcaaagacgacgaatagccgcacccctaagtgacgcacaaacactctctcatcatatcataacaaattctctactctacgccatagtagagtagaagaacactcttcctcgaacggccgtacgcgcagcgacgaacacacatagagaaaaccgcccccctattacatcatactaggtaggaacgcctgaccgaaggagccgcggcagtagatgacacaccacacccagatgaccacgaactaagacggcggcacatacataccacggccggacgacgacaacgcaccggcgggcaatgatcgaaccccaaatgtaggaccccccaccgaacgcaagaaacattcatagcgatggagcggccacacaagcccatatttgtgtcacagacccacgagaacggaggctccaaccatctatccgccgcagctggacggcacgatccatccatagatgagagacggagggtggacgtaccaaacgaccgctattcactccccttgctagacgccagcaggctgcacggcgaccaagacgagcggaacaccgccgttggtcgtgagtcgaacacccccccccccctactgtcgatagcagaaacaagcgtcgccattcatgactgcgcccccaactacaataatgaagaaccaacacaaacaccccccgccagcacgaagatgacacaacacgcactcccacgaaaaccaccacagttacgccaatcaacaacatccgcgcgatgcagcacagccacacaaaccaacac

SEQ ID NO: 543447 - DNA, 530 bp, Homo sapiens
gtggtggcactgattgatgattgtggcagacatcatcttcatagagttttcatgagtttaaatgggatcacatatgaaaatgcttaacatagaacatggtacattgtaagtgcttgataaatgcaaaccactgtagctgttacctgctgtatctacctcaccgggcagtcgtgaggatgaaagggaggctgtgttggggaagtgctttctaaactgtgaaatggtagccacacacttctcttgccttcagagatgggatggttggaagctatgggcagacgttaatggtatccccaaataaggggcctgagaatacttacctatgtccacagaaggtagctgtgttgaggcgagtgtcaccatgggtagctggaaaacagtgcaaaatgctctcagctaagggttaattgtagtcatgagggcaaactctggcatggtatgacttggggcacccttggggacagggagaaaactgatttttcagaaagaggctttagaggaaggatcatgttaaatggaacctgcccact

SEQ ID NO: 543448 - DNA, 234 bp, Homo sapiens
gtctcctatgtctctacaaaaaaaaaatagccaggggtgggttcgggcgtgcttggcactccagccggggcgacagagctgggagttttctttttttggagctcggtctctggtctttttttttaaggccaggcaggggggctcaggccggtaatcctagcacttgggaaggctggggggggaagggtcgctggaacccgggagttggagaccagccggggcaacatagtgaga

SEQ ID NO: 543449 - DNA, 232 bp, Homo sapiens
atattttagatctctctcagacgctcagcgagcttgaaacgtgtgactgatccgtgcgctgctatcatccgagacctgcgatcgctctctgctcgccctacgcatccgttacataacagacgacgatcaccgagtctccgtcccttatcatcaattctcttgagcaccaatggtagtgtacctacgagtacaccgactacggcggactaatcttcaactcatgtcatccatt

SEQ ID NO: 543450 - DNA, 372 bp, Homo sapiens
gccaggtgactgtttttgaagtgtgattttttcattataaaaactcatgcagaattcacacatacacaagtagagagaataatataataaacataaagagcctccatatagtcatcattgatttggtgatttaaaaaggagtaggctgggcacagcggctcatgcctgtcctcccagcactttgggaggctgagttaggaggttcgtttcagccggagagttcgagaccagtctgggcaacatagtgagaactcgtctctactaaaaataaaaaattagctgggggtggtggtgtgcatctgtagtcccagttactccggaggctgaggcgggaggatcgcttgagcttgggaggctggggctgcagtgagc

SEQ ID NO: 543451 - DNA, 237 bp, Homo sapiens
  misc_feature (124)..(124): n is a, c, g, or t
ggaggtagagtagaagttatgtgtttatgcggggaaatgcatatcgggggcacgattatgggggaatagtcagtgccaaagcctccgattatgatgggtattactatgaagaagattattacanatgcatgggctgtgacgataacgttgtagatgtggtcgttacctagaagttgcctgctgcccagctcgctcgtataaggaggcttagactgtgctagactccaactcagatca

SEQ ID NO: 543452 - DNA, 309 bp, Homo sapiens
aagatcacgccactgcgctccagcctgggcaacagcgcaagactcagtctcaaagaaacaaaaaacaaaacaaaaaaacaactcttgaacactgcaattgtttcccctgcaagggatgggctgatttccttatattcttccttttaaccagctattcgtataatattacctagaaagcttgacagggtgtaatcatagcctttgtcccgggaacttggagtcccctgtgatttattagttgtaacagctattatcaacaccctttcttttaaacttacctgttgtctgcgatggcaataggagattttg

SEQ ID NO: 543453 - DNA, 132 bp, Homo sapiens
tgtcttttagtagaggacagcttgtggaggccgtggtctcctgcagcagctgtcttgtgcaccgtctgcatctcctcagacttgagctgcagcagttgggcctccggtgggagcgttctccttctcacgctc

SEQ ID NO: 543454 - DNA, 116 bp, Homo sapiens
  misc_feature (50)..(50): n is a, c, g, or t
cagatgatggggatcgatgagaccgtaaggtcctgcggactgtttatatnatctggtatgttttcaagagtcttagacacatgcgatatatatagctataatgtgcgggtctttat

SEQ ID NO: 543455 - DNA, 1271 bp, Homo sapiens
cttcaccaccaaactaaaatgttgcggagatctgatagtcctgaaaacaaatacagctgacagcacaggctcacagctaacggccaacaaactgctgcatacctcacagagcttagagagagggcactgggaccacgttactctccacaagaaaattcacaccaaccacagctgcctccttcactacgcttcacaacttcacatctctctctaactccacagcaactaaccccacagccaacacacctctcagcatgccacccctctacctgatccctgccacgactgcacctgcgcctcctgcacgccactaccttacgctcctcctccctgcgcgcacacacaacgctcactacctacccactcgctccgcacacccagcacacgcctcccacccaactgcgcccacacccacaccccaacccaccagcctgcgccctctgcaccccgcacgcacaccacgcacgccacccaccgcacacgcacacgcccaccccccaaccgcactcgcgccgccccccacccgagccctctccccccagcacacccactacgcgcgcattccaccccgcccccccacgcacgcgcccgcactggccaccacggccacacccacgcccccacgcctcacgcctgcgcccgctcaccgaccccaaggcctgccccaacccggcgccgccgcacccacacccccactctcccccaccgcctgccacccgcccccacaccccacgcccccccgcccctccgcccccaaccccacgtcacacctacctcccgacgggcgcctgcacacaccacccacacgcccacgcaacccaccccaagcctgcatcccaccgccaggcaacccgcgtaaccaccccaacccctggcacccacagagccagccaccagccgcggaaccctcccacgcacgcccgaacccgtccccctccaccccccccgcacgtcctcaccaacggccaaaacccccccccaacctgcccacgcaccccgcacccgcgcgagcccccacccacttgccccacaacacccctgtccgtcacccccccctcatgcacccccgcccctggcttcgcgccccttttgcttaagccttccgcacactctcctccacccgccccctccacacacggctctcctggcggcattcccaccctgaccatccctccccaccgaccgcgcagccctccccacgtccctcgcacttgccgccctacccctctcccgcgaccccacattccccccccccccctcccactccacaa

SEQ ID NO: 543456 - DNA, 116 bp, Homo sapiens
gaacggatttcagtggccacaagaatgaccacttatatgatatacagcattttctaaaataacaagaacaccaagaaaccccatttaattcttcttcttcttctttttatatgtaa

SEQ ID NO: 543457 - DNA, 231 bp, Homo sapiens
gggcgctctgaggatcccggcgctacggacgccacgcagagggtggacgtcagtaggtttgcagtgttgccttaacccaggttttgcccagcagggcgtggtagagctcactgtctcccaaaatccctaccaccctgttgtgtcatgcagcaccagcttgttgcctgtctggtagcgaatctgcaacgcatcgcgcatgccgatgttcgagtccaccagcgtccgtagcgg

SEQ ID NO: 543458 - DNA, 147 bp, Homo sapiens
tctgtgctgctctctgggaggctctcaatccccagcctcatccagagttgcagccgagtagggactcctcccctgtcctctacgaaggaaaagattgctatgtcgtactcacctccgaccgtactccgtggatctttatggtgagtt

SEQ ID NO: 543459 - DNA, 807 bp, Homo sapiens
atgaccccaatacgcaaaattaaccccctaataaaattaatttaaccgctcattcatcgacctccccatgccatccaacatctccggcatgatgaaacttcggctcactccttggcgccatgccggatgctccaaatcaccacaggactattcctagccatgcactagtcaccaggagccgcaagccgtcattgttcatcaatcgcccacatcactcgagacgtaaattatggctgaatcatccggtacctgtcacgccaatggcgcctcaatattcttgtatctgcctcttcctacacagtcgggcgaggcctatgattacggatcgatttcgctactcagaaacctgaaacatcggcattatcctcctgcttgcaactatagcaagagccttcataggctatgtcccgtcccgtgaggccaaatatcattctgaggggccacagtaattacaaactgtagtatccgacatcccatgacagtgggcagacctagtgcactgaatctgaggaggctactcagtagacagtgccaacctcagacgattctgtactgtcaattcatctggccttattatgcagcctagagaaagcaacgtctatttggcgaagagcggatcaaaaaccccttggattacgccatcggataatactcaccttgaaaagtagagccccgggtatttcctctaagaaacaattacggactgtggcaatttgcacctaaacccaacgatgttaacagtaaaagtggcacccttgacgctgaccttatactatcgggatcacgtacaacacaaaacccacaaag

SEQ ID NO: 543460 - DNA, 953 bp, Homo sapiens
ggtaatctcctggaaagctaccatgttcctgaattgattaaggatgctcacttgttggcttgagagtaagaactttacgactttcaacaaaactgtgcaacttacatcactctgaattggagtccacacttgaacacactaaaagctgaaaatcaacctataagagactgtcctaaatgcacctcagtattagtgctttgttcagaagagaatatgcaaaaagcccttgcaatcgaaacgcaaaatatgaactccgacatggttactggtggctatgcagctttcaactaacatttatagctgctcgacatgcataccagtcagaacgatgccttgcaccttgacacagaagaatttgaccgcttcacattcatcttgctgtcgctctgcaccctggccacgtcactcgtcccccttgctccgcatgtatttgcgccaccctgccctgcgcccggcctcccccgcactgctcctctcgcctgttctcgaccctgcacgcctgcacccgcccaccggactgtcgcctccctctccctctctatcatccacgcccctccactcccctttctacccctcctcttctctcaccacctccctccccacccctcttacagacccgcctcacaactacgactccaccccaccacccacttcgcactcaacccccaactcacacacccctctaacgcctctcccacacactctctctcacccaccctccttcggctactacccgccccttggcctcctcccgctcgctcccctcccctcgcgcaaccttcttgctcttctcttcttatttttctgttggtcctcttttttcgccgtctcgcgccgcgctcttgccccttgctcttcttgctcatcagccttttgccggctcccttcctctctcccgcactcttcaatggcgtgccccgctgtctctctcacactgtggctctccccctccg

SEQ ID NO: 543461 - DNA, 346 bp, Homo sapiens
gctcacggtcctgctgatatgtgacatcaccccggaggcccatgtaaattcctctcttgtactctctcttattccaacagcgccttaggaaatgactacgctgaaatttttggtgggcaggttctcttgctaggtttgaggttgggctgaagatattcctgaatgcaatcatcccaggtgccacactaagaaaatgatccagttgacagctacccctgtgagtgcacttgttgatgagccagtgcatatccaagctacaggcctgattccctttcagatggtgagttttcaggcatcactggaagatgaaaagcggagacagtgttttatgctcaagcccactata

SEQ ID NO: 543462 - DNA, 478 bp, Homo sapiens
tctagaggaccccgcacgaggggtgtccaggtgctgatgaaagagcttgacagcagctttgttctaaaggagcttaaagagaaagcagtggccgggcgcagtggctcacgcctgtaatcccggcactttgggaggccgaggcgggtggatcacgaggtcaggagatcgagactatcctggctaatgtggtgaaaccccgtctctactaaaaatacaaaaaaaaaaaaattagcggggggcgtgggggggggctggtagtcccagctactcgggaggctgaggcaggagattgtcgtgaaccggggaggcagagttggcagtgagcagagatcgcgcccttgcattcaagccagggggacagagcaagattcggtctccaaaaaaagagagcagtgaagaaggaagtagagccgcttggcctcccttttggtctcataggcttaaaggtctaaggatcagggcaccagacctaattggt

SEQ ID NO: 543463 - DNA, 225 bp, Homo sapiens
gcagaacacaggtgtcgtgaaagctaccactaaacgccaaaattgggaaaggaaaggactcatatcaacaattgtcgtcattggcacgtagattcgggcaggtcaacaactactggccatctgatctataaattcggtggcatcgccaaatgaccacctgaaatttagaggaggcttcttacatggggaagggctcctccaagtattcctggcctttgataaact

SEQ ID NO: 543464 - DNA, 238 bp, Homo sapiens
cacacctggctaattttttaaattttttttttataaagacagggttttaccatttgccccagctggtttcaaacccctgggctcaagcaagcctcctgccttggcctcccaaagtgctgggattacaggtgtgagcccccacacccggccttatttcctaacattttgatagcacaaaattttgaaaacccacttttgtgtacgttatgaagcataaaaaattaaacagtatgcccca

SEQ ID NO: 543465 - DNA, 833 bp, Homo sapiens
  misc_feature (27)..(27): n is a, c, g, or t
  misc_feature (92)..(92): n is a, c, g, or t
  misc_feature (124)..(124): n is a, c, g, or t
  misc_feature (129)..(129): n is a, c, g, or t
  misc_feature (136)..(136): n is a, c, g, or t
  misc_feature (169)..(169): n is a, c, g, or t
  misc_feature (207)..(207): n is a, c, g, or t
  misc_feature (237)..(237): n is a, c, g, or t
  misc_feature (242)..(243): n is a, c, g, or t
  misc_feature (249)..(249): n is a, c, g, or t
  misc_feature (252)..(252): n is a, c, g, or t
  misc_feature (273)..(273): n is a, c, g, or t
  misc_feature (278)..(278): n is a, c, g, or t
  misc_feature (290)..(290): n is a, c, g, or t
  misc_feature (308)..(308): n is a, c, g, or t
  misc_feature (323)..(323): n is a, c, g, or t
  misc_feature (329)..(329): n is a, c, g, or t
  misc_feature (333)..(333): n is a, c, g, or t
  misc_feature (364)..(364): n is a, c, g, or t
  misc_feature (378)..(378): n is a, c, g, or t
  misc_feature (393)..(393): n is a, c, g, or t
  misc_feature (397)..(397): n is a, c, g, or t
  misc_feature (399)..(399): n is a, c, g, or t
  misc_feature (418)..(418): n is a, c, g, or t
  misc_feature (429)..(429): n is a, c, g, or t
  misc_feature (447)..(447): n is a, c, g, or t
  misc_feature (453)..(454): n is a, c, g, or t
  misc_feature (472)..(472): n is a, c, g, or t
  misc_feature (476)..(476): n is a, c, g, or t
  misc_feature (483)..(484): n is a, c, g, or t
  misc_feature (514)..(514): n is a, c, g, or t
  misc_feature (629)..(629): n is a, c, g, or t
acagccaagtcagtagatgggcaagtntcacataaatacaagaatgtttatagaatgtttagcatatcatgttaatggacaatagttttccnttctctacagaagtatgaatgaaatgccaaanttgangtccctngtttttttcataaccagcttagtgaggatgttncccactgcctcacatctgttggtcagttgggttttttntgctgagcattcataatttgtgtttttttnatttnntgtttnttntgctggttctctctctgtganttttntgatgttctttncatgggctttttttattnttattgctgcaagtnttcttnagcnttcttgacaacaggtttttttaaattttttncgggttgtgctttnttttgttcatacttntgtnanttttttttgtccatttgtnattttattggntgtgtcctcatagatgtnattttnntgtttcattgctattatntgtnagatttnnaagagtgttagagcatgttcaatatttgcnttcgagtgcatgctacacagttggcttgcttccattagatctacggcagtcataaatgggtgcgatgctgttactcgatttaaagcaagcatcaatagcatgtgtaatgaccgcngttttttgctgatattgaaatgcttctgtagtacttcttgcacacttctatcttctgagagatactgaacattttcattccacttctcagcaaaaaccttgtctggaaactctgcaggtagagataactgttctttaaatattttaacatactgtggaaaaccaaatgaattcattaagtgtatctgccggtgagaaatcttga

SEQ ID NO: 543466 - DNA, 132 bp, Homo sapiens
aagtcccccctttgtctagtagaaccaccgtacataggaccgggatcttgcttagatcttgcacatcattttgggaagtggattctactagcaaggtgtgatctagtacctcatgctgtggcagaaacctga

SEQ ID NO: 543467 - DNA, 226 bp, Homo sapiens
tataagatatctaaagcattcttttacagctccgcggctgagtcatgtaagtgaacatggatcgctagtctggtgtccgtaggctattcctgttcgatgactagtagctggtatctctaccagtatagaaatgcccagagatttcacccgatacgtcatgaacaactccgcatgcatattctggagggttctgtcacatggtttcatactacatgtagtctgttct

SEQ ID NO: 543468 - DNA, 88 bp, Homo sapiens
aggggcagctagaggatgaggggggaggatatttagcactggggcctggagctttttccccacttctgtaccctatcacaccccatcc

SEQ ID NO: 543469 - DNA, 715 bp, Homo sapiens
  misc_feature (47)..(47): n is a, c, g, or t
  misc_feature (58)..(58): n is a, c, g, or t
  misc_feature (132)..(132): n is a, c, g, or t
  misc_feature (139)..(139): n is a, c, g, or t
  misc_feature (162)..(162): n is a, c, g, or t
  misc_feature (170)..(170): n is a, c, g, or t
  misc_feature (214)..(214): n is a, c, g, or t
  misc_feature (226)..(226): n is a, c, g, or t
  misc_feature (344)..(345): n is a, c, g, or t
  misc_feature (364)..(364): n is a, c, g, or t
  misc_feature (366)..(366): n is a, c, g, or t
  misc_feature (402)..(402): n is a, c, g, or t
  misc_feature (408)..(408): n is a, c, g, or t
  misc_feature (431)..(431): n is a, c, g, or t
  misc_feature (433)..(433): n is a, c, g, or t
  misc_feature (441)..(441): n is a, c, g, or t
  misc_feature (455)..(455): n is a, c, g, or t
  misc_feature (494)..(494): n is a, c, g, or t
  misc_feature (497)..(497): n is a, c, g, or t
  misc_feature (516)..(516): n is a, c, g, or t
  misc_feature (527)..(527): n is a, c, g, or t
  misc_feature (534)..(534): n is a, c, g, or t
  misc_feature (537)..(537): n is a, c, g, or t
  misc_feature (586)..(586): n is a, c, g, or t
  misc_feature (588)..(588): n is a, c, g, or t
  misc_feature (604)..(605): n is a, c, g, or t
  misc_feature (611)..(611): n is a, c, g, or t
  misc_feature (614)..(615): n is a, c, g, or t
  misc_feature (645)..(645): n is a, c, g, or t
  misc_feature (649)..(649): n is a, c, g, or t
  misc_feature (686)..(686): n is a, c, g, or t
tcccctttcttaaaagacaagctagtatactggaaaaagaaaaaaanaataataaaanaaaaaccaagacaactttagtaccctcaactttatttgggaaggggagggggaatcctgggtcgcccccccccnccctgcnccgcccggcggcgggcggaagcncggcgccncgcgcccccccctttgtgggcgcggggagaggaccaggggcggngggggggggtcnggaggggggggggggggggggtgggggggggggggggggggcgggcctggggcccggggtgcggggggggctcggggtgcccaggacgggaaaggggcagctagcattgcgtgcatgnngtaccagggtgagagggcngnggcccaggcagactgtcggttacacatgttcaaaangggggnagggccggggctgctgcgcttcncnaggtcttnctcccttgggaccnggtctcccatctgaccctccaggccttagcttgcctcanatntcagggcaggtatccaccnaaccaggctgnaggggangangagggaagccgggaatggggtaggaagaaagctagaggtggcctgcaancngggctggggcccccgnngggggncannataaatactatgggagtttagccaatcccnagcnccgctgtgtcttgtgctaaacattcctttctctccgngcctctgtctccctctgtccccctaccaa

SEQ ID NO: 543470 - DNA, 240 bp, Homo sapiens
tccctctcagctccaaagcaagatattcttagaaagatgaagcatccctgctgtgcacagtggctcacacctgaatcccagcacttcagaaggccgaggctggtagatcatctgaggtcaggagcttgagaccaatcctggccaacatatgtgaaatcctgtctctactataaatacaaaaaattagctgggcatggtggtgggtgcctgtaatcccagctacttgggaggctgaggagg

SEQ ID NO: 543471 - DNA, 105 bp, Homo sapiens
cccttactgttccctaaatcatatttatatatatgccacggactatctgaacacgttactgagagcctgtcccttcaccgtgtgaatcttggacgctcacacatg

SEQ ID NO: 543472 - DNA, 765 bp, Homo sapiens
ggaagaagtctctattgagacaattgaggctggcttcatgaccaaggacttggctgcttgcataaaggtttacccaatgtgcaacgttctgactacttgaatacacttctgacgttcatggcataaacttggacgaacacacttgaagatcaaactagctcaggccaaactttaagttcatacctgagctcaagaaggataatcgtcttttggtaacctaggtctacagggtttacattttctgtgttaccactcaaggatacaaggcacaacctcaatttggtaattggtttagaagccagagtttatcttttctataagtttacagccttttctatatatatacagttatgtgccaccttggtgaaacaatggccaagggacttttttacaacttgttatttattttctagtaccaggctaggaatacggttagtactcactggtattcacctgtcactttttctcatgtttctaatttataaatgacacaaatcaagattgctcaaaagggttaatgatagccacaagaattgttcccttagcatatgcatacagtagaaaattgacgtgactttccgctcctgtcatgacctggggacaaagggacagtctggggtctagattccgtttagggggggagagtggagattaactgtcattgactgacgacgtgcatggactcaaggtgagattgcagcttaggcagacttggatgttcatcagtaaacggtaggccgacggagtggaccgaaaacaacaagg

SEQ ID NO: 543473 - DNA, 987 bp, Homo sapiens
  misc_feature (261)..(261): n is a, c, g, or t
  misc_feature (294)..(294): n is a, c, g, or t
  misc_feature (370)..(370): n is a, c, g, or t
  misc_feature (372)..(372): n is a, c, g, or t
  misc_feature (386)..(386): n is a, c, g, or t
  misc_feature (389)..(389): n is a, c, g, or t
  misc_feature (393)..(393): n is a, c, g, or t
  misc_feature (412)..(413): n is a, c, g, or t
  misc_feature (427)..(428): n is a, c, g, or t
  misc_feature (444)..(444): n is a, c, g, or t
  misc_feature (456)..(456): n is a, c, g, or t
  misc_feature (468)..(468): n is a, c, g, or t
  misc_feature (471)..(473): n is a, c, g, or t
  misc_feature (475)..(475): n is a, c, g, or t
  misc_feature (477)..(478): n is a, c, g, or t
  misc_feature (488)..(488): n is a, c, g, or t
  misc_feature (492)..(493): n is a, c, g, or t
  misc_feature (498)..(498): n is a, c, g, or t
aaactcctactcctcatgtacccattctagtcgcaatggcaatttccgtaatgcttacgaacggaaaaattgtaggctatatacaactacgcaaaggacccaacgtgtaggcccctacgggctactacaagccttcgctgacgccatagaagtcttcactcaaagagcccctaaaacccgccatatctaccatcaccctctacatcaccgtcccgatcttagctctcaccatcgctcttctactatgaaccccactaccgnatacccaaccccctggtcaacctcaagctaggnctcctattaattctagccacctctagcgctagccgttatactcaatacctctgatcagggtgagatcaaaatcaanantagccctgatcggngcnctgngagcagaggcaaacaatcnncatatgaagtcacnnctagacatcatactantatcaacattantaataagtggantcnnntnanncctctccacncttnntcacnacacaagaaccaccgtctgatatactacctgtccatcactgaccgctctggccaataatatgagtaatatcgtccagacatagcagacagacacaaaacgcaaccccgctttcgcaacttgccgaacgagggatgtccgacactagtgtcatggacttacaacaatcgaatacgccgtaggaccacttcgaccgtatatcttcatcgactcgaactacacacaacataatcactacatacaaccaccctcaaacacctacaactcttcctaagaaaccccaaatgacagcactcatcctccttacctctacactacatctttatgtacacccctataaaccgtaaactattttagaccaacactggcccattcttgccattcgaacaagaatatccccagaatacagactatgacccaacattcattcccccatcctatgcaaaccacactacttataaatcaccatacgaattaacacaatcatttgt

SEQ ID NO: 543474 - DNA, 339 bp, Homo sapiens
  misc_feature (110)..(110): n is a, c, g, or t
  misc_feature (195)..(195): n is a, c, g, or t
tctaggatcaattcctcgtatagatgatgcactctagtgtccccctggaggaagctgggagatgggaaggggtctggaccaatttccccgtttgatgatgcactctattncccctggaggaagctgggagatgggaaggggtctggatcaatttcctcgtttgatgatgcactctagtgccccgccctggaggangctgggagatgggaaggggtctggatcaatttcctgatttgatgatgcactctagtgtccccctggaggaagctgggagatgggaaggggtctggatcaatttcctggtttgatgatgcactctagtgtcccctccttgtccag

SEQ ID NO: 543475 - DNA, 148 bp, Homo sapiens
ggatcctttcgacgggtcttactatattgcccaggcttatcttgaacgctcaagtgatcctcctgcctcagcttcccaaagtgctgggattacaggtaatcccagtgctcagccccaatgtttaaaagaggactggccacttgttggc

SEQ ID NO: 543476 - DNA, 357 bp, Homo sapiens
  misc_feature (48)..(48): n is a, c, g, or t
ggtcctgcaagcgtgtacccaaagacacttatgatcaaatattctcgnaagtcaatcgtataattcacaagactgattactttaacttgaaattatagcttaagttaaaatataccgtgagcagtaagaatctccacaggatgccgtgcctcatagatctgtcctggtacttgtcattcccgatcaggagaagctcaatggacactgactcgacccattatgactctcaagcgtagggtcccattgctttgcttccgatatccaaggggaacaagaactacccatctcttacaaaaataagcatgtcaacattgttcagtacatttttctacacatattgggtactacgctttggca

SEQ ID NO: 543477 - DNA, 864 bp, Homo sapiens
ctcagtagcggaggctgtacaggcttgcatagtgcttgagatattccatcgtgcctggctcacataaggcgcttcctggaattcaagtcgtgctgtcctgaacgcgggccaggcagcttgcggcctgagggcgtttatggagtgatcacgaactgaggcaaagtcgtttgggcatcctgcaggcaacatctgtcagtccatcctggctgagtcctcggcatggtccccgcggcaagcatcattgcaattgaaaagtacggaaggtaagtactagcaatcgaatgcacacgagatgagcagcccagaaagcgtcccgatcggcctctgggatcgtaccctcgatgtgacctggttgggttgtacacgacaccgattgcgacaggacctggctgtccttatacgtccttggattcagcgtgttcgtatatgacaatgctagggcactttcagccagagcattattcgcaatgagtgactcactgatggcccagggtgcagtctgcatctgatgccagaggcgaggcaacacgctgtcccgttctccgagagtgctatcttgcttgcttgggacgacagattgccatcgaacagaccgggcaggaaaagccagtgcggcgcccatttggagcttggcccttacttgcccgtagcacgcaatctgccaactggtggccacgtgtggtctcgggtcgccaacgattgactcgccctggaccctaaacattgttacccatcacaatctccttggtaggccttgaattcaaggggaacccaagagtccacatgatggtgcaccgttggggagggacaaggacgttgcaggggcccattcatatacggattccgggcgttgaagggacttct

SEQ ID NO: 543478 - DNA, 924 bp, Homo sapiens
gctatgttgaatagtctactgtgctgtggttgatgataatgtgacgtcagtcgttaattgcttcaccagattgaccagagctctcatggacctcgcttgggcctgagtggcgcctgaaggctagcctcaatccccttggtgcctgtttcagctcaaaccaggtgcgacttctcgttgccttccggatgaggctccacaaagagactggctatctagagcgaacatcctagaaatgaatatacacagccttacacttgaacatgagatgccttctgctgcctggatgtggagaacagccagagttctgagagtgagacgacaggcatatgagctctgtaaagaggggaataccataatgaaagctattgagaaggtacagtgaaaattgcctactctgtcgtatagtaagccgggaaattctggccactgtagcacggcaaacatgaagacagcttcttggctagtagagagagataccttgagatgccaatgttatcacattgaatgtccacgttgaaaggagcttgtcagcgaggaaaagatcccttcagaaggcttggagtggggaaaaatgaagcgtagacatggcagtttcctaaccatgaaacggggctccaagggtcgcacaagagggcgactcccaaggggtagctattaagattccccagccttgggacgaggaacaattctagccaacccctccctttaccagggattggcagcctacaggcaattggctccgtggcaacacggaaaggtttggccgggtcgagcgcacagcttgaaggcgaggaaacttaaccaataaaacaaagctcaaacacgggcaaaacgtgggaaccccttggcttgaatctttacccggagaagccccttgggccacctggtcctttggccccggtccttgaaacccaatattggcca

SEQ ID NO: 543479 - DNA, 538 bp, Homo sapiens
gaaacaattcttcagccaaatgtaaggcaccacctgcgggcaaagcagggcttttccatagtcttagctttccgattttaactccatgggtccaaggcgggagaccatattaattttggtaccaaaaccctactagtttaccaaagggctgaaagggagataaagaggagttgggttaatgggtacaaaaatcccagttagatgaaaggaataatatagatagtgttcagtagcagaatagaatgaacataaactattagtttaaattatgtgaaattccttctatttgatcatattttacaagaaaaaacatcaattttatataggccactttaatacccacccgtatgaggtgtataaggtaaggttaccgacctgagaagctgattaacattggttgaacaatcttattcattagagaacatggtgcttagggtctaaaaccttttgaaaggtctgagaactctttaaaaaaaggaaagaaagaaagaaaagaggaccccctatcaaaataaaaaaatgcaaaatgagaaataat

SEQ ID NO: 543480 - DNA, 409 bp, Homo sapiens
ccttgctctctgttacacagagcatatcagggctgtcctgtgtgggttccagatgagggtctgtgtcccggaagcttgtgttgagagcgtcaaggacccaccccgcttgctgaaccctcacaggtcttggggttgtgcagcctggacttgtagcacacatgtgctgaagcaaagcttcgcggactggatgagccacctggccacagtccttccatggagggcctgtcgtgacgctctaaggagagaggcacaggcctgtgtcttcacttaagccacacagtgatgaggaaaccacagatggagctctttggcgataatactgactctagcccatgagtggcttggccaagccgaggaagggtaggttggcttgtcgagcccttgagcgctgggagaaggggtggggggg

SEQ ID NO: 543481 - DNA, 887 bp, Homo sapiens
gtctgatggtggcaccccttcctgcataccattttgaacatgtaacttttgtatgaaaaaaattcgagcacagtatgatacgttgcccaagtacagaacacctaccagaataaccatctccgattgaaaactccgggaccatcttctcgctcatctactgtttctggcagacctgcccagggaccggggccgcggtatagctccttcttgcgaaccaacgatgagctcccagattccgtgcaagaataattccaccgtaggtgttagcaccagctgtaaaaagccctggtccaatccgtacctgtaggacatccatacacctagctctctgctgggctccatatggcgaccgcgatgatgtggctctggaatgcgtagagaccaattcttccgcgaaattggcgagtgataagtcgccgagggcatactgatcgtctcctgaatatgcgaaacagcgtgccggccgagactctcttccaggacatcaatgaagtccagctgaagatgagtggggaaaaaccccagacgccttgaaagctgccatgtgcctggagtactcctgcttgagccaggcctttggatctatatgccctggttcgtgcccgaatggacgcaccatctctgtgactttccatggaatactccacttcctagataaagcaagtgagctttattcaagaagatggtgaccacctgacaactccaaaggatggatggcggaatttaggttggcagactattcttccgacaggctcactctcaagacgataaaacttatgaccagcggttctgaggcctgccagtaaacggtctgcaaggcatctccagcatcagagtgtctataacttacagctgccacggaacaactttggtcaacaacacaaaac

SEQ ID NO: 543482 - DNA, 1103 bp, Homo sapiens
ggctcttctagtggttctaagaggcggaggctcgggctgccttggtccccagcccactcgctcagccctgaggtttccctctgcttccccaggagcttgaaggcaagcagtccatggcgggaatcctggtagggagagtaatgccccatacctgtgcccactgtctccctgtgccgggggcgcctggaggcaatgccagctccaggacagaggctcaggtgcccaacgggaaggcagccaggaggctgtgtcattgttcaagtcaggcctttaccccaggccctcgcgcagcaagtgcctccacgggcagccctggggcccccaacccacgcactgaagcaggccggcatgtggcatgccatggcccttgaccttcctgctggtgctgctcaccctggtccacgctctgcattacggcttgcacagaaacttccgacggcggggagagcatctactgggggcccatagctggacaggccaggaacacaggtgggcctgctgttgcagatagcggaggcctgcctggcagctccatcgaagtccgtggctcaaagtcgctcgctgccgggaaaaccgcttcctacccgggcacgacgcccttgaccggggtgcccggggaagcgctgagcaggctcgggaggtggaggcgcctggtgtaccttgcaacatgagtgcgcgtggaggtatacgtcaccaggagaccgcggaggggccagaggaaacttcatgtgccagcgtatatgtacacgagtcggccagggacgccattcccttggttggtgaatggcgcgccggacacttgggccgatgccacgtggcgggagtctaacctacgcttgtggggcttgatgggcagtgggcgtgccaggggcatcataacggtacccagacagtatgtcttccatggccacgctccgctgcatcattacactactacttaatgtagtgaaaacaagagatcaacaacaactatgggcgcatcaacccgagttcgagcacgagttactacatgggcaggtgctatatgttgccgctgcacaactcttgtcaagtggtaactggcgccccatatgcagtagaatccagcacgggacccgattgat

SEQ ID NO: 543483 - DNA, 1034 bp, Homo sapiens
  misc_feature (16)..(16): n is a, c, g, or t
  misc_feature (76)..(76): n is a, c, g, or t
  misc_feature (140)..(140): n is a, c, g, or t
  misc_feature (153)..(153): n is a, c, g, or t
  misc_feature (157)..(157): n is a, c, g, or t
  misc_feature (167)..(167): n is a, c, g, or t
  misc_feature (732)..(732): n is a, c, g, or t
ccaagcaggcgagctnccccgggaggtgcgcacggcccaggcccggtcctcaacccttctgcaacaagggcccagncccgggccccaggacaccgtagagcggcccttctacgacctctgggcctcagacaaccccctgnacaggccgtttgnttgnccaggatgantttttcctggagcagaccaagaagaaaggagtgaagcggccagcacgcctgcacaccaagccgtcccaggcacccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgcttggaggagtcggatggtgagggggagccaggccaggggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagactgttccggctgcgcgggatcaaggcccaggtggccctgaggctggcggagctggcgcggcggcggaggcggcggcaggcgcggcgggaggctnaggctgacaagccccgaaggctggggcggctcaagtaccaggcacctgacatcgacgtgcagctgagctcggagctgacagactcgctcaggaccctgaagcccgagggcaacatccttcgagaccggttcaagagcttccaaaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaattttttttagctggaaaaaaa

SEQ ID NO: 543484 - DNA, 1081 bp, Homo sapiens
  misc_feature (16)..(16): n is a, c, g, or t
  misc_feature (76)..(76): n is a, c, g, or t
  misc_feature (140)..(140): n is a, c, g, or t
  misc_feature (153)..(153): n is a, c, g, or t
  misc_feature (157)..(157): n is a, c, g, or t
  misc_feature (167)..(167): n is a, c, g, or t
  misc_feature (546)..(547): n is a, c, g, or t
  misc_feature (549)..(549): n is a, c, g, or t
  misc_feature (618)..(618): n is a, c, g, or t
  misc_feature (624)..(624): n is a, c, g, or t
  misc_feature (629)..(629): n is a, c, g, or t
  misc_feature (667)..(667): n is a, c, g, or t
  misc_feature (681)..(681): n is a, c, g, or t
  misc_feature (693)..(693): n is a, c, g, or t
  misc_feature (701)..(702): n is a, c, g, or t
  misc_feature (720)..(720): n is a, c, g, or t
  misc_feature (723)..(723): n is a, c, g, or t
  misc_feature (725)..(725): n is a, c, g, or t
  misc_feature (746)..(746): n is a, c, g, or t
  misc_feature (748)..(748): n is a, c, g, or t
  misc_feature (761)..(761): n is a, c, g, or t
  misc_feature (766)..(766): n is a, c, g, or t
  misc_feature (769)..(769): n is a, c, g, or t
  misc_feature (772)..(772): n is a, c, g, or t
  misc_feature (774)..(774): n is a, c, g, or t
  misc_feature (780)..(781): n is a, c, g, or t
ccaagcaggcgagctnccccgggaggtgcgcacggcccaggcccggtcctcaacccttctgcaacaagggcccagncccgggccccaggacaccgtagagcggcccttctacgacctctgggcctcagacaaccccctgnacaggccgtttgnttgnccaggatgantttttcctggagcagaccaagaagaaaggagtgaagcggccagcacgcctgcacaccaagccgtcccaggcacccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgcttggaggagtcggatggtgagggggagccaggccaggggcgagggggcccccccctcgcccctccccgcccccctcctccccccccccccccgcctcgcgcccccccnncncccccccgccccccccccccccccccccccgcccccccccccccccccccccctccccctccccccccngccccnttccnccccccccggctccccccccccccgccccgcctcgtcnccccctcccccccncctccccccccncccccgcnnccccccccccccccctcnccncncccctccgccccccccccccncnccccccccccccnccccnccncgnancctgcnnctcccccagccccgaaggctggggcggctcaagtaccaggcacctgacatcgacgtgcagctgagctcggagctgacagactcgctcaggaccctgaagcccgagggcaacatccttcgagaccggttcaagagcttccaaaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaattttttttagctggaaaaaaa

SEQ ID NO: 543485 - DNA, 204 bp, Homo sapiens
acctaggtttctgccattcggggtgaccctgtatttctttcgggtgcccattccattggtccagttaatacttcctcttaaaaatctccaagaggcggggtctccagatcccatttagaaccaaccgggtgctgacaacgcttgtagatgagggccatcatcctaagcccaaagtagaaattggtcgaaggtagtaggtagaga

SEQ ID NO: 543486 - DNA, 675 bp, Homo sapiens
acgaggggtggtgtggacgtgggtgatgtggacgccacggccccgagaagctgattgttggcgtggatgagaaactgaatcctgaggacattaagaaaacacctgtaggtccacgcccctgaagacaagaaagaaattctggccagttttatctccggactcattcaatttctacagaggacttgttacttcacacgtaccatcgagaatcttattccccattgctagtgaccgaacagatcggagatctatgtccatatgacataggcggccaaagagtggacagccaacatgccagaacatacaatctctgcaaaagtgaacgatggaggatgacactcagagattcccgatcctcacaccattccgagagccgggacaggcactagtccgagcagagaaaagccctaaccagtatgacaagaaacacatacgcaattgcccacaaaaagatggcgggcaaaggcctgtaccacgcactggaaaccgtatggacttgccaaacacgccccaaatagggtggaagcgaaattcctcgggaaaacccaaataggaatgagtgccccgtgcatgccacatagagagccgcccattcatttgactcaccgcactgatttacaagcgcaggtaattaccacaatatccatgctaggaaatcctaagcgacgagcaatg

SEQ ID NO: 543487 - DNA, 974 bp, Homo sapiens
tccctggctggttctggaggcacggcgcaccgcggtaagaggcttcagacgctgtcagacgatgcctcgcccacggcgggtcaggtcatctcctggatctatgccttgtggtgcttcatgcacagaatattcccagtatatctcacatgacatttgaagcctggagcctcccaacataatagacagactgattaacaataatgagtatgcagggacagcatacaggattcacaattatcagtgagatttcacgatcctgaccgtccaaactgctagatctacagtgagcttcggatatatcacatgctgctctcctgctcctgtctaactgtagaataactgaaggaaattagattttgatgcttcggaacgggaaccgagtttctgtaactgctgaaggaatagaagctgtggcttcatcttgttcataccttacactgaaagcttctttgaaaaagatgctgcaatctcactgacgaccggagtcgttgctcttgcactcagttgcctgctgctacagatcctcgatttgggtggctgcttaagtattatctgatgtgtccttactgcatgaggagacctcactgcccctttctcgcagtgtgtcgacttttcagctactcaggtttctcgacagtggtgtgttgccttgttgtggaccttgtgcgaagaattccggggttctctgggccttgtgtcctctgctggtggtgctgtgcgaagctgtctcatctactggctcgatacgtctttctcttcaggatgcccgtgtagagaatatgccggaggttgggccgtgtttggccccaactacgcatgagggcgtttggctttgccagaacggtgggagttccctcttccggacagccttgatgtttttgcgccgattttggggtcccgccggtgttttgggtcccctgaaaggcgggtctcccccctatctatatttttcccgttccgctgttattttcccc

SEQ ID NO: 543488 - DNA, 1030 bp, Homo sapiens
  misc_feature (766)..(766): n is a, c, g, or t
gaataggaatgaccaaggtctgacttgatcaatacaccttggtactatcgccaagtctgggaccaccatagcgttccatggaagctttgcaggctggtgcacatatctctatgatatggccaatctcggtgtggtggttctattatactgcttattgtggttgctgagaaagtaacatgtgatcactcgagaatcataacgatgatgagcaggtactgctatggggagtcctcaggcaagggggtatcattcactacgatgatggacatgattactagtgtgaactcgtatggagtcagtagggaactaaaagtaatcctacagcgctgtagaagtaagaccaaatgtgattacttggaggaacgaacgaataaaggagattgtgaagaaaacattgctcagatttattgtggatatcccaattactctctatttgtggagaaggaagcgtgataaaagaattaaggcgagtgaagaggctgatgaaaaggaagacaaattgaagaagaaaaaagaaaaaaggatcgagaaggagtcggaagacatgatcgtgagaatttgaaagatgttggtatctagatgaggaggaagataatagaagggtggggacaatgaagaagactgactgaagatgacggaaaggtacaatcgatgcatgaagagctcatcaaaatgaaatttcgcatctgggcagaaatctccgagatattactaatgaggagtacggagattctataagagttgacaatgactggaatatcacttngcagtgaagccatttcgaggggcagaacgttggatgccaagccctccattcggccccgaagtgccctatgatcggtgcaaccgaaaaaaagaacagttcacagaatgcgcggctcccagataaggagagcaagccgaatcaacacagggggtaaaggaacccaaacacacgcaagaagacacagtcgaaaggcaacaagacgacgcaagacacggccccgaggcaaacaaaaagaaacaaacaaaagaaccgtaaagaagccac

SEQ ID NO: 543489 - DNA, 628 bp, Homo sapiens
ggacagagcactagataccctgtgtatctgtgagagactatgtctgcacacaggataattagaccaagcgtatgcatgcagtggaccttaaagaggaaagcataatctgtaaccgagtctcagtacttgctgtctatatagtgtataagcacatgcataaagatccatcacacaacaattgatatatgcttatgagtcatactctgtatcccacggatcacgtgcaatatcactatgcactaaacagatagctgcaccacgtctataatatgtgcccttagctgtccagcactacatccatgaatcttcaggcagaacaaagatccaagtcgatgatgttacagttggctcgctgcaacgactagttagagatcacatgtacatgaagatggatatgacacaggcataaggcgccactattgatacagcgagctcgtaagagagttactggcatagcattagcaatggacaggtctagcgtctatcatgaggaggatgccagatgtgctcatatacacacagtgagctgttacatagctctaagatggtatctaatttgagacctactacctgatgctcttggagacactctgcgtacatggataactcatgcttatcgggccagtgt

SEQ ID NO: 543490 - DNA, 104 bp, Homo sapiens
cagaacagaagccaaaaacagaagataggaattcgttacctttggctaccaaatctatctgcgtttgtgcctatttttttcccttaccagaactgacttggaag

SEQ ID NO: 543491 - DNA, 332 bp, Homo sapiens
taatggattgggagacgtgtggcagaaaaactgagaggttgaggtgatcccattcgtaggcccagacctgtcattccagttgggagaggtcaccctggccattttgcccctgccagcatcccatcctatttctctctcccagtctttttgcctgggaaagcagccgacattcccagggctgtccagtgagtggtgttcagtgggcttcagttccaaggaatccagggggatctgtccattggggtttctctattgtgccttcagaaacccgatggaggcaatgtatacacacatattatacttccactttaaaaacctacgcaaagccgaga

SEQ ID NO: 543492 - DNA, 368 bp, Homo sapiens
gttctaggcctcgccagtgcccagtagaagctccggctgatcacggcatgcttctgcagctggcaccgagttctgagatcgccccgaatgtcccacccaggttccatgtctgctaactgcctctgataaagtcataaataaaagcccaaaatggagcgagggggcaatgggagaggcagcccagcaagaaagacggccaaggttagttcttccagcacggaggcaaactttccacctccggccgcggctggctggacccgactgaaatggtcccctcagtccttggggtcaacggggagggcactaggcagccgagtgggagggaggcatgaggcaagcctggactacccatggcctcctgtcccctg

SEQ ID NO: 543493 - DNA, 465 bp, Homo sapiens
  misc_feature (10)..(10): n is a, c, g, or t
  misc_feature (24)..(24): n is a, c, g, or t
  misc_feature (45)..(45): n is a, c, g, or t
  misc_feature (247)..(247): n is a, c, g, or t
  misc_feature (424)..(424): n is a, c, g, or t
  misc_feature (445)..(445): n is a, c, g, or t
ttcctcgaantttggggcccctanttgtggtcctttgtgtaatgncaattttgccccaaaggggaaaaattgccaccctgttgcaaacatatgatcaactcccttgaatttacccatgtggaagggattacaactaggattatatatttcaatattgcctattgaaagacattgatagactgggtactgtggctcatgcctgtagtcccagcactttgggaggccaaggcgggtagatagcttgagncccaggagtttgagaccagcccaggcaacatgatgcaacccctcctctacaaaaaacacaaaaattagccaggtgtagtggtgcacacctgaagtcccagctatttgggaggcagatgtgggaggtttgctttatcctgggaggctgaggctgcagtgagccaagattgcaccacancactccagcctgggcgacagngatgagatcctttctcaaaa

SEQ ID NO: 543494 - DNA, 670 bp, Homo sapiens
ggacgcgtgggtcgaccaacgtcgtcgtacgacccacgcggtcgagtctccttacaaggttcctgaccttgcggtagtaaagaatgtcactctctggcaggcccaggagccaaaggatattttgggaaccttgaccaagagaggagtgtatccaatttatacaggaattacaagtgcagtctgattgtgaatccttgtcttggttcttaccttgagagttttaaaagttgaatgtgaaattccttatgaaaaagttccaacaaagccaaactttaaaagagcctatatgtggtcaatcactatttttgctgtactttatgcaaataatcaggccaaatataataaaactaaaacttattttgcaaataaattggtcctgttatgatttgcctttaatagaaaagggggactggagagagaagaattatgtttcagaagaaaatgatagcatacctgttgttagattctagctttgtccattgtttttaagttgtaattatttgcctacatttgaactaaatcttgaattctttcctggctacaagtctccaagctaacatttaaattttttctctcctatgtttctgacttggaataagtagaagttaaaactatgctttttcttgaagccctgcagactggagcaagacaacttgaataaactatggga

SEQ ID NO: 543495 - DNA, 955 bp, Homo sapiens
gggatcagcctgagcacgtctccatactgggagaggcttctgggtcaaaggaccagtctgcagagggatcctgtggctggaagcgaggaggctccacacggtcgttgcaactaccgaaggcaggatctgggcatccaagcacggccatgatccctccgagggctcttctgggatgttggcgtgtctgagttgcaggaacccaagtgcgtgatagcgatggtgacatgtcgtgactggccgattgggggacgccgagcaaccagggccgcgctgagtagatcttctagcacgagtgccacgtgtgtggcatctgtgtgttgacaaccctgtgtggacctgacttgatgccagctgtcgtctgccggggccctgggcttcgagaacagtcacccaggctctgggcagatgtgccttcgggcaatgatcaggtcccatcatgctgggacgatgtccagtgcacgggaagccgtaggcctcgaactgggccgagctgcgatgtccctgtggctggcctgaaagagcaacatgtaggtcacgagagagactgcgtggctgtgtgtcctgtacctaatgaaaccagtgagcgaccctacatcctggaagcgtctctcatgggaagcgtcgtacgcgaggcaccgtatgtgccagatcgtattgaccagccaagaggggctgcgaccttgttcgttcagcgtgaatgtgcagggtcgaggacgccctgggcttctgtggccacattggtctagtccgtgaactgacaatcgtgggacgggccatgcggcctgttggtaatcgcagctcggggtcagtccaattgttcacctatgcaggtgtgcgattgtgaggttgtgttgcccactggttcagggaacgttctcacgggaattacaagctccctaaaggattgaacagtacctgtttgaattcaaatgtcccgaaaggctgcctttccaag

SEQ ID NO: 543496 - DNA, 331 bp, Homo sapiens
gctcagccacatgttgatgccgaggctcccggcgctcgctgctcccgcggccgtgccatgccctcctacgcggtcaccgtggccactggctgccagtggttcgccgcgcactgactgactacgatttaccgtcagcctcggtgggctcgtgcgggctgtatgcgagaatcacctgcgtggtacaagccctttctacaactgacttcgatgcgtggctgcggtggattcatactgacgtgagttgtggacgcaggtaactgggcgatgatccagcctgggtcagaatcggagaagcgcaagtacgtggcttgaatgacgacgtggtacctga

SEQ ID NO: 543497 - DNA, 215 bp, Homo sapiens
gggaccctcaaattaaacagcctcttaccttgcgagccgttttccccaggcctgcgtccgagtcttcgccgcttgcggccccgttccgacgcggaagattctgattgcagccatgagcagcattgagtgcttcagtgttggacgacttggccattgggcccgggatgtcctactgtgggaggcgtggtcgtggatgagagccgtggcagagtggt

SEQ ID NO: 543498 - DNA, 1133 bp, Homo sapiens
ccgagaactgtgctggtgaaaaggacagaccccggagaactgtactggttgaaagaggagtgacagaccccgagagctgtgctggtgaagagggacagactcccggaacgtaacttgctgcgtgggtggatggaggagtaggagcctgtatgaacgtgtatcatggctgtgtgcatgagagagacaccggcggaacgtgttcgtagtgctcttacgggagcgcaaaagaggctctcgatcatatagagagatggctgagaggatgagacgcagagagccacccgtacgtatacgtggatcagctggagattaggacgagagaggggaaaggacggcaggagtagagccagtaactggagtgggtattgagactgaggagtgagatctcacgtcgaatgcgcacggtaaggtggcaaggggcgagagactcaagtatcctccttggcaaacgtgaggtaggcgtaagcatgaagagggggccaccaaagaaagcgcctactttgggagagcgtgagcgtcggtctgtgcgatgaaagtgcgcaagtagttggttgagacaccggcccatagggccaatcatttgtgcatggcactgttggttgagccacagtgtgtaaaaacggccgtggacactttcaccgatacggcatgggtttgggcatagcacagagggggccagaaggtataaccaagaaagagatccataaagacgttctagccagcccattgggaagaacgatccaagaggcaaaaggataaataggcaagacaaaagtacatcaaaagacagagctttgtaagtcccggacacagatcgaggacgttcgcgagagccgaccatatcagaataatagatacctaatgagtttgggccttggaaggagcaccaaagtaagcccacatagtacgcttacctcataaggatatggaacgtatagcctagtcatggtatggaagcgaagaggtccatgtgcggggaccacattatcaagatgaccgcagagaatggcagaagatacacacacatggtatgaatttggacatagcttcgccagaggagttgaactcagggggggaccccaggaagccattattcataacaatggccttggctttagtaatatagaatcctt

SEQ ID NO: 543499 - DNA, 198 bp, Homo sapiens
acacggatcacacttctaatgacatcgaccgacggtcggaaaaatcggtttccagctcaatttccgggtaacgccgaacaaattccgccaccaccggattcaacagtgccgcccaccagcggcaaactgacacgcagcttgccgcgcggcgcgctgtgcgtatcgctgatttcccgttccgccgccgccaattccccg

SEQ ID NO: 543500 - DNA, 1100 bp, Homo sapiens
cacccagtacagacatatccacaaggtctgtaaatgcatgctagaaaaatagggctggatcttatcactgccctgtctccccttgtttctctgtgccagatcttcagtgccccatttccatacagggatttcttttctcatcagcagtcaattcatcatgacacagtttttcatgcacctccctttatggtcttgaacatactttttgcacaccagcaatttcctttatatttcaacacaacaacaaacagcagcatggcggtcttcactcatgttgcccagtgctggtagtcggaactcctgggctcacagcgataccattctgccttggacctcccgaagatgctgggattgcaggcataagctaccatgcttgggcctgaacataatctcaagaggaggatttataaaaccattttctgtacaatcaaatgcttggtgtcatatttccccatttgccaatgtagtctcacttaacaaaaacccaccacaggaaaaacaacatggcatcacaccctccaacgtgcacttacacatagaggagcaaacgagcagcataacacaacaacaccatacatcacgggacactccacacaagaggagacccaacaagaaacaaccatggcagacgggataagacaaagaatcagggccacccacagcacggacacaattgtccaggagaaacccatggtgtggccgctatctgcatgggcgacacccacacactgtatctcagacgacaatcccgaaacctcacgacatctacactatcccgcacccacgcacactcggtgttgatacacaattacacgagcattgagtaccttcgccacttactcgaaagaccccaaggcaccacggagagaagcagaaccaacctagaacaccacaccccaaagcggaacacaacaaccaaggggcccagaaggcacccccacaaggacaccgtaaaaacacagcaaaaaaaagacccaccgaactaatatgagacacaaaggaaagcaccaaaagacggagcaccacacaaccaccgagacacaacggcaccgagaaacaccaacgaaaaaaaaacagcggcaccctacggcaacacgcat

SEQ ID NO: 543501 - DNA, 125 bp, Homo sapiens
tctgacatcgctgatccttttccttcagctccattgtttggtctctggtttgcatccttcgagtaagccatgtagaacagacttgaaaagtttaggaaatcatactgtggtcgatgcgtggtggg

SEQ ID NO: 543502 - DNA, 301 bp, Homo sapiens
actcaggttctatcaaacattaatcaaatggttaagaattgtgatagggccaggtacacctgtaatcccaggacgggacgccaaggcaggatgattgcttgagcctgggagttcgagaccagccagggcaacatggcaagaccctgcctttaccaagaaaatattgaaaaattagctgtgtgttgtggtcatagtcccagctactttggaggctgaggtagagggatcgcttggccctaggaggtcgaggctgcagtgagctgcaccccagcctgggacagagcgagaccctgtctcaaag

SEQ ID NO: 543503 - DNA, 298 bp, Homo sapiens
tactgtaattggtgtgagtgtgttcaagcgactgcatgtgctagtccacatgacatgattgacattcacattcttggggagccttgcagttaaggaatgacacagggagccaagagagtggcttattcggttggattctgaatcacaatcaggaaatagtctttatctggtgcaaccataaatatcatttttcttgaagcgaattcaaaggaaggtaagatcgttactggaggtcgatgtcacgcacggtgctccgtgcctatcaggatgaagctgtgcatgaggctggccatactgg

SEQ ID NO: 543504 - DNA, 1263 bp, Homo sapiens
  misc_feature (620)..(620): n is a, c, g, or t
  misc_feature (663)..(663): n is a, c, g, or t
  misc_feature (768)..(768): n is a, c, g, or t
  misc_feature (775)..(775): n is a, c, g, or t
  misc_feature (795)..(795): n is a, c, g, or t
ggggaagcgggtgcttttcatctgagcctgcaagaggggggtccaggcatcgaggcgtggggagtcgtgggtatgagccccgtagtccatgccaagaggccacagtgacataatggtctcacgtgtgaaacatggctacagattggctgggaagtattgtagtccagtcaattgtggagatagcttgggtgtcatatcagggcaagagtgtcagctgtggatcaggtcagccagaccatctctcgtctcacccgggcttttcgcataatgtgatgtgatagtgtcttgtaccagaagtcaccttctaggggcaggtgacattacggagttaacaagattctgtgatgataccaggcacctggagacaaccaaggttttggaggaccttcatcagacagaattaggccccgtctggtgctggctgccaagtgggcatcaatcagaattggcacaggcaaagtttgtcaaggaagccagcctcttccagcagtgccccctcagaatatccctaagaggacagatgtgaagagccaggatgttgccgtttccccgcagcagcaacagtgctcaaagagctatgtcgacaggcacatggaatccttgagtcagtccaaaagttnccgtcgtcggcacaactcctggtcatctagtagcaggcacccnaaatcaggcaactcccaagaaaagtggtttaaagaatggccagatgaagaataaagatgacgagtgcttcggggatgatattgaggagatcccagacacagattntgatttngaagggaacctggctctttntgacaaggcagctgtgtttgaggagattgatacctatgaaaggagaagtggtacccgttcccggggcatcccaaatgaaaggcccactcggtaccgccatgatgagaacatcttggagtccgagcccattgtctatcgacggatcatagtgccccacaacgtgagcaaggagttctgcacggactctggcctggttgtcccaagtatttcctatgagctgcataaaaagctgttgtccgtggctgagaagcatgggtgggactggtccctgccctcatccttagcctgggccttccccagaggtattaaagagaagtatgattcctctgtcttcagttcttttcaggggcatcctgcccatagtacccagttcccaaggggcccccagtcacgtggtgaagcctagcactcatgcagctcttagggaaccaaaaaccagcactgaaataaagctgaatgactgactga

SEQ ID NO: 543505 - DNA, 130 bp, Homo sapiens
gtaggtcaattgattgtggcaagtataatagaaaaataattgatttattcttgtgtttctcttttctttcttttttttttagactgtgtcttgccctgttgcccagtctggagtgcagtggtgtgatctc

SEQ ID NO: 543506 - DNA, 490 bp, Homo sapiens
  misc_feature (90)..(90): n is a, c, g, or t
  misc_feature (94)..(94): n is a, c, g, or t
  misc_feature (98)..(98): n is a, c, g, or t
  misc_feature (106)..(106): n is a, c, g, or t
  misc_feature (109)..(110): n is a, c, g, or t
  misc_feature (140)..(140): n is a, c, g, or t
  misc_feature (146)..(146): n is a, c, g, or t
  misc_feature (170)..(170): n is a, c, g, or t
  misc_feature (173)..(174): n is a, c, g, or t
aacaggagtgccaccctatagacctggcctgcagtgtattttgtccccctctggagcctgggacttggtgagcagtgggtaagagatctnagancaanaggtgcanggnnattgtctggtatagggtgcaagggattgcnagtatntagctgatactgcttcttcacctnctnntccaggttgaatcccaaaaatgttcaccagaggcctacagtggctctactgtgtggacctcatgtgaagggggctcagggtatcagctgtggaaggcacctagccaaccatgatgtccaggtcatccttttcctgcccaattttgtcaagatgttggaatctatcaccaatgagctgtcgctcttcagcaagacccaaggccaacaagtgtctagcctcaaaggtgagcacttaggcagggctgggctgaaggcctcctccctccttagcagtttgatggtctcgtcatgccacccagtggcgacaggtggaaagg

SEQ ID NO: 543507 - DNA, 114 bp, Homo sapiens
  misc_feature (12)..(12): n is a, c, g, or t
gggaacgttgcnagaccctttgcgtaacaccaaacccgcccgcttatgcgcccttcgggggcgcctgagggggattttttcttcccatcgggggggtgtaaacacataatcata

SEQ ID NO: 543508 - DNA, 3738 bp, Homo sapiens
  misc_feature (620)..(620): n is a, c, g, or t
  misc_feature (663)..(663): n is a, c, g, or t
  misc_feature (768)..(768): n is a, c, g, or t
  misc_feature (775)..(775): n is a, c, g, or t
  misc_feature (795)..(795): n is a, c, g, or t
ggggaagcgggtgcttttcatctgagcctgcaagaggggggtccaggcatcgaggcgtggggagtcgtgggtatgagccccgtagtccatgccaagaggccacagtgacataatggtctcacgtgtgaaacatggctacagattggctgggaagtattgtagtccagtcaattgtggagatagcttgggtgtcatatcagggcaagagtgtcagctgtggatcaggtcagccagaccatctctcgtctcacccgggcttttcgcataatgtgatgtgatagtgtcttgtaccagaagtcaccttctaggggcaggtgacattacggagttaacaagattctgtgatgataccaggcacctggagacaaccaaggttttggaggaccttcatcagacagaattaggccccgtctggtgctggctgccaagtgggcatcaatcagaattggcacaggcaaagtttgtcaaggaagccagcctcttccagcagtgccccctcagaatatccctaagaggacagatgtgaagagccaggatgttgccgtttccccgcagcagcaacagtgctcaaagagctatgtcgacaggcacatggaatccttgagtcagtccaaaagttnccgtcgtcggcacaactcctggtcatctagtagcaggcacccnaaatcaggcaactcccaagaaaagtggtttaaagaatggccagatgaagaataaagatgacgagtgcttcggggatgatattgaggagatcccagacacagattntgatttngaagggaacctggctctttntgacaaggcagctgtgtttgaggagattgatacctatgaaaggagaagtggtacccgttcccggggcatcccaaatgaaaggcccactcggtaccgccatgatgagaacatcttggagtccgagcccattgtctatcgacggatcatagtgccccacaacgtgagcaaggagttctgcacggactctggcctggttgtcccaagtatttcctatgagctgcataaaaagctgttgtccgtggctgagaagcatgggctgacccttgagcggagactggagatgacaggtgtgtgtgccagtcagatggcactgaccctcctcggaggacctaacaggttgaatcccaaaaatgttcaccagaggcctacagtggctctactgtgtggacctcatgtgaagggggctcagggtatcagctgtggaaggcacctagccaaccatgatgtccaggtcatccttttcctgcccaattttgtcaagatgttggaatctatcaccaatgagctgtcgctcttcagcaagacccaaggccaacaagtgtctagcctcaaagatctgcccactagccctgtggacctggtcatcaactgcctggattgccctgagaacgtcttcctgcgcgatcaaccctggtacaaggcagctgtggcctgggccaaccagaaccgggcaccagtactcagcatagaccctcctgtgcatgaagtcgaacagggcattgatgccaaatggtcactggcactgggcctgcctctgccactgggggagcacgcaggccgtatctatttgtgcgacattggcattccccagcaggtcttccaggaggtgggcatcaactaccactcgccctttggctgcaagtttgttatcccactgcactctgcttagagggttcctgcgcaggcaggactctgctgtcccctgctgctcctgataacaaacgccttaaggatatgaagcttcatggaccttgttaaagttttttctcttttgggtttgtttcttctgtgagagaacagaacttacttaaaactgacctgtcacttgctcttagccagggaagtctttcccactgggttccgggctgggtggcaggctgagcgtgcagcaactccaggcatctctaccctcagccccctgcacggccaggtgggcctttgtttacagccgtaggcagctctcaagactgtgtttcaggtttacagccactgggcctgggcacacacattgaagagtgggccaggtcctgtctgggggcctgtacctgctctatttcagagcttgtggctttgtgtctcccctgctttccccacgcagacagcccttcctctgtagaaccagctgcacggcagctgtccaccagagggcagacctgcactctccattcatgtccagggctgtgacagaccaggccttcccctagccccacaagttgatttggggggttttgacccttactcctgagctgatccaagttttatgctgatttttccaaggatctctccctccttttccctccatcactcagaggtagggaagggggcggcattaggatggtgttactgtattgggattttatgttgttctgtcgtcttcagcacaggtagtataaggttatattactgtagaaccacagtgcccatcttgccagcagtgcccgcccccaccctcaaagctgagcaggttgagcctttgcctagtctggggccagacccctcagatggggatatccctgggggagcctggtgctgaaccagaagaggcttcctggtgcttctgtcctaggccaccactcctccagccctttgcccgcacatacatgccccacctactctttcatcccctctgcccttcccctgaaacggtcctttgcagctgtcatcccagagcaggcagatgggctcccgtgcttgagctccaccccagctcttacatcatctgggctttgaaccttttacatttgtccagtctagatgagtaggcttggggccagcaccctgtctcaaagatggcaaaatgaggctagttctggatgagctagctggtgtgggttccaaccataggaacacactgatgctcaaatcctaaggtgccaagctctaggccctggaggctggtagaacaggatctatgcctggaatcctggcagggattcctgtcaaggacttgtgtttaagcctgcttcagggcttcaggctgcttctgctctgtgtctgcccaggctggctgagcgggtggatgggtggacagaagggctcaccaaggattgtggacatagggtaggccctggtaccacgggtttcaggctgttatcacttcccttgtaggaacatagccagaagcagatgagccagggtagagggctggcccctcctctcatcttcccttcagtcttaaattgtctccagcgatgggaagaggccagggactgtaacccttgtgctgtgtattctctgagcctctgctcactctcagggccaagcagctcccaagccggggccctctcttggccaaaatctgaggagcagtctaggttacaggctttttggtaggtaggttctggctgcctgttaatgcagttaggccccctgattaggtacagtgagaaacaagctagaacaaccctggcccagaagactgtccactccagcaagatccagggatgatagccttgcagggccactgggagtttgtgcccaagcttctccctcttctctccccagggggcactgggactggtccctgccctcatccttagcctgggccttccccagaggtattaaagagaagtatgattcctctgtcttcagttcttttcaggggcatcctgcccatagtacccagttcccaaggggcccccagtcacgtggtgaagcctagcactcatgcagctcttagggaaccaaaaaccagcactgaaataaagctgaatgactgactga

SEQ ID NO: 543509 - DNA, 4029 bp, Homo sapiens
  misc_feature (620)..(620): n is a, c, g, or t
  misc_feature (663)..(663): n is a, c, g, or t
  misc_feature (768)..(768): n is a, c, g, or t
  misc_feature (775)..(775): n is a, c, g, or t
  misc_feature (795)..(795): n is a, c, g, or t
ggggaagcgggtgcttttcatctgagcctgcaagaggggggtccaggcatcgaggcgtggggagtcgtgggtatgagccccgtagtccatgccaagaggccacagtgacataatggtctcacgtgtgaaacatggctacagattggctgggaagtattgtagtccagtcaattgtggagatagcttgggtgtcatatcagggcaagagtgtcagctgtggatcaggtcagccagaccatctctcgtctcacccgggcttttcgcataatgtgatgtgatagtgtcttgtaccagaagtcaccttctaggggcaggtgacattacggagttaacaagattctgtgatgataccaggcacctggagacaaccaaggttttggaggaccttcatcagacagaattaggccccgtctggtgctggctgccaagtgggcatcaatcagaattggcacaggcaaagtttgtcaaggaagccagcctcttccagcagtgccccctcagaatatccctaagaggacagatgtgaagagccaggatgttgccgtttccccgcagcagcaacagtgctcaaagagctatgtcgacaggcacatggaatccttgagtcagtccaaaagttnccgtcgtcggcacaactcctggtcatctagtagcaggcacccnaaatcaggcaactcccaagaaaagtggtttaaagaatggccagatgaagaataaagatgacgagtgcttcggggatgatattgaggagatcccagacacagattntgatttngaagggaacctggctctttntgacaaggcagctgtgtttgaggagattgatacctatgaaaggagaagtggtacccgttcccggggcatcccaaatgaaaggcccactcggtaccgccatgatgagaacatcttggagtccgagcccattgtctatcgacggatcatagtgccccacaacgtgagcaaggagttctgcacggactctggcctggttgtcccaagtatttcctatgagctgcataaaaagctgttgtccgtggctgagaagcatgggctgacccttgagcggagactggagatgacaggtgtgtgtgccagtcagatggcactgaccctcctcggaggacctaacaggttgaatcccaaaaatgttcaccagaggcctacagtggctctactgtgtggacctcatgtgaagggggctcagggtatcagctgtggaaggcacctagccaaccatgatgtccaggtcatccttttcctgcccaattttgtcaagatgttggaatctatcaccaatgagctgtcgctcttcagcaagacccaaggccaacaagtgtctagcctcaaagatctgcccactagccctgtggacctggtcatcaactgcctggattgccctgagaacgtcttcctgcgcgatcaaccctggtacaaggcagctgtggcctgggccaaccagaaccgggcaccagtactcagcatagaccctcctgtgcatgaagtcgaacagggcattgatgccaaatggtcactggcactgggcctgcctctgccactgggggagcacgcaggccgtatctatttgtgcgacattggcattccccagcaggtcttccaggaggtgggcatcaactaccactcgccctttggctgcaagtttgttatcccactgcactctgcttagagggttcctgcgcaggcaggactctgctgtcccctgctgctcctgataacaaacgccttaaggatatgaagcttcatggaccttgttaaagttttttctcttttgggtttgtttcttctgtgagagaacagaacttacttaaaactgacctgtcacttgctcttagccagggaagtctttcccactgggttccgggctgggtggcaggctgagcgtgcagcaactccaggcatctctaccctcagccccctgcacggccaggtgggcctttgtttacagccgtaggcagctctcaagactgtgtttcaggtttacagccactgggcctgggcacacacattgaagagtgggccaggtcctgtctgggggcctgtacctgctctatttcagagcttgtggctttgtgtctcccctgctttccccacgcagacagcccttcctctgtagaaccagctgcacggcagctgtccaccagagggcagacctgcactctccattcatgtccagggctgtgacagaccaggccttcccctagccccacaagttgatttggggggttttgacccttactcctgagctgatccaagttttatgctgatttttccaaggatctctccctccttttccctccatcactcagaggtagggaagggggcggcattaggatggtgttactgtattgggattttatgttgttctgtcgtcttcagcacaggtagtataaggttatattactgtagaaccacagtgcccatcttgccagcagtgcccgcccccaccctcaaagctgagcaggttgagcctttgcctagtctggggccagacccctcagatggggatatccctgggggagcctggtgctgaaccagaagaggcttcctggtgcttctgtcctaggccaccactcctccagccctttgcccgcacatacatgccccacctactctttcatcccctctgcccttcccctgaaacggtcctttgcagctgtcatcccagagcaggcagatgggctcccgtgcttgagctccaccccagctcttacatcatctgggctttgaaccttttacatttgtccagtctagatgagtaggcttggggccagcaccctgtctcaaagatggcaaaatgaggctagttctggatgagctagctggtgtgggttccaaccataggaacacactgatgctcaaatcctaaggtgccaagctctaggccctggaggctggtagaacaggatctatgcctggaatcctggcagggattcctgtcaaggacttgtgtttaagcctgcttcagggcttcaggctgcttctgctctgtgtctgcccaggctggctgagcgggtggatgggtggacagaagggctcaccaaggattgtggacatagggtaggccctggtaccacgggtttcaggctgttatcacttcccttgtaggaacatagccagaagcagatgagccagggtagagggctggcccctcctctcatcttcccttcagtcttaaattgtctccagcgatgggaagaggccagggactgtaacccttgtgctgtgtattctctgagcctctgctcactctcagggccaagcagctcccaagccggggccctctcttggccaaaatctgaggagcagtctaggttacaggctttttggtaggtaggttctggctgcctgttaatgcagttaggccccctgattaggtacagtgagaaacaagctagaacaaccctggcccagaagactgtccactccagcaagatccagggatgatagccttgcagggccactgggagtttgtgcccaagcttctccctcttctctccccagggggcactgggactggtccctgccctcatccttagcctgggccttccccagaggtattaaagagaagtatgattcctctgtcttcagttcttttcaggggcatcctgcccatagtacccagttcccaaggggcccccagtcacgtggtgaagcctagcactcatgcagctcttagggaaccaaaaaccagcactgaaataaagctgaatgactgactgaaaaaaaaacaaggaaaaacggtcgcagaaggaacaccaacacaaagccagcaaatgaccaaaaaagagaggccggcgcagaaaaatgtaccccgcgggggccacaagacgaacacagccgttttgccgcaggggccccccaggacgcgacaacacagaaaggaggcgcccacaaccgaggaggcgggcacacaccggggctcggggagacccacacgcgcggggcacggcaacgacccaacagaccggcgaacaacgccgcacgcaccgctcgcgcgacgtcgataccatc

SEQ ID NO: 543510 - DNA, 303 bp, Homo sapiens
atacggctgcgagaagacgacagaagggaatggtaccctggagtcaagggagaaaagaattttaagaaagcagttcaccatggcacatgtacacctatataacaaacctgcaaattctgcacatgtaccccagaacttaaagtaaaattaaaataataaaaataaaaaaaggctgggtatggtggctcacgcccgcctgtaatcccagcacttttgggaggctaaggcaggcagatcacttgaggtcaggagttcaagaccagcctggccaacacgctgaacccaacctctactaaaaataca

SEQ ID NO: 543511 - DNA, 3097 bp, Homo sapiens
  misc_feature (620)..(620): n is a, c, g, or t
  misc_feature (663)..(663): n is a, c, g, or t
  misc_feature (768)..(768): n is a, c, g, or t
  misc_feature (775)..(775): n is a, c, g, or t
  misc_feature (795)..(795): n is a, c, g, or t
ggggaagcgggtgcttttcatctgagcctgcaagaggggggtccaggcatcgaggcgtggggagtcgtgggtatgagccccgtagtccatgccaagaggccacagtgacataatggtctcacgtgtgaaacatggctacagattggctgggaagtattgtagtccagtcaattgtggagatagcttgggtgtcatatcagggcaagagtgtcagctgtggatcaggtcagccagaccatctctcgtctcacccgggcttttcgcataatgtgatgtgatagtgtcttgtaccagaagtcaccttctaggggcaggtgacattacggagttaacaagattctgtgatgataccaggcacctggagacaaccaaggttttggaggaccttcatcagacagaattaggccccgtctggtgctggctgccaagtgggcatcaatcagaattggcacaggcaaagtttgtcaaggaagccagcctcttccagcagtgccccctcagaatatccctaagaggacagatgtgaagagccaggatgttgccgtttccccgcagcagcaacagtgctcaaagagctatgtcgacaggcacatggaatccttgagtcagtccaaaagttnccgtcgtcggcacaactcctggtcatctagtagcaggcacccnaaatcaggcaactcccaagaaaagtggtttaaagaatggccagatgaagaataaagatgacgagtgcttcggggatgatattgaggagatcccagacacagattntgatttngaagggaacctggctctttntgacaaggcagctgtgtttgaggagattgatacctatgaaaggagaagtggtacccgttcccggggcatcccaaatgaaaggcccactcggtaccgccatgatgagaacatcttggagtccgagcccattgtctatcgacggatcatagtgccccacaacgtgagcaaggagttctgcacggactctggcctggttgtcccaagtatttcctatgagctgcattgttatcccactgcactctgcttagagggttcctgcgcaggcaggactctgctgtcccctgctgctcctgataacaaacgccttaaggatatgaagcttcatggaccttgttaaagttttttctcttttgggtttgtttcttctgtgagagaacagaacttacttaaaactgacctgtcacttgctcttagccagggaagtctttcccactgggttccgggctgggtggcaggctgagcgtgcagcaactccaggcatctctaccctcagccccctgcacggccaggtgggcctttgtttacagccgtaggcagctctcaagactgtgtttcaggtttacagccactgggcctgggcacacacattgaagagtgggccaggtcctgtctgggggcctgtacctgctctatttcagagcttgtggctttgtgtctcccctgctttccccacgcagacagcccttcctctgtagaaccagctgcacggcagctgtccaccagagggcagacctgcactctccattcatgtccagggctgtgacagaccaggccttcccctagccccacaagttgatttggggggttttgacccttactcctgagctgatccaagttttatgctgatttttccaaggatctctccctccttttccctccatcactcagaggtagggaagggggcggcattaggatggtgttactgtattgggattttatgttgttctgtcgtcttcagcacaggtagtataaggttatattactgtagaaccacagtgcccatcttgccagcagtgcccgcccccaccctcaaagctgagcaggttgagcctttgcctagtctggggccagacccctcagatggggatatccctgggggagcctggtgctgaaccagaagaggcttcctggtgcttctgtcctaggccaccactcctccagccctttgcccgcacatacatgccccacctactctttcatcccctctgcccttcccctgaaacggtcctttgcagctgtcatcccagagcaggcagatgggctcccgtgcttgagctccaccccagctcttacatcatctgggctttgaaccttttacatttgtccagtctagatgagtaggcttggggccagcaccctgtctcaaagatggcaaaatgaggctagttctggatgagctagctggtgtgggttccaaccataggaacacactgatgctcaaatcctaaggtgccaagctctaggccctggaggctggtagaacaggatctatgcctggaatcctggcagggattcctgtcaaggacttgtgtttaagcctgcttcagggcttcaggctgcttctgctctgtgtctgcccaggctggctgagcgggtggatgggtggacagaagggctcaccaaggattgtggacatagggtaggccctggtaccacgggtttcaggctgttatcacttcccttgtaggaacatagccagaagcagatgagccagggtagagggctggcccctcctctcatcttcccttcagtcttaaattgtctccagcgatgggaagaggccagggactgtaacccttgtgctgtgtattctctgagcctctgctcactctcagggccaagcagctcccaagccggggccctctcttggccaaaatctgaggagcagtctaggttacaggctttttggtaggtaggttctggctgcctgttaatgcagttaggccccctgattaggtacagtgagaaacaagctagaacaaccctggcccagaagactgtccactccagcaagatccagggatgatagccttgcagggccactgggagtttgtgcccaagcttctccctcttctctccccagggggcactgggactggtccctgccctcatccttagcctgggccttccccagaggtattaaagagaagtatgattcctctgtcttcagttcttttcaggggcatcctgcccatagtacccagttcccaaggggcccccagtcacgtggtgaagcctagcactcatgcagctcttagggaaccaaaaaccagcactgaaataaagctgaatgactgactga

SEQ ID NO: 543512 - DNA, 3489 bp, Homo sapiens
  misc_feature (620)..(620): n is a, c, g, or t
  misc_feature (663)..(663): n is a, c, g, or t
  misc_feature (768)..(768): n is a, c, g, or t
  misc_feature (775)..(775): n is a, c, g, or t
  misc_feature (795)..(795): n is a, c, g, or t
ggggaagcgggtgcttttcatctgagcctgcaagaggggggtccaggcatcgaggcgtggggagtcgtgggtatgagccccgtagtccatgccaagaggccacagtgacataatggtctcacgtgtgaaacatggctacagattggctgggaagtattgtagtccagtcaattgtggagatagcttgggtgtcatatcagggcaagagtgtcagctgtggatcaggtcagccagaccatctctcgtctcacccgggcttttcgcataatgtgatgtgatagtgtcttgtaccagaagtcaccttctaggggcaggtgacattacggagttaacaagattctgtgatgataccaggcacctggagacaaccaaggttttggaggaccttcatcagacagaattaggccccgtctggtgctggctgccaagtgggcatcaatcagaattggcacaggcaaagtttgtcaaggaagccagcctcttccagcagtgccccctcagaatatccctaagaggacagatgtgaagagccaggatgttgccgtttccccgcagcagcaacagtgctcaaagagctatgtcgacaggcacatggaatccttgagtcagtccaaaagttnccgtcgtcggcacaactcctggtcatctagtagcaggcacccnaaatcaggcaactcccaagaaaagtggtttaaagaatggccagatgaagaataaagatgacgagtgcttcggggatgatattgaggagatcccagacacagattntgatttngaagggaacctggctctttntgacaaggcagctgtgtttgaggagattgatacctatgaaaggagaagtggtacccgttcccggggcatcccaaatgaaaggcccactcggtaccgccatgatgagaacatcttggagtccgagcccattgtctatcgacggatcatagtgccccacaacgtgagcaaggagttctgcacggactctggcctggttgtcccaagtatttcctatgagctgcataaaaagctgttgtccgtggctgagaagcatgggctgacccttgagcggagactggagatgacaggtgtgtgtgccagtcagatggcactgaccctcctcggaggacctaacaggttgaatcccaaaaatgttcaccagaggcctacagtggctctactgtgtggacctcatgtgaagggggctcagggtatcagctgtggaaggcacctagccaaccatgatgtccaggtcatccttttcctgcccaattttgtcaagatgttggaatctatcaccaatgagctgtcgctcttcagcaagacccaaggccaacaagtgtctagcctcaaagatctgcccactagccctgtggacctggtcatcaactgcctggattgccctgagaacgtcttcctgcgcgatcaaccctggtacaaggcagctgtggcctgggccaaccagaaccgggcaccagtactcagcatagaccctcctgtgcatgaagtcgaacagggcattgatgccaaatggtcactggcactgggcctgcctctgccactgggggagcacgcaggccgtatctatttgtgcgacattggcattccccagcaggtcttccaggaggtgggcatcaactaccactcgccctttggctgcaagtttgttatcccactgcactctgcttagagggttcctgcgcaggcaggactctgctgtcccctgctgctcctgataacaaacgccttaaggatatgaagcttcatggaccttgttaaagttttttctcttttgggtttgtttcttctgtgagagaacagaacttacttaaaactgacctgtcacttgctcttagccagggaagtctttcccactgggttccgggctgggtggcaggctgagcgtgcagcaactccaggcatctctaccctcagccccctgcacggccaggtgggcctttgtttacagccgtaggcagctctcaagactgtgtttcaggtttacagccactgggcctgggcacacacattgaagagtgggccaggtcctgtctgggggcctgtacctgctctatttcagagcttgtggctttgtgtctcccctgctttccccacgcagacagcccttcctctgtagaaccagctgcacggcagctgtccaccagagggcagacctgcactctccattcatgtccagggctgtgacagaccaggccttcccctagccccacaagttgatttggggggttttgacccttactcctgagctgatccaagttttatgctgatttttccaaggatctctccctccttttccctccatcactcagaggtagggaagggggcggcattaggatggtgttactgtattgggattttatgttgttctgtcgtcttcagcacaggtagtataaggttatattactgtagaaccacagtgcccatcttgccagcagtgcccgcccccaccctcaaagctgagcaggttgagcctttgcctagtctggggccagacccctcagatggggatatccctgggggagcctggtgctgaaccagaagaggcttcctggtgcttctgtcctaggccaccactcctccagccctttgcccgcacatacatgccccacctactctttcatcccctctgcccttcccctgaaacggtcctttgcagctgtcatcccagagcaggcagatgggctcccgtgcttgagctccaccccagctcttacatcatctgggctttgaaccttttacatttgtccagtctagatgagtaggcttggggccagcaccctgtctcaaagatggcaaaatgaggctagttctggatgagctagctggtgtgggttccaaccataggaacacactgatgctcaaatcctaaggtgccaagctctaggccctggaggctggtagaacaggatctatgcctggaatcctggcagggattcctgtcaaggacttgtgtttaagcctgcttcagggcttcaggctgcttctgctctgtgtctgcccaggctggctgagcgggtggatgggtggacagaagggctcaccaaggattgtggacatagggtaggccctggtaccacgggtttcaggctgttatcacttcccttgtaggaacatagccagaagcagatgagccagggtagagggctggcccctcctctcatcttcccttcagtcttaaattgtctccagcgatgggaagaggccagggactgtaacccttgtgctgtgtattctctgagcctctgctcactctcagggccaagcagctcccagcgggcctctctgcgcaaaattgagcgccgcacgtacagcctcgcaagaggcgggcggaggactagggccggtagtcggccaacacacaccggcaacagccccgccccgggtgcctcgccgggtggcactccttcccggggcgagcccccccgcccaaaaatacgctggcgacacgcctacctcaataaggccccaacttcg

SEQ ID NO: 543513 - DNA, 972 bp, Homo sapiens
tcgcgagcggccgccctattttttttatttttggaggtttggcggctattttatttacaatttatacttttaacacaatgaaataaacactgatatactgaagcctagtaatagtagtgtaccaatatccctcatttggatgattactttatttaaaacaacaaacctaccctgaaaaattatgccgataaaatctctgggtcataatataagaaatacaatatataattggaacaatatgatggcttaaattttgaaattggaagtgacctctttgggacagactcagagtaacataatctgaagggaggggagctctgacccaaatgatatctttcaggttaacagaagaaaaaagaagcatagttaatctgcaaggagaacgggcagttggcttctcaggtagaatatattcccagttgtcctcaggcttggcagcagaatcatcatcaccgagcatgaagatctgtgccttgtgaagctgccccgcccatcttttctgcctccaaaattatccttcgaaaacacttccacagcagtctgatttcttgagcagaagattccaaaaaagctgctttccaagattctgccaaaagttttcccctttcttcaaaatgatcacccttccatatgcggtcttttctaattcccacgcagcataataggtttttgtactttcccccaccagaatccacagtttgcccggtttacttcatcccttcacaccttttggtggtcgttcccgaattcccagaaattttcctaaaaatatggcttgtttcgcgacagagaaaatacctggcggcgtgttcacacagcgaggattcgtccgcccggcaccggtaaggttccaacgggtcgcggcccagcgtgtcaagtgtctgggtgatccacgccgcgcacccgcgtgagttgtggtgtccccccacggggcgtttggtgtctgaccctcctcatcctcagaggacacaa

SEQ ID NO: 543514 - DNA, 297 bp, Homo sapiens
ccatgtccgacgctaatatgggatctggagacccagcttcttggagattctaagaggacagtattagactggacaaatggaagtgggcaccagaaagaaatacagggtcaccctagaatggcagaaacctaggtttcccagaggtggaaagtagagaggagacattcaacaagacaagtatatattgcacgcgcctacgtatgtgccaggcacgtgttctagacccccgctcccagaagaagaaaacaaagaaacaagtatagcaggcagcaaatcacaagattctgacgggagagg

SEQ ID NO: 543515 - DNA, 260 bp, Homo sapiens
gagacgaaaagtacatgggagcaagaaaagaagttatcactgttcgcaaatatctaaaccgactttcacgatttcactaaaaactgaacacgtatgctgaacgagtttacgtgcctaaggaagtatttaacagagatcattttcaagtaccactgaaggctctgaaggagccgtgcaaagactaaggatgaaatgcatgttggcgatagaagaagctataaccaactgctggctctgagtatcacatgggcgatggggtg

SEQ ID NO: 543516 - DNA, 746 bp, Homo sapiens
ggaagttctgtacagtttaggcaatagaggcttcaacagataattcgcattgagtgtgaaagtggtctcccaagccctgataaacaacatggcaagcccgtggcagcgccagttggctgagtcggcttaaaggcgcgggttatgagcccgtgaagaaagatcgtgaacacgtgaatgggcgagcgggaccatgatgcaggggttcggtgtgcgcttcaggtgcttgtccagcacaagtgcccaggacgggatctactatgaggtccgagggcaagaacagtacgtgtcgaaacgatgacgtttgcagatgctctttgcccttttgctgtcatcaggtgtggtttgacctctcatcaaggtggccggagttatcagagcccattgacatcaaacgcgctgccatccgggagttgctctccgttgttgaacctcttgccaggaaaggttcctggcacgatatcggggttggccaggaagtgctgcgaaggacacctgtgttcggcccctggtcataaatttagtggagaacagccagaggccttctggggaggatacatcttggcagaaagttggcagtgtatcaataggatgggaaggcacggctcttgatatgcaaacagaagggacccagtacatcaaagacatttaaaggtgggcaaatgcggaaggagtagagttggcgcatggactggaagctgaaaaggggaagtatagggcgatccagtgccatgataaatgggtgtccc

SEQ ID NO: 543517 - DNA, 360 bp, Homo sapiens
acatggagagaccctgatcatctacaaaaaatacaaaacttagctaagtatggtggcgcacacttgaagtcccagctaccgctactcggagaggctgaggcgggaggataagcatgagcccaggagtacaaggccgcagtgagctgtaattgcaaaaatacataccagactgggcaacacgagcgagaccctgtctcaaataaaaacaaatcatccacagagtagccgcagccccccagtgctgaccctgaccctgtagccgcgggctgagaacccaactggtctcctgccctcaccaggaggacgagggaggcctccagcagccaacacctggaggacgttgtgcaaaatccattgcca

SEQ ID NO: 543518 - DNA, 569 bp, Homo sapiens
gggggaaaccgccaacttaaaaaaaatttttaaaaaaaaaaattggaaaagggaaaatttttaaaacttttaaaaaaaattgtaaaaaaaaaaacaaaaaagtttttttaaaaaaataaaacggcgaccaacgttaaaaagggggggatttttggcgcaccttaaaaactttaaaaacacaagaaatttgcaaaaaaaaaatttcccacttttaaggggaattttttttaaaacctgggggggaaaacaacaaaccagggggaaaaacccccctccaaataaaaaaattcctcctcaaaaaaacattaacacataaaaaaagagggggatttttcaaaaattctggggtaaagaggaggggggggaaaaaaaggtatttataggggggcaaaaggggcaaaagggctgcgtttatttctccagggggaaaaaacacgtgggccccggaggactcaaaggggcttttgagggacaaccttggtttcacacaagtaccccccgggaagaccaaattttctaaaaaccccccggggggttacaacggggcgggttttttccaaaaaggggcg

SEQ ID NO: 543519 - DNA, 827 bp, Homo sapiens
  misc_feature (16)..(16): n is a, c, g, or t
  misc_feature (213)..(213): n is a, c, g, or t
aagtgtacgcccgaantatggatgacatctgcggccagggcagtgacactgctgagagaggccaggatggtggaggctgaggaactggcaacagctgcggctgtcaatctggagctcctgatcagctgtggtggggcaggatgctgtgcggcggtcagtggccaggcagctcgagtgcgtgccgcttgggaacccagagaatgggctactganctttttgcagcatcaggcttctgggctcatcttgttcaatacacccattttacttgatgatgggacattgagggctgggagggaagagactgtgcttgtgtcactgctgaggcggagcagatgaggatgcttgccttggtgcctggcgtagcccggtgggtagttctggcagcactccctgggtgaccgtgccctctctccagtcaagcctggaatacagcagcagctacaactcagagactccatcgacccagagacgtctcaacttccttgagcacctcctgcccacggggccggtcctccgtgttggggccaccagatgcctgtcgagggggaacctccgtgaatgtggcagatcggggggggtttgggctctctccgcaacttgcaaatgccagcaccaggatgtccttggtgcccgaaccggaaaaaaccccactcatgcaaccctcgcttgtggcaactcaagcctggaggggacccagagcctcaaggggagggagggtcggggggtaaaattcccagggaacccccaaggggaggggcacaagaaccccggaaggtccatcctggggctcaacagaaggcaagctggtcaaagtcacagggtggac

SEQ ID NO: 543520 - DNA, 398 bp, Homo sapiens
accagaggaaagaggctcaagtgcagtagtaaactgaggagacagggattagaatttaagtggttgaaatctgcaggtaaggccctagagaagagtgaattgtgcagaaaggaggcctccgcgcggaagccgcaaaagggcaaccgaccaaaaaacaggccgcacacgcaaaaggcaacgcaaaccaaaaccgcccaagggccaagaacggaacagacacaaccagaacccaaacaccaccgaggggccacggcacccccaacacccctggccaagccagagtgacgagaccataccacccccaaagaatggagcccaaccctgggcacctgtgagaggaaggggaaggatgtctccaagctcttgcgtatgcgaaattgtccaggacgttttaaaaa

SEQ ID NO: 543521 - DNA, 134 bp, Homo sapiens
  misc_feature (1)..(1): n is a, c, g, or t
  misc_feature (27)..(27): n is a, c, g, or t
nccactctagagtatcccctgccaatnacctccaactgaagacaacaaagagaagaaatctgccaaggatgcatcgctgttgtggtgccagatgaagacagctgggtaccccaatgtcaacattcacaatttca

SEQ ID NO: 543522 - DNA, 473 bp, Homo sapiens
  misc_feature (92)..(93): n is a, c, g, or t
  misc_feature (123)..(123): n is a, c, g, or t
gaaaaacttttccaaaccaaaaggagccccgagacccaagttttccccctgtcccccttccgggattatgttccaaaaaccaggccagcctnncctggctggttaaaagttttttttccaacnacattccctttgattgggaaaacaattggcccccggagaaaaatttcaaaacccccccttcccggtgtggatccgagggtctcttttttcttttaacaaactcccctgtgcaaaagaaggtggaccaggggaacgttctttcctgttcccttatggttagggttttgcccaaccccttcccccaaaaaaaccttttcctttttccgggtaaataaattggaggggcggcaaaccccccctccccgggttttttcgtttgcccaaaaaatttttggagggacccccttttaaatttttccggggcccccacatttaaataaaacccccaacctttcctttggcccctccca

SEQ ID NO: 543523 - DNA, 120 bp, Homo sapiens
tggggaaacagagtttcgctctggtggcccaggctgaagtgcaagggcgccatctcggcacaccgcaacctctccatctccggggtttcaagtgattctccgtgtctcagcatacttgga

SEQ ID NO: 543524 - DNA, 348 bp, Homo sapiens
  misc_feature (66)..(66): n is a, c, g, or t
atatagttttttattcctttccccttctgagtctccatagtccattatatcactctgtataccctntggtatccatagcttagctcccacttacagttgagaacatacagaatttgattttctattccggagttactttacttagaataatggcctccagctccatccaagatgctgcaaaagacattatttcatcttttattttttatggctgagtagtattccatggtgcatatataccacattttctttatccactcattggtctatgggcactttggttgattctgtatctttgcaattgtgaactgtgttaacaataaaaatatatatacgagtgtcttttaa

SEQ ID NO: 543525 - DNA, 297 bp, Homo sapiens
cttttggggtctttgctcttttgtggtctttgctctctctctctctctcctgtctctcagagtccagcctgggcgacagagcgagaccccgtctcaaaaaaaaaaaagccccctcttagattatatggaaattcattggggctgaccccttacaaattttttcacaggcctggcatggggcctcatgcctgttttcccagcattttgggaggccaggccaggtggtttgcttgagctcaggatttcaagaccggctggcagcctgggcaacatagcaaagaccccaaaggggtcccg

SEQ ID NO: 543526 - DNA, 121 bp, Homo sapiens
ccccgccagttaccacagctctagatctctgattttgaagaataaccagaaatatacgccatattatcctacaatctattatagtcattcttgttcagctgtctatcttattggactacag

SEQ ID NO: 543527 - DNA, 523 bp, Homo sapiens
gcatttcttgtttgccctttttctgtgtgctgggattttaacccccagcctctctttcaaatcatgataatttgcatttattacacacgtactatgttccaggcactgggtaaattgctttctattgttcatttcatttaatcctcaaagccagcctatgcagtagatactagtgatccatattggatggatgaggtatggatggattagaaaggtttatgtagcttacccaatgtggcacaacttgtaatggcagggtcagacttagaaactaaatctctccaatactagcttttgattttatttttaccctactcacccctgatattcgtcccctggccttttctgcttacctggcttggagcaagtcctcatctgccaaagactatgtaggtggttggaaggagtgctctgtcctcacctctttctcctatggcacctgcaggcagagacctgctgtgtgtgctatataactcttctgagctctctgattctgaatcgactgcttgggattacaaggagg

SEQ ID NO: 543528 - DNA, 1064 bp, Homo sapiens
aatatcgtcgacccacgcagtcgccagtacctgggattacaggtgctttttaccacactcggcgaattttttgtgtttttagtagagacggggtttcaccatgttagccagcatggtctcgatctcctaaacttcgtgatccgcccgcctcagcctcccaaagtgctggattacaggtgtgagccacctcgcctgccctctttttcatatttttttactatttcacgattacaaaataattcatttataaagctcactactcagcctgaaattggcgacctgcatcatacacagtgcttcgcacataactcaatagactctccgtggcctccaccaacacgtttgttgaacgcttcacttcgtggtgcacaccatgtgacgaacaaaccccagaaacattcgtcccgctcgacgactatgcacattccgacacagagaacaggatgcgcaacacgcgactggcacacacccaaaaaagcacccgggcggcaccacaccggccccattaagacacacacacctgcaccggaactcacacccacctgacatacggaatcccacgctcacactcgcaccccggacacaaactgtcaaaaactcacactataccagcaatgcccacaaagcacggcgcagagcttacaccatcgtgatacatcacacgcgagaatgggcacgcaacactacgatcacctacactactatacaccgaactccctctactttgaataagcgcccacattactctcacagacagcacgcaccacactcagcagctctcagcagcacataaaccccgtattacataaatcgtcttaattatcctaatccacatccacacttccaacatcccctcccatacatacaaaccttacacgagcaccactcacaccattacacacacaacacttctggcagactccaaacccaataacatccttcccacgacctattcatacccaacaacgaagacaccaatgcaatcactaccaaacactacccaacctcataatcaccaacaccactctatcactactatcacaccacttttaaccaccactcac

SEQ ID NO: 543529 - DNA, 161 bp, Homo sapiens
tgtcatgtatgtcccagctactcgggaggctgaggctggaggatcgcttgagtccaggagttctgggctgtagtgcgctatgccgatcgggtgtccgcactaaagttcggcatcaaatatggtgacctcccgggagctgggggaccaccagtgttgcctaa

SEQ ID NO: 543530 - DNA, 196 bp, Homo sapiens
  misc_feature (182)..(182): n is a, c, g, or t
agcggaacagcaaggaacaagacatagaggtggcaggcatggtggatcacttgaggccgggaatggagaccagtctggcaaacatggcaaaacccagtctacactaaaaatacaaaaattagccagacgtgatggcgtatgcctgtaattccagctgttggggaggctgaggcacgagaatngcttgaacccggga

SEQ ID NO: 543531 - DNA, 320 bp, Homo sapiens
ctttctactaaaaaacttgcacatgaatacttagagtggcattattcataagccaaataatgcaaataacccaaatgtctatcgatgggttaatgaataaacaagatatggtatattcatacaatggccacaaaaaggaaagaaatagttacatgctacaacttggatgaaccttgaatatattatactaagtgaaagaagccagacacaaaaggcaacatattataaaattccattcatatgagaactcagagcagggaattctacagacacagaaagtagattagtggttgcttaggactgggagtgtagaaattgaa

SEQ ID NO: 543532 - DNA, 142 bp, Homo sapiens
ctggtcagcagcgttgtaactcccctagcgtacgtccgcacgatacttaactttcccacggtctcttctctcggctcaccgctcggcgccgccctgttggctccctccgcgccgctctcccgggcagacgtgcgcctgggtg

SEQ ID NO: 543533 - DNA, 100 bp, Homo sapiens
agcagcagctccgtgaagacagatagactaatgtgaagatggcgtctgaggggggtgcagatactctgctgaggagggggactactgaatgatgatgata

SEQ ID NO: 543534 - DNA, 384 bp, Homo sapiens
  misc_feature (104)..(104): n is a, c, g, or t
  misc_feature (108)..(109): n is a, c, g, or t
ccaccagtcatacttgttcccacatggaaaaaccatgacatcagtaaaattgggtgggcgtgaataaggaagcaaaactcaattataataacattactattgtncaannttcacatggcacttgcaaccggaggctactttgtctgcctgtctccatactcatgctgtcttatgctcatgttcttcacatctacaattttgctagcatctaaaatatctttcacatttccttcctctgcctccaataactacaaaaataaatcttaaaaaacatttttttttttgagatgatctcactctgccacccaggctggaatgcagtgagccgagattgcgccattgcactttagcctaggcaacaagggtaaaactccatctcaaaaa

SEQ ID NO: 543535 - DNA, 369 bp, Homo sapiens
  misc_feature (93)..(93): n is a, c, g, or t
  misc_feature (98)..(99): n is a, c, g, or t
  misc_feature (138)..(138): n is a, c, g, or t
  misc_feature (152)..(152): n is a, c, g, or t
  misc_feature (154)..(154): n is a, c, g, or t
  misc_feature (158)..(158): n is a, c, g, or t
  misc_feature (166)..(166): n is a, c, g, or t
  misc_feature (176)..(176): n is a, c, g, or t
  misc_feature (180)..(181): n is a, c, g, or t
  misc_feature (205)..(205): n is a, c, g, or t
  misc_feature (219)..(219): n is a, c, g, or t
  misc_feature (222)..(222): n is a, c, g, or t
  misc_feature (229)..(229): n is a, c, g, or t
  misc_feature (233)..(233): n is a, c, g, or t
  misc_feature (236)..(236): n is a, c, g, or t
  misc_feature (250)..(250): n is a, c, g, or t
  misc_feature (283)..(283): n is a, c, g, or t
  misc_feature (285)..(285): n is a, c, g, or t
  misc_feature (335)..(335): n is a, c, g, or t
  misc_feature (354)..(354): n is a, c, g, or t
gggctgacaatctgatcagtgcttgaagctatccagaggcacaactccagcctcgtctttttctttctttatttatttttatttttttgtgtntctgnnctccctccatccttcccagatattagaggccaaaaaaanacttgcattttttntnagtntgaaggtntcctgctaantaanntgagccccgcgtggtgggaatcanatgtacccatccanttntgatgcnctcnccncctctccccaagtnttgggtctgtttgctattttgcatggtgggatntntggcccctcagggacttgagattatttaagtactagttcctaacacgttntggaaaataaaaataactntgggttaaggtttta

SEQ ID NO: 543536 - DNA, 100 bp, Homo sapiens
ttgagcggggtttggggttgtagggatagggcatgatcaaaggggccatttctttctttccttcctcatcttcactgccccctttgagctaggtgggatt

SEQ ID NO: 543537 - DNA, 387 bp, Homo sapiens
tcttaaaagctctggggaccaggaagacggaaatgagctgggaagactgagtgagtgaagtgagtgagtgagtgagtgagtggctggctgtgtgcacacattggttgtctgagagttctgtcagcagctctggttggttactctttagtaggtctttccatcttccaatgttctgagtaactgttcaaacacattacttcatgcttttattttcagcattgtctcctaatttgtatttttcaaagatcggatacttaaaaaaatgatgaatgcttaaaaattaatgttatgaaagggaaggaaaggcagagagtgtaactcggtgcttttctaccatgtgtgggttgggtttgatttctccagtactgtttctgctccccacaaaaa

SEQ ID NO: 543538 - DNA, 325 bp, Homo sapiens
aattgtataccaacatataaattaaaagtgttatgcaatgagaaacaataatggaaacagcataatactacatactatcgcgcggggttgtcggcgtggtgggcgtgcgtgtagagagagagcaagggcgtgtgcgtgagtgggcgtaaagagtgagcgtgggagggtgtggtcggtggaggtgtgtggagaggtgagtgtgcgagaggggcgagtgtatgtgtgataagtatagcgcgcaagaggcgaggacaaaatatatatatatatagatataatagatatgagagaacactaaacaataaccactactcacatagaatat

SEQ ID NO: 543539 - DNA, 394 bp, Homo sapiens
tgaatgctacttacataaaagaagactttcataaaataatcactgcacaaaatgttaaagggtggggttatgctgtaagatattatttattcctcaattaatgtttttctatgactgtgctagaactcattacagtatcacggtaaatttgttttcaaaatgccgaattgtgaaactaattgctgggttcacgtttctatgaatatctttcatagtttctctgtcgttgcagtttgtaagtttccttgtgatgacacattctatcattaaagaagagccaggttatccctgttttcaatgcgatccgtaataaccatgtgctcattaatcagattggactgatgcaaataggttccagccttgttgttcgtaagtatctccagtaggtatctgg

SEQ ID NO: 543540 - DNA, 349 bp, Homo sapiens
ataaatgggaaagaatgagtgtggaagtgtcttcacttgcctaacaagaaaggttatatgtggctgggcgccgtggctaacgcctgtagtcccagcattttgggaggctgaggtgggcatatcatctgaggtcgggagttcaagaatagcctgaccaacatggagaaaccccgtctctactaaaaataccaaattagccagtcatagtggcacatgcctgtaatcccagctacttggaaggctgaggcaggagaattgcttgaacccaggaggtggaggttgtggtgagccaagatcgcgccattgcactccatcctgggcaacaagagcgaaactccgtctccacaaa

SEQ ID NO: 543541 - DNA, 106 bp, Homo sapiens
cgtgtacgaggcagtatagctgtttctgattgtaacggacggcagtatcagctgttcctgattgtacacgccggcgagtcataactgatgcctgattgtcaccggc

SEQ ID NO: 543542 - DNA, 590 bp, Homo sapiens
cccttcaactgcctgctatgatggataagattgagagagtgaggagaagtcaatgtggagaaagaaattgggaagggtgctgggctgcttcaagttgaagtataaggctgattgcagaaggagggagcaggtgagctcctggtaccgacactgggcaagtggatcccactatccctgtgtgtctctcctgtaagaggagtgattgcttcagctcacaccagcagtatgtatgcaagcactcaatcattcatccttcaacacatgtattgagcaccttctgtgcgctggactctggggaagaaaaatcaacccagtcccctggtccttgagaagtttgggttctggtggtcaaggcagaaagggaacagatagaaaatgttcctgtgggagacctgcacacatgagaggggaggaaggggagtaggcagagatgcacacaggagggccacttagtagagctgttcacaggctgggctgtccgcctcacacagcatgttggcggatctcgcagagcacttgataccaagttccaatggagtggaagccgaggtcccctccacagggagaaatcaggtcctctggggcccaga

SEQ ID NO: 543543 - DNA, 121 bp, Homo sapiens
ctgacacatagatggtgtctaagttgcttaaatctgcatggcccatgaccccatctcccagtgctctctgatctcatctggacgccgtggaccagcggctcctgagtagtctggccacctg

SEQ ID NO: 543544 - DNA, 449 bp, Homo sapiens
ccaaggggggtccttttttgggcccctggtggggagaggcattttttccagcccggtggggggatggggccgactttttctttttggcctccgggccccgccttttttttggggctcaaccccccacccggttggaggggtgggcccttcctttttacccccgggggggggggccctaaagggggggggggggtttttctcccccggggggttgcccccattgtttcaggggttttttccgggggggggcccttcttttgttggggattttgggggacatgtcttttggggtccaacccgggtttgttttgcccgggggggggggtttttttttggggttaaaaatgccccggggggggggttttcccattttgggttttttgggggggggtcggggggggggggggtcggttttcctcttttgggtcttttaacttttgcccccctta

SEQ ID NO: 543545 - DNA, 336 bp, Homo sapiens
  misc_feature (327)..(327): n is a, c, g, or t
ccatggaaatgaaagaatgaccttttctgtcctatcaaaagtatgaaaataggggctgggtatggtggctcatgccctgtaatccctagcactttgggaggctgaggtgggtggatcagctgaggtcaggagttcgagaccagcctggccaacatggtgaaacctcgtctctactaaaaaaaatacaaaaattacgcaggcatggaggtgtgtgcctgtagtcccagctacgtgggaggctgaggcaggagagtcagttgaacccaggaggtggaggttgcagtgagccaagatcgcgccattgcactccagccttggtgacagagncggtccgtc

SEQ ID NO: 543546 - DNA, 548 bp, Homo sapiens
acagcataaactattcaaaagatcaatacacccaggagttggctttttgaaaaaaattaatagatagactgctagctagactaataaaagaagtgagaagatacaaataaacacaatgagaaatgacaaagacaatgttactactgatcccacagatataaaaataccatcacagactactacgaacacctctatgcacacaaactagaaaatctagaagaaatgaataaaagaagagctagtaccatctgtactgaaactattccaaaaaaactgaggaggagggactcctccttaactcattctatgaggtgagcatcatcctgataccaaaacctggcagagacacacacacacacacacacacacacacacacacacacacacacacacacacagagaaaacttgagccaatatttttgataaacatagacgcaaaaattcttaacaaaataacaagcgagccatatccagcagcacaacaaagagtgatttccctacagacaagcaggctttattccctgggatgcaagtttgtttcaacaca

SEQ ID NO: 543547 - DNA, 327 bp, Homo sapiens
cacttagggccacagatatccaggcttgaggatggggctttgccaggaaactgccctcttctacccagtatttccctggttcctgtcctatcagtgtacaactaccccattttctttatccatttatctgtttgttgttggagacctaggttaatcccatatcttggatattgcgaatagcactgcaacaaacgcatggtgtagatgtctctctaatatactgatttcgtttcctttggataaatgccaagtagtggggttgctggattgtatggtagttctatttgtggtttttctagggagttgcatatgggtgttcaattcgtc

SEQ ID NO: 543548 - DNA, 461 bp, Homo sapiens
tggacaccttctctgcccgacaacacaattcttcttggtcgcccgggtgcgacaacccgcctttctctggaacaccccgtcctgccgtggggttctatacccagctgcctcatccctggagtattagggccgagaaaattgttggggacacatgtacccgggcgcccggcctattccttcccccccccatggccctgtgcaaatcttggccgcgattttggggatcagtccaagacacctcgtggtctatctgtccatcccccggcgtgattttccccgcacttggatagatccggaggcgatcttcttagccacgggtttcccccgcccgttttccccgacccatttccttttttccccccccccgcgggcgggttcctttttcgccccttttcctccccccctttttttccaggccatccaaaaaaggcaccgggttttggggccccaaaaaaaaaaaa

SEQ ID NO: 543549 - DNA, 507 bp, Homo sapiens
  misc_feature (193)..(193): n is a, c, g, or t
  misc_feature (198)..(198): n is a, c, g, or t
  misc_feature (208)..(208): n is a, c, g, or t
  misc_feature (215)..(215): n is a, c, g, or t
  misc_feature (219)..(219): n is a, c, g, or t
  misc_feature (240)..(240): n is a, c, g, or t
  misc_feature (247)..(247): n is a, c, g, or t
  misc_feature (254)..(254): n is a, c, g, or t
  misc_feature (279)..(279): n is a, c, g, or t
  misc_feature (286)..(286): n is a, c, g, or t
  misc_feature (476)..(476): n is a, c, g, or t
gaaatatatttgccaaattgtaagaataattttaatgcaaacacttgtgtggctgccacctattcaagaaacagaatcatgccaatctacatgtgcctcctctgtccagtttaggtcccaacggagtctaaactagaaatattttctagaagctcaagtggaatattgactttctctcggctcttcaaatcanatacncactctaaantgtttanactngcgctagagctcttgtataanggggtcntcattgnctaaaaatcacaacaatgtattctnccctgantggcaagagttcaaagacttattgaaaatttaactccctttagaagtagtctttgggagcaaatcattgagagaccatggaaaaatctgggtaaagtacatgtatagaagtattttaaaggaattcattacaggccaatggtgtaccaatttcagattattagggcagctattgagcatagtattaggantctccagagaaacagaagcccataggggggt

SEQ ID NO: 543550 - DNA, 141 bp, Homo sapiens
tacaggacctcttcataggtagctttttctatcgcggtggatgtaactttcatggcatcttccttggaagtccctttcagctcattccaggcatcccacttggccttgccattgcatatcgcaaggccttgcaatatgcaa

SEQ ID NO: 543551 - DNA, 732 bp, Homo sapiens
atgtcgataccaagaagcagaagaccgacgaggatgactagacagcaaaaaaggaacagttaaactaaaaaaaaaaaggcgcggactattcacctccattcccgtctcagaatttaaacgtggtccacctttccggaagttaaagaggcccgcccgcccaccgtggcagtgccacccgcagatgacacgcgctctccaccaccaagccaaagcatgagaatttgcaacaggggaggaaaaaagaaccaaaattccaaggccctgtttttttctcttaaaagtactttaacaaaggaaattgttgtattcttatatttacattttatattcttgtacatatgttagggtcagccatttttaatgatctcggatgaccaaaccagccttccggagcgttctctgtcctacttctgactttacttgtggtggtgaccatgttcattataatctcaaaggagaaaaaaaaccttgtaaaaaaaagcaaaaatgacaacagaaaaacaatcttattcccgagcattccagtaactttttgtggtatgtacttagtgtactataagtagctggtttgtatgagatggttaaaaaggcaaagataaaaggttcttttaatttacccttttgtgtctatgaaggtagctgtcaaatatattttgcctgtttgatgtctgtgtgcacccatgttgtccaccaataaaccaggaattaattttgctgagttgttctaaccac

SEQ ID NO: 543552 - DNA, 755 bp, Homo sapiens
cgaaatctaccagctacctccctcagccacagacccataagaataaaaaattatatagaaatcctgagaaccagaatgaatgagaaatctgtgcgcttacattcattgccccataatcctaggtctatccggcggagtactgatcattctatttcccccctctattgatctcccactctaatatatctcaatcatatcaacccgattaatcactctacccaagcaatgactaaatcatagactaacgctcaaagaatctaatatgtataatcgcgatactaccaactacataaatggtatcgaacgcatgagtctctttactcctagatattcctgtagagtcgatttgttattgcgcatgaacttaactctctctcggtactccgtgcctcacttcatttaacagcaaacacccaagctatctataaaccctaggccatggaccatccccttatgagcgggcgcagtgagttagtaggctttcggtctagagattgaaaagatgccctaggcccacttcttaccacaaggtacagcctacatccccttatccccatgactagttattatcgaaagcatcagtgctactcagttcaaccaagtagccctgggcgtacgcctaagcgctaacattactgaggccacctactcatgcacctaattggaagcgccagcctagcaatatcaaccagttaagcttccctctacacttatcatcttcacaattctaattctactgactatctagaatcgtg

SEQ ID NO: 543553 - DNA, 1155 bp, Homo sapiens
aaagatggagtgcagcggagcacagaggcggaatgctgcatgcccgtagaggtcctggctgaggtggcatggccatcttggcaacctgtaggcctgcaggcaggaggcagaactgccagccaagatcctggttgagcttctgtggtggactctcagaagaaagacaagctgctctgcagccagccttcaggctagcggactttcctgcacgaacatcctggcctcagcgaggaccactgctaagggtctcgacccccttggccttctgcacacgcacacgcagccgacagaaggcaactcgcagcctaacggacacaaccggacacagcagcagaaggccaccgtacagggcagcacgctacagcgcccactcacaaaacttggccctcaccccaagggccctgcactcagcatgcgccggacagcccacgaggcaacaccggcacaccacacctcccggcgcacagcccctcctgcagccagcctccagcgcccaacgaacaccaacactggcccactggccgcacacaccgcacgcacgccagctccaccacacccacgtgcgcaagctaccacaccacgcgcagacacgcactcctgcagcgccctcctgggccgcagcggttcccctgccaacaccgctcgcggggcaccgcggtcaacgaacgagggggacctccacgccacgggccgccctcggcaccgcgcggctgcgcccccccgcaacaccctccggcgcaccaccccctggacacgccacgccacgggccaccaacccacgggcacccgcgcgcacccccgcctgccaccaacgcgtcactcagcaacccatatccctaccccacgcctatacaggcaactaaccacctgccaccaggctcaaagcccggcatggccaacccctggcaaggccctgaaccgccagggagaggcaacaacgcacccctcctccccaacaaacgcgcgctccacccccccaacgccaacagccgggaacactccgcatcccccagacggacgccgccgaacagccaccacggccgcaccaccccacggtcgccacacgacgccacccccagacgcgagcgctgcaccatcaccaccgagcacaagcatccgcgcacacacaccgcacgagcaggagcacaacagccc

SEQ ID NO: 543554 - DNA, 1262 bp, Homo sapiens
agtgagactaatgtttcatatgcagtgacaaaagaaaacgtgggtgaagaacatgccagtatttgtactctgcagaagatcagtctagcattaaattatcttcatgagcagaggtgataatttatcagagatttgaaactggacaatgtattactggactctgaaggccacattaaactcactgactacggcatgtgtacaggaaggcattacggccaggagatacaaccaggactttctgtgagtactcctaattacattgctcctgaaattttcaagaggagaagattatggtttcagtgttgactggtgggctcttggcagtgctcatgtatgagatgatggcaggcaaggtctccatttgatattgatatgggagctccgatacaccctgacacagaacacagaggattatctcattccaagttattataggaaaaaacaaattcgtcataccacgtgctctgatctgtaaaaagctgcacagtgtactgacagagtattcttaataaggaccctaaggaacgattgggttgtcatacctcaaacaggatttgctagatattcagggacaacccgttcttccgcaaatgtagatatgagatactgattggaagacaaaaaacaggatggatacatcacatttaagacccacacatatttcatgtggaaattagagaaatagagacaaatttgaaacactcacgtatacttactggaccctgtacaagactacacgtcccagcgacagtgaccgcatgaacattggtgtaaaagacaaagccactgtgacaccaaggagcatgacacaatatgtgaaaggaacagaagatatatatcgcagtcctctcttaagaagttatggcgaaagaagtgtgttcgtgatcaccaatattatagacaatagtaatactacacaagatgccaacatagtacaatacaatacaagggagagagagaccgggtaaagacaaacaagtagaagagttgggccgagttcagtacggtcagatgcaattaggcactagagagcaaacataccgaacgcaatacgggtaggaaacagaagcacgaacaggaagagagagggacaggaaaagagagagccgaggatgcgaagagtagacggagaacagaggaggaaaagagagcgcgtgacaagagcacataggatcgagcgaggagcagggacgtagacgaagtatagagaaagacaaagaaagaaccagagaaggggacagaaaaacaatgaaataggacgg

SEQ ID NO: 543555 - DNA, 864 bp, Homo sapiens
ggacttgcctctagactcctccagcatggagcctcttgcagtttacccgcttaaaatgttccgggcccactagccaaggtatccgcaggtttgcatgtctatagttctatgcacagtaacgctatttcttctacaattaaaatgcctcaaagcctaaattcaagagtttgtagtgcactttgaagtgaaggatgcagatagggaagaactgtttctctggaaaagtatccatggcataacgttgtcactagtgtgtaatacgtgggcagtgattgccaattcagagacagaaattacttagggctgaaggaactgcacaaagagttgggaccatgccgacttccagcgtgttcggtcttgtgcctctgcaattcagttcggagaatcggagacgcaggacacgagcgaaggaggtagaatctttggcgagaaaaaactacggggtgagctttcgccatcttccacaagatttaggattcctaggatctgagaggagaagctgcatttagattgtcttgttgatgtcttcaaagatggaagcaagcgtggaatttttggcagtatctgtgtcaatcctggacggtcaagttgtgaagttgtggtatgcaagaggaggcccattgaatgtccatcagggcttgtacatagcaagctgtggtttagacaagttgatcatttaccataataagggggatttgattgagacttgcaatgggtttgtaataataccgagagaaatgtctccaggaggctcgggtgcatctaacaattttgtggggaaggtgttcatctggaccaggtgggtgacttggtttcagtatggcacttggctttaacgtatttgggagaggctttaaggctcgc

SEQ ID NO: 543556 - DNA, 123 bp, Homo sapiens
tgaagcaggtgaaaacctgtctacaaaaaatacaaaaatacagctagggctgggcacagaggttcatcccggtaatcccagcactaaggaaggccgaggtgggcggactgcttaatcccagga

SEQ ID NO: 543557 - DNA, 359 bp, Homo sapiens
  misc_feature (185)..(185): n is a, c, g, or t
  misc_feature (193)..(193): n is a, c, g, or t
  misc_feature (258)..(258): n is a, c, g, or t
  misc_feature (304)..(305): n is a, c, g, or t
aaggcaaacgtggtacatcatgacaccatgggaatgactcatgccagccataaaaagaatgagaattctgtccagaattggttccttccggtgggttcttggtctcgctgacttcaaaaatgaaagccatgaaccctcgtggtgagtgttaacagttccttcaaagatggtgtgtccggagtttnttcccttncagaatgttccaaatgttatcccaagtttcttcccttctggtgggttcgtggtcttgcctgattntcaggagtgggagccgcagaacctttgcctgtgaagtgttaacagnntctttaaaaggtgggtggcatctgggagtttgttccatttcctccccagtgggg

SEQ ID NO: 543558 - DNA, 901 bp, Homo sapiens
ggctgttacggcccggattttaggcatctctggtgcagctggggtggaatctaggccaggccactgcttaaggcccacatccttggcggtcaggacaattttgagaggataatggcccttctgccccaaggttgtcctcgaccagtcccgtgccatggcagcccacctgactatacccatctgcgccctcttcctgaccttactcgatatggccacaaggcaatttagagggccccgttgactacaccaagccgtgaccttcaaccatctgtctggaatgcaaacacctagtggtgctctggagagtgcaacggatgtggacagtggaatgtcagatgtcttcgattgtggtaagcgcaaaccagaggacaagaacttaccagcaggacccgtgacaattgacagcatgagtcatagtcagcattcccaagactggggcacactaaacaccgtacgtacgaacggccgcgactgagagggaagacactgtgttaagggtggatacattgcacacaaagagaatgaccacgcacatgaatatgcacacaaagcagtgagaaaccagaagaggattacacaagggggcagcaaagtcaccttggggtcgtaggcacgacataagcccatgggcggaccccaggaaagccagaatcatacaaaggggacgtagaggacgaaggacgaatacgggaaacaaggggagcaagagacgaatagaagaagaacccaaagaggacgagggggaacaccaaccaaacactgggagaaaacaaccagcgaggggaagaaggatgaagaccagaggaaggaggaacatccagaggagggcaacagagggaaaccagggacaacagacaagccccgagaaataagggcagcagagcatccaaaccagagaagg

SEQ ID NO: 543559 - DNA, 1120 bp, Homo sapiens
agagaaggtgaggcaatgggccaatcccatatccatgaccttccagatgacacaccaacaaccttctcgatcataaagagagataggaatgggatcaatcatgatccatagagatcagaaaatatatacatcaacaccataggtagcgtccgtacctggtcctgacccagtgtgctgagctgggctacttctaactgacggacgctggagacagtggaggtgacgagtaggcgtgaaccgtgtaggtagtcgaagccctctctcgtcattcatcgcaagcatcatgtgtatgttcatatgtccaaggaatatgcagtagaaaggaacgaaagactttacataattgattatccagagcccatcaagaagccagtccgtatggacatgatcgccgtatcagcgcactcgcagtgaccatcgtgacacattccatcaacatcaacatgtcatcgaggtaaacgtgggagtcatgagagagagattacgaagatgggacggaaaagtaagagagtcacatggaaagatgggattgattcaaggtggactatggatgaggaatgacaagatgggtcatatcagggcaattcatacacaccgagaattttaattatgatacggtctgatatcagaaaaggcgtgggtaaggagcataacatgacgatcatcatcctcgtcgtgccagaggtgagacaccatttgattttccctgaagggatccctccgaccttggaggtcctgacacattcttgatagatatatcatggtgaaacgaccgctgggctgtcccctgttgaagagcatcccttggatgtgttgcctagagaatggtagcacccatagtaagcctccagaagcaccaggatagcccgataacacatgcataaaggggttcaagggggcccatgggagcgcccgcacaaggcattgggttgaaggggaaaccccatatccccaagtaaggggtctgtcaccaaacagcccacaactcccatggggggccaagagataacctggggacaaccgtagtgggtcggataaacaagactgggaatacaaaataaagtaaaacaacaataccaaaaacttagaacctgatggaacagacgcagggtacaaaggg

SEQ ID NO: 543560 - DNA, 639 bp, Homo sapiens
aaagaactttttaaatgttttttgtttatactttattttcttgccacaatttagaattttttattcaaatgggtggaaattaaccttcctcttttgccaccccatttttatttcttaaagccggggggggcttgaaaccattttttcccacaaaaagggggggggaaaaagggctccaaaatgccacaaaggggttttaaaaaaacccccggggttaaaaaacaaaattccccgcaccaaacaggggggggggtcctgggaaaaaaaaaaaaaaactccccaaaaggtttcccccgcgcaaaaaaggggaatatccggtcccccaaaaaaaaggggcccccccaaaaaaaaaaaaaaaacttcctctaatttggcccgcggggcaaaaaaaaccccccggatttccccgcgaaaaaccccgccaacaccccggggggggcgcttaatttttgcccccccctaaaacccaaaaaaccccgaaatttcccccaaaaaaaaacggcaaacccccccccggggggatacaataaaaacccccgggccttggtttctccccccccccgtagaagaaaacgccccaccttcccctaaaacggcccccaaaaaaaacggcaaacccgggtaccaatgggtcggtac

SEQ ID NO: 543561 - DNA, 132 bp, Homo sapiens
tagctgttctagaggatccctggtagctgtatcgagggtagagggggtagataagggtaaatacgggccctatatcaaagatatttaggggaattaattctaggacgatgggcatgaaactgtggttagcta

SEQ ID NO: 543562 - DNA, 479 bp, Homo sapiens
tgatcacacttcgagctcggcacccatcctttcctctttcacgctcccaggtattatgacagctccctcctgaggtgcacctaaatgctcaatgtgttacaaaaacgttagcatttattgtgtcaccctgtcctctgaacacacggggagttcaaggcccactatacacaaaggtgcacctctttaccattttatttgtaccatgaaaatataggctcaaggccagaggtgactcacaaagacatcattctcttgaggatacacatacacaaacatacacacacacacacacacactggccctgcaactctggggacttttacttacattaacaatggattctcttcatgtgatttagaaaccaaaaacccggggggcgggaaggtgctctccttctaaaattcctcaagccttcatcaagaagaataatggcagtttgatggaatacttcactaggaatgcagccctcaaacaaaccc

SEQ ID NO: 543563 - DNA, 106 bp, Homo sapiens
tggttttcgctacctttgcacggttagggtacgcggcgttaaacatgtgtcacctgggcaggcaggtgccttctaatactggctgatgctagaggtgatgtgttgg

SEQ ID NO: 543564 - DNA, 738 bp, Homo sapiens
cctgttacggcgcattaaattgggactttcgaaaaggagttggtttcagcggtaaaaccgccttgggactcccctgaatataatcgacccggacattatacttccgggtctttggcatgaaacggtcgcccgcccattacacagttgaactagattgacccgagacggtgtgaaatatatttcaaggtgaacaagtttacttacactccgggtgtgctcaaggagggagcaaattcttttttgctcgctctccttctatggggaacacaactgcctcgcccactcatatggcgaggatacgcaatcaagtccttctcgccgcgtctcctagtgtacctcccttgccggatggggactatctccaccagaggttgcaaaaatatcatttccttccgccaaacgtctccttcgcagttgaaaaaatgcacttcggatcgccccacaaggttctcttttgccccacactggcgtacccaaacctcctgggcggtagcctcgcgcgatgcttataatatactccgcgagagctaatggttcttgcgctgataaataagattcacaacaagtcattcttgattcctgtgagagattagaccatagtggacatcaggaacccaaaaaggtattcagaagaattgcatcattcgcgcccgcatcagtcggggcgacgcgtgcccaatgatgactccggacattcggacgcccccgcaatacccgctgcgccccgtccgacatgca

SEQ ID NO: 543565 - DNA, 310 bp, Homo sapiens
  misc_feature (205)..(205): n is a, c, g, or t
  misc_feature (228)..(228): n is a, c, g, or t
  misc_feature (248)..(248): n is a, c, g, or t
  misc_feature (264)..(264): n is a, c, g, or t
tatctctaacattatgcactttaactttcttaatttgacaaagcattcaagaaacatctgcagactagttttaacagacaaataacacctgtaagcagacatgactgtcctaaatcgtttagttaagctatgaacttttacaacactttacttagtattagacggtaacaggtggagctgagagagtattgcgcacttctccaangctgcccggcagagagccaccanatagtgtggtaggaacttangtggccctttccaagngccacggcttcttttcggcctgcagaatgtcatgcccacagcatct

SEQ ID NO: 543566 - DNA, 104 bp, Homo sapiens
gatagataagctcggcccaattttgcaggaggcacgtgaggctatctggttggcctttttaacaccaacctgtgtgctatccatgccaaacgtgtaacaattat

SEQ ID NO: 543567 - DNA, 346 bp, Homo sapiens
atccagcgccaggagatcgcacacgggaagggcgggtgccaagactgtgatggattcctgagcattcaatacacatgaggactcccaagtccaaactggcccacttaggattctgagtctcacagtccacacagtgggcgttcccacgcatgttatggatagactgcaggaccatggccttgctctggctggacagctgggacgtgcatttactgctctagcatgactgcaggctggccaggatatggctatggatggcttggacccaggcatcccgctcctcatacgtcgtggattcaaagtaccacgtttgtccagtggcagacacaatcataaaaaaaaaaaa

SEQ ID NO: 543568 - DNA, 458 bp, Homo sapiens
  misc_feature (421)..(421): n is a, c, g, or t
ctcggaccggtgttagcttctgaggagagggctctgctgcataaggggcctgagagctgtaggactgagagctggctggcagacacttcagatgcttgtagctcttcctgctggaggaggaggtggtggtgtacttgatggtcggaactgccgccgtccaacagagctgaggccagccccagtgggtctggcgctgctggaactagagccggctccaacgccaagatcactgccagtaggagtagctgcttcctccacctcaggcctaagccactgcctgacaccggtggcaccgccagtagccactggagacggtggactgacactactgagatgtagacttgtccaacgccttcgccatacagcctgcgctcctcgccctccaggagcttgcggtaagtggcgatctccacatccaggnccagcttgacgtgcatcagctcctggtactccttcag

SEQ ID NO: 543569 - DNA, 370 bp, Homo sapiens
  misc_feature (17)..(18): n is a, c, g, or t
  misc_feature (20)..(21): n is a, c, g, or t
  misc_feature (47)..(47): n is a, c, g, or t
  misc_feature (49)..(49): n is a, c, g, or t
  misc_feature (299)..(299): n is a, c, g, or t
tttttttgtgacggagnnannttctcttgtccacgccggagtgcagngncgcaatcttggctcaccgcaacctctgcctgccaggttcaagcgattctcctgcctcagcctcgcgaagtagctgggattacaggcccacaccaccacatccagctaatttttgtatttttagtaagagaggggttttcgccatgttggccaggctggtctcaaactcctgacctcaagtgatctgtgtgccttggcctcccaaagtgctgggattacagatgtgagcacctggcctctgcttttgtacntcataagcacttcaaattctcacatacaacgtgtctccctcaaactttgttatgaggtcagcacgtcgacg

SEQ ID NO: 543570 - DNA, 471 bp, Homo sapiens
  misc_feature (439)..(439): n is a, c, g, or t
cacgagggtccgacacccgcggcatcggtgccgcgcggcgctggatcacggccgagctcaccgcctgcagcaaggccgcgggtggccggctgcaggtggaggagcagagcttcatcgagccggcgggcaaccgcgtgagccagccgaccgagctggtcaacgtggtcgcaaccctgcccgggcggggggccagcaagtcccgcgtgctggtggtcagcggccactacgactcacgcaacagcgacgtgatggattcgctgggcgaagcccccggtgccaacgacgatgcctccggcaccgcggccgtgatggagctggcctgcgtgatggcgcgccggcagttcgacgccacgctggtgttcatggccgtgccgggcgaggagcagggcctgctgggcgcggcgcaatgggcgcgcgaagcccgggcggccggcaccancgtcgaggccatgatcaccaacgacatcatcg

SEQ ID NO: 543571 - DNA, 915 bp, Homo sapiens
cccacgcgtcgcccacgcgtccgcaccagcatatgctgaggaggatgtggagcaacaggagctcccattcactgcaggtgggaatgcaaaatggcacaggcacttcagaagacagcctggcggtttcttacaaagctaaacatactcttaccatatgatcaagcaattgcaaccttgttgatttaccaaaaggagttgaaaacttacgtccacactaaaacctgtacatggatgttttagcagctttactgctaactgcgaaaatttagaatcagctaagatgtccttgtgtaggtgaggggctgaacagatacattctgacaatggaatattatttagtgctaaaaagaaatgctttatgaagccatgaaaagacatggaggaagctgggacgtatattgctaagcaaaggaagcaaatctgaaaatcctatatactgtatgattcccaatatgtaacattctggaaagggcaagactatagaaagaataaaagatcagtggttgccaggggtcagcaggcaggaaggaatgagtgggtggagcacagaggattttcagggcagtggaacaactccatatgacgctgtaaagcaaaatcatgtccttacacatttgttaaaacccaatgactgttcaaggccaagagtgagccctaatgtaactatggactttgggtgacttggccagagtgagccctaatgtaactatggactctggggtgactagccaagagtgagcctaatgtaactatggacttccaggtgactggccaacagggagcctaatgtactatggacttcgggtgactggacaagagtaggccctaatgtaagctatggaactttgggttgatatgaaccaaatgttaagtgttactttcattaacagttaataaaatttcacttgtggtgtg

SEQ ID NO: 543572 - DNA, 415 bp, Homo sapiens
agcgtggacgcggcccgaggtcagtcagtctgctacgggcgtcggtcccgcgaaaactgatcggagacgtatagggtcatcgttcaacggagtcgacgatcccctacctgaaacttgccacggaggacctgcgcgcaatcgccctagagatcccgggacaggaggtgcgctcatgaacgctaggcccgacaccgatggcagaacgatagcccgttatctaggtcagctccggctgcgctgctcgaccagtccgatctattaccggcaggcgctccgaaccttccaggaagtagttatccgggatcagcgcacacccggacagctaggccgagaagtgctcgaaacgtggatgcgcgaatgtgccatgcactggcccatggcgacgctgctgcatcgcgcccggatcggcaatcgg

SEQ ID NO: 543573 - DNA, 516 bp, Homo sapiens
  misc_feature (110)..(110): n is a, c, g, or t
  misc_feature (118)..(118): n is a, c, g, or t
  misc_feature (130)..(130): n is a, c, g, or t
  misc_feature (143)..(143): n is a, c, g, or t
  misc_feature (163)..(163): n is a, c, g, or t
  misc_feature (176)..(176): n is a, c, g, or t
  misc_feature (185)..(185): n is a, c, g, or t
  misc_feature (189)..(189): n is a, c, g, or t
  misc_feature (191)..(191): n is a, c, g, or t
  misc_feature (195)..(195): n is a, c, g, or t
  misc_feature (201)..(201): n is a, c, g, or t
  misc_feature (229)..(229): n is a, c, g, or t
  misc_feature (231)..(231): n is a, c, g, or t
  misc_feature (233)..(233): n is a, c, g, or t
  misc_feature (235)..(235): n is a, c, g, or t
  misc_feature (247)..(247): n is a, c, g, or t
  misc_feature (252)..(252): n is a, c, g, or t
  misc_feature (255)..(255): n is a, c, g, or t
  misc_feature (277)..(277): n is a, c, g, or t
  misc_feature (280)..(280): n is a, c, g, or t
  misc_feature (293)..(293): n is a, c, g, or t
  misc_feature (308)..(308): n is a, c, g, or t
  misc_feature (313)..(313): n is a, c, g, or t
  misc_feature (336)..(336): n is a, c, g, or t
  misc_feature (405)..(405): n is a, c, g, or t
  misc_feature (509)..(509): n is a, c, g, or t
tggatttctggtttatttaaaaatgatttaaaaaacatttttcaaaggctgatcagtttaaaatgtgactgacactgaaatgctgtgatgtcccccaggctgaggggaanctaggctntggggcccccantgctttgcccctntgtctgccctgtcctggggngatggacaaacanatgaccacnggcngnaaantctganattggaagcctctagctgagccctctgncntngncccacatccctnacctntgnagcctgggtgcctgcctccatntcntgttcattctcanctggcctgccagganccaanggggagcctggcgggaggcgggnggtgcctagaagctttcaagaagtgagagcaccaaccctgaaggaagtggacagggaccaggaagttgnggaagggaaggccaaggaagaggtggatacaggagacacttctcatctcatctcagaccctaagaagggtccacagatggggacacaagacccagccagcccantggattg

SEQ ID NO: 543574 - DNA, 399 bp, Homo sapiens
acctagaggatcccggctcatgagtagagaggtagtgaagtcagtaaaaagtttacagtatatataatcagctttgtttaggctgaactttgtttaattgagagtttggtgcaatttataatattgtttcattgattttctttcttattgcatcttatatggactgtcgtaacattctgtgagtatatttggtccatgtcatccatatggggtgtacagtaattacaaaaatgaatttaaagtagggacaggagcttgacatatgtaatcgggtttaatgtaccagaagatccatcagagactgagtagccaaacttgtaacaacctgtatgggtgcatattctgccagactatgaattttcttaagtaatagagaacagaggtctttacagagctggt

SEQ ID NO: 543575 - DNA, 152 bp, Homo sapiens
taaatgccttttttggccaaaggcttagttgtgaaaaaaataatttttaaattaaacattcaaggtagtggccaaatgtaacccctcaatcatggaatgatttttttgctaacacccgcctgtatgtttcaataaatttgtccaaagcccca

SEQ ID NO: 543576 - DNA, 282 bp, Homo sapiens
tcggaccggatagagcggtctcatacatacaactggtcaatagggacatgaaatcatgcctggcatcaccagtcatcagggaaatgtaaatcaaaaccacactgagatatcacctcacacctgttagagtggctattgccaaaaagaaaagagatagcaagggaacccttgggcattttttttttggggaatgtaagtgggtgcagccactatggaaaatagtatggattttcctcaaaaaattaaaatagaactaccctaaggtccagcattagaccgctc

SEQ ID NO: 543577 - DNA, 134 bp, Homo sapiens
ggcacgagggccactcagccaggcgggaagcgctggtgttgcggcgctggcgacagtcggggttgcgagcggtccttattcggtggttaaaaacataccttgaggcgagcagaaaaattaaattttaaccatga

SEQ ID NO: 543578 - DNA, 1303 bp, Homo sapiens
gcccgtgaccagtgttgtgcgagctcgtctactggttctctgcggtactggggatattcgtgaggcttggctggcagctggccagtccgtcctgacttcgctgggaatgtctgcacgggactatcgcgtactatagtagacgcgagaagacggggctaccaacgatgccgaggcgaacgcctcgctggacgtactgtattcggagagcgcaaatgagcatgtacattgtcgacaaaattgcgtgggcttacgcacgcatggggcaactattgccgtcacacctctgtctcacttactctaccatagacgaatgggccgcaacgcaacagaggactcgaccgcatgtatgcgaattgacctattgcttgactgccgtatcggttcggcagtcggcgacaggcagcaacgcaatcgctgactgcggctggaatgaagagtgtatacgcacagctaaaacacgaatgtccgaagcttggagacacctcacttatgcactgaatccacagagctaacccttggcaccttccccccgggcagcagcacaccgttggacctacatcgggcccttccgtgggcttcacacgactggcgttccccttgaacacgagcgggacgacaccacgacttgtcgggagccgccccatccgagctcacacgtagtggggatacgtaagacgtaggcgcctgtgagaccaacactagttgcagagaaccagatgttaccttcccacatgggtaatacatcgcgagcgcacagattacctcacatttgccctcttctggccaggacgggcatacaagggccttcgacccctactacgactggcagaactatatccacggccaaccgcttatgtcgacttgctccctctgccgaatccattggatatcaccgctaatacgcttacgacccctcaaaagatatcgcccttggctcttgaaactttcagccaagcaaactcgtatgccatctagtctcacacactgctcggccacgtccacctgaacacggtctaatagcacggacacaactcccgcatgacctcttacaccttcaccagggcccttgacgccaaccccggccagcccacaaaactgacccacattcagacacagcacgagcgaccgagccccaaacagggagggaaaacaacgccacaaaaaccgacgcgcactccagcgacgcccaagacaccgcacaccaaaccactagaaaccgggacagcacccctgaccccgcccacggcgccccaagcagcacccagcaacatcagacccccacccaaccggaccatccacaaca

SEQ ID NO: 543579 - DNA, 391 bp, Homo sapiens
  misc_feature (192)..(192): n is a, c, g, or t
aaacacacacaccccctgacccccagagaggggggaggtcacttctgtaggccccattcacgcaggagttggaccaatgcctaatgcaaaagccttggcaattttcagggaataggatcgagctagaagctgaaaactaacacagcacccggtccggctacaaacacctacaagttttttttttccaagaanatatcgtacctcaggatctactcttgagctccatgggagacctttattaggctgagatcccaaaagccttgtgtggtttgctctggtggctgttctgtggcttgctgttggggtatttcttacccccttcgagttgaaatttaaatgatttacaaatcaaaggttacttcctcactttcaactcttattcttcttccac

SEQ ID NO: 543580 - DNA, 191 bp, Homo sapiens
atatatctgatggagagtctgcagtttctcctgttcacatctttgtgacggtttatggaactcgagtctttttatggttgaaaaagtttcatcaggctgtagtgcactgactctctgaaaaacacttatggaaatgtttttgtgtagcacattttaggaaatgtaaacttttcatccccaaagtaatagtg

SEQ ID NO: 543581 - DNA, 149 bp, Homo sapiens
gactcatataccagactccttgcagcttgagcattgggtttatgcattcagctctatgcatcatgggtacctgaggtacctgccagagaaatggaaccagaagtaagtcatgggagaagatgactgcattaggaatccgttcttctgtc

SEQ ID NO: 543582 - DNA, 192 bp, Homo sapiens
cttcctaaggaagaatgaatgggccaggcctgaagccaggtcccaactctttatacccaggggaatggataccaagggcccagaaaacgcccccaacttgttggggttcacacgcgtcctgagacatatgggaactgcctctgaatgggccaaagatattccattaaaacgttagaacagagcttagaaata

SEQ ID NO: 543583 - DNA, 206 bp, Homo sapiens
cagtaaaattggtttcactattctgagttccataaatttggcatgtggcttttaggagcatcttgtcagtttccaaacaacaacaacaacaacaacaaaactgtggggaatgtgtataggaattttattgaatttgtacatcaattttaggagtattatcttagcaatattattattattattttttgaaccggcggtgcggcgtg

SEQ ID NO: 543584 - DNA, 124 bp, Homo sapiens
acgcatgcatggtcagtgtggcattgttgctgggatgtagactattctggcggtagtcgggcacgtgctgcaggctgaactggggtcgtagcgggcgctcaatcccatggtgcagcgttccaca

SEQ ID NO: 543585 - DNA, 1720 bp, Homo sapiens
  misc_feature (1066)..(1066): n is a, c, g, or t
  misc_feature (1139)..(1139): n is a, c, g, or t
  misc_feature (1430)..(1430): n is a, c, g, or t
agttgtttggttgtgtgtcatgcttgttgataataggtggcttcattttgtgtgtcgcatggcgggtctcggtgttagggctacgcttcttctagtgaggtcttttttcgcgggatgggcccttggtggttggtccgcgtcgttgtaccctttgttggtgttcggtgttttgtttcaccccggggggtttttgtggatcacccgagcgtgctcttggtgtacgagagtgtggtaggccggtgtgttgtgggcctttctccagtataaatatccgccgggggacatcttttcgcggggagtcttggtggtgttattcccgcgccgcgggtttgagatggggggcgctttcaacaacgcttttatgggggttaagtatgtgcttccataagatcgccgctttttgttatgttgttgtgtcactccaccccctctgattagagttttttataaacgggggtgggcgtttgtcgctatgatccacaaggactgtaggcacacctatgcaccggtgttatcatcatggggggggggcgttggtgacgactgttctctttccgggggaataacacgggggtttgctgtttgggcgcagggcgggcggctggttctcacacccgttgaagggaggtgttttctacagcgaggtgacccccaccatggccgtaggctgtcggccgtgtcgccgcgtgtatgagagagaaaggattggtgaaattaattgttcgttatgcgcgcgtcgaattagcgtgttcatcgcacacgcgcgaacccactgtttgggtgggggaagactgctgtggtaaaaggttgcggctgtttggggccgagcgagatattgttccacggaggcccgacccgcttttccaccgtttaaatcttgtttatgatagcggcgttttaagagaggaatttgtttttaccctccttgttgggtgtctctccgctggagagttcggcactgctttttttagattaaaagggttttgaacacacacgggagattttccacacactctcggagaagagacttttgtttggttataaacgtgtgtctagacacggggcncgcgccactctcggtttaatagccctcgggaaacgctctcttttgtgtctgttctcagcgcccttattacacncgggggatactcctgtgtgtgtgttggagacggtctctctcagagatatctcacactctcagacgacgcacacacatgtgtttgtggtaacactgtcgtggcctgttttgtctctgtgtctgtcacacagacacacacgctcttgattgaaagagtgcaccagtgttctcaaaagagaataataaggggtgtcccacacagagtttttataacacccagaaagaggtggccacactctgtgtgtggcgctctccttggtagagtattatgatagagacctaatgacactgnggcgaacgaccattagaaataccagaccaaataaagagtaccagtaatgttgtacatttttttctttggtggtacaatcttaaattaccaaccccttaagttgcccacggtgtgccaccttacgtacgtcttcccaggtatgtctttattacatcttcccaggatgtcacagccatcttttaacacgtttcacagtcctatgtttgctttctcccctttttaagagatggtaagttaactgggattgatttactggatgaaattataatgccagatatcctgtttttgga

SEQ ID NO: 543586 - DNA, 208 bp, Homo sapiens
  misc_feature (32)..(32): n is a, c, g, or t
  misc_feature (50)..(50): n is a, c, g, or t
  misc_feature (177)..(177): n is a, c, g, or t
attccactgctagactgtcacgcggcatgatntaccgcacattcccccgngagccagcacgctcccatgaaaacagcaccgtgcatttgcatcgcccaggtcgcccaacccctgggcgtgaccaaggacaccgtgtatggctgacgcgagccacaccgccttggatctgtgtaggcnacccaccgtgtccgcagtgcacgcatgaatc

SEQ ID NO: 543587 - DNA, 857 bp, Homo sapiens
ctagtggccccccggtaggggctaggggtccgtcccgacaaaatggctcgtcgtttgcgggtgctctttgcgtgtgttggtgaacgccagcgcgaggtctctgctgtgtgagtgggctgtccaatcaaaggcatgagtatcccaccggtgtcgtgagcgatccgccaaccaagacaccatgtggggtgaagccggggctatctaccaccgcggagtacacttgttcgttgccggaggcactttggtcagcgcccgcgagtgagtgatgggtctctggtctggcttctttccgtggccccccgatgatacaggcgtgtttgccgataccacccacgccgaggtgaatggtgtacgtctggtggcccaagcaccggtgttggtctccccgtgcggtgggggggcgccccttcccgaccacagaaacaaggtttcttgtatgcggggcaccttttcttgatagttaatttcccccgcggcccgtcctaagtaggccgcttatcttcgcacgtattggtgtataaagcattaggttcgcaacggtgataatatcaacggcgtcgagaacaagctttttgtcccgaccacaccagctgtacccctcctagaaagcacaaagttcccccccgcccagcagtgataccactctggcaattgcactcccgcgagttttatgatggttgccccctactagattatcctcgacacatcggcgattttcttggcaatttgtatcctcctaaatacaagcttgatgttttccctctaattatttgtactcagacgtatagtgaacaagatgaatctctcctaattgataagtaaaaatacactcgaattcttttcgcgcccacattcaa

SEQ ID NO: 543588 - DNA, 453 bp, Homo sapiens
caaaatgggaagcaatcatgctgagacacggtctgaggaaaacagtctatgctgatacaagattaccaaagaaacgcccaatatcgtcttcctactactgtttgacattctcttgctcgccgggagcactctctggtatgcatacttgctgagatacggtctgaggtactacagtctatgctgcttcaagattaccaagaggaagttctatactcttccactactgtatcacttctatcctatccatggctgtcttcttataattctgttcttttgctcactctctttcgtcttgtatctcccttatagagtggttgtctcgcaacttctttactgatctggctctccttcgtgtctggatctcacggggggttcttgaacaactcattctcttttgtgtcgctctttttgttcctgtggaagccttctttcccagctcctccgttcctgacc

SEQ ID NO: 543589 - DNA, 402 bp, Homo sapiens
ggtcgacctagcaggatcccgttatcgaaaccctgaagagacaaaatgtctgtgactaaaattccttgtaaggactcgtgataagcttggtcttagaacgcaaggaacaataacgagtctaagtggcaatacaactactttatatacttaacccaccagagtacacaggttgaaaaagagcaaattactgggcatattgacaagagctctgtctagcctctcccccagtttatgtcacttccttctagactttcctctgactttactagagaaactgatgaagctgcttttgaaccagactatcatgaaagtgacagtgaaagtcatgtttctgtaaaagaagaggaatcttcaggacacatttctaaggacctgaaagataaaatagtggagaaagctaaa

SEQ ID NO: 543590 - DNA, 482 bp, Homo sapiens
tactggcctcgttctacaggccggcgcctgcatggcgcttctggtctctcttcaccctgtctgtgtcatggtgaatcggccttttttcttcagcctctctctcagtcactcacttcacgcgtgtccttgtcttctgctcggctgctgattgctcggcctctgtgcaattgacccccatgacatcactgagaaattggaggcacacagcccatggtgggcataggacccaaccgatgaatttgctccccagagactgtgctctcatccctgcactccctcatctctacagggtcacccatcttagggatacacctttcggtctcttcatatgccacctcagtggctcttagggctttgccaatacaactcgtgtttctgtaactctctttatatgtctgtcttggtccctctctggccattctctctctcgagcatcttcttcgcactgcctcgtccatgtgtctctacaatttttcatttgc

SEQ ID NO: 543591 - DNA, 218 bp, Homo sapiens
atcatgttggtgatccagatcactgagaaagcccagtgtatcccatgggttatctttgttggcaatggaacttttctatggcccacactttacaattctttgtcattctaacccatccttccatccttatgttttttttttttggaaatttctaaatggaaagctagcttagggccccaggtatttttttaagggttataggtggttaaccattagaa

SEQ ID NO: 543592 - DNA, 654 bp, Homo sapiens
ctcgtatgctagcacctttatccactacctatgtgaatctgtgtctatgcgggatctatggatttgccttcggtggctcagctccgatattgttagaaacattgatggaccttgttggcaccccagaggttctccagcgctgtggagatggtgaccatgtggaatgctgtcctgtccatccttggggccaccacttataaggtcggtctcaattgacatgtagtggcagactacaaatactacattactgtcgcatgtggcgtcgcccctaaatctatttcaggtatctatcgtcttcattggcatggcgcatccacttatcgccttttgcgcaaagagaccatgaacagcaacaccgagcagaacaaaggcacacgtacatgaggcagagaccagtcatagcatgtctgctggagaaagcccaaacatgacatgtttaccaaaagagcatgtcagaaattcctgcctgtgaccgcagaacaagaccaccagcatgagacgcgggacacacacgggatggcacgtcgacacacgtcccaaggtcctggaaatccacaattgggggctttgcaacgggggtaacacttggacggccagtttccatttgatcccacgggaatactcttggaacaacattattcgtatttgggccct

SEQ ID NO: 543593 - DNA, 162 bp, Homo sapiens
gctctacagactcctgagccaacttttatgtacctggcttcctaggctgtggcttgaactatatgtaaagaagccaaggagtccagatctagatcgcagagaagtaagtctcattctaaaacattgcaaactactgttagagtccaaccccaatgaagctag

SEQ ID NO: 543594 - DNA, 634 bp, Homo sapiens
  misc_feature (319)..(319): n is a, c, g, or t
ctgggatttggttaaggagtgggcaggtgccaccgtgggacactctctttccttctcctcctctctatgaaccgcctctccattcacactgactttcccgtcttaaaggtcttcagaacatcttgagaatttttgggctgggagtaaggcttgggtgtcagcataggcactgctttgggagtgacagttttgcttggagacccactgcctgctgacatgctggtatccagaacactggcacgagcaatggtggtttcaacagtggcagtgaatttgggtggtggcagtgactgttgccgcaggtatttcatgggattgnggtcattcaggaaggaggataaatttggctctgttgaatggctttcttccagaattttttggcatcttccagcggtcgagaaccggcctcactggtggggggacccctctaagtgacctgtggagggatcccctttgcttcctcctggaccggagcggtcttaatatccttatgcaggctttttttttccgctctttttttgaacaatttccttgtaggtttgaggcttttcctcttttacttggcccgtttttccgcagaccttgggaccgggcccgattcggaacagggccaaaggtttctcttctgtggaaa

SEQ ID NO: 543595 - DNA, 346 bp, Homo sapiens
ggaagaaactcaggaggctgaggaggagagagtgaaagaagaagtgccaagactttggcagttaatattgagcataaatcatagtcacttgagctggcatattggtctactatttacaagctgtggttggtttgtttgtttgtttgtttgtttgtttgttttttgagacagtgtctcgctttttctcccaggctggagtgttttggcacaatcaggggtcactgcagcttcaggtcttctggactcaagttatccacctcagcccctgttcccacccagtaggtgggactacaggggcacatcaccacacctgaactgtgttacgtctagttcgacctagacgtaa

SEQ ID NO: 543596 - DNA, 452 bp, Homo sapiens
  misc_feature (10)..(10): n is a, c, g, or t
  misc_feature (91)..(91): n is a, c, g, or t
  misc_feature (124)..(124): n is a, c, g, or t
  misc_feature (133)..(133): n is a, c, g, or t
  misc_feature (139)..(139): n is a, c, g, or t
  misc_feature (145)..(145): n is a, c, g, or t
  misc_feature (158)..(158): n is a, c, g, or t
  misc_feature (170)..(170): n is a, c, g, or t
  misc_feature (175)..(175): n is a, c, g, or t
  misc_feature (263)..(264): n is a, c, g, or t
  misc_feature (451)..(451): n is a, c, g, or t
atttaataantactaatgaataaaaatactttattttgtcaagagactgcctctcctccctctcccgctctctcttgtgggcctcctggcngttgtgtgcccctcccgggcctgcacccacagnccccgtctncttgcncaaatnactcttctttacngggagggctccntctcntttgcctgcgaatacaacttaggtataattaccgctcctttcccccatctccttccaaatacgagttcttgccctgcgttccattttnnttttttttttttttttgagacagagtctcactctgttgcccaggcgtggagtgcagtggcgcgatctcagctcactgcggctcgcgcgctcctgggttctcgccttctcctgctctcagtcttcagagtagctgggtctactggcgcccgccaccacgcccggcttgttttttgtgtttttagtggng

SEQ ID NO: 543597 - DNA, 100 bp, Homo sapiens
ggcacatgtaaagaccaaatcctcctctcgaagctcgatcttctcttgaacgctggatgtaactgtttacgaatagtgataaccacaggagaatattgta

SEQ ID NO: 543598 - DNA, 145 bp, Homo sapiens
acagtcgacactggatcgatgacagacagtgcatggagcctgataagatgagaaatatagactattctgaatgacttacataaatcacaaacactgcaggtggtgggagagacacgttacaccgattcagagatatgccatatag

SEQ ID NO: 543599 - DNA, 245 bp, Homo sapiens
gacggcatgcgccgccttgaacgggctcttcacgaggatcttggcggtctgccccgcctcgtactgcttcttgtccgtgacgagctccacggtggagacgtcgctcatcgcccacgcgatcgcatcggcgctaccgatggcgtacacggagctcgaggccgcggccatgttgcccttcgcgtccttcaccgtggcgcgcacgatgaagtagccagcgcccggggccatgagcgggcacgacgcgc

SEQ ID NO: 543600 - DNA, 179 bp, Homo sapiens
tgagatcccgatctcgggtccatacttatggagagctcaacactgcatctgttccggtctactattaaacccgctccagtaaagtgttggaagattctgatttgaagaaatctgatattgattacattgttcttgttggtgcgctcgactctaacttcatagattccacacctggattc

SEQ ID NO: 543601 - DNA, 409 bp, Homo sapiens
atgcatcaagatctgctcgatcatcaaacagacgaagcacatcaacacatgagataagatgcaacaatccacaagacaggttgtacgttctacaaatggagagttaaacacagatgaccccaccgcaggacgttcaaatgcacccatcacagcccctactgaagtagaagtaatggatgaaaccaagtgctgctgttaattcaaacgaaggaaaaggaaaaccatacagcgccacaaagtgactctggacacagacagatcctggggagatacttacatgttcatctgctgtcttgtgattaaaatcatctctgtagtgaccacgtatattatcaaggactcacctcttagaaacaaaaatgtcatactttcatacttcatgtggtggttgtcttactttctttttctt

SEQ ID NO: 543602 - DNA, 199 bp, Homo sapiens
ggcgcggttcagccgggcgacgcgctctatgtcgaaacgccctacggcttcctgacgctggagcgcttcgcgcccggcggcgacctctggctgctggcctccggcaccggcctgtcggcctacctgtcgatcctgcgcgatccggccgtctggcgcgcctatcgccgcatcgtgctggtgcacggcgtgcgcaccgcgg

SEQ ID NO: 543603 - DNA, 876 bp, Homo sapiens
  misc_feature (429)..(429): n is a, c, g, or t
ggttttacctaagcaagcctgggcaatggcgggcgccctctgctagccttgtgcgcttgcagttgatctcagactgctgtgctagcaatcagcgagattccgtgggcgtaggaccctccgagccaggaaggcactggaggagtttgcagaaatgaaagaacagagaagagaagaaggctaacctcgaaagggcacgagaagaaaagagattaccacgcccgaaagatgcattacctcctcagcacaaagcagattccaggaatatacaattcaacccttcagaaaagagcctgatccatgggagctgcaattacagaaggcaaaaggcttttaaacaccgaagacctaaagttaagcagaaggactccaccagaccttatgatgggctagcttgttccaagcgcccgttcttttcctcggtctgaaatnctaccacctattaatagaaagcaatgtcaggggccttccgagatatcaccgaagtatagaacaaccgctacaggccttggagccaacgttggcgggtggcagaaccaatcgatgagttcacagtgggccagagaggagctcagcaagagaggaatgggtgcaaatgtacactgacacatatgtttgtgccattctcttcataccataacaagtggacagtacatccattcaatgcttatcaagcaagatggtcctatttctaacaagaacattccggagtgaaatctacaaatggtccgggcacgttccgactggtccctcttgggctcttaagtgggaatttctccaacggcgtgttcaacacggctgctcgccgcaccgggcgggggtaaccccgcggcggtcccgggggaggggcacctagcctcgggaaaacgcgcttcaatg

SEQ ID NO: 543604 - DNA, 322 bp, Homo sapiens
tcctccataatgtgtgccagtgcgaggggcgtgctcagatatgcagtgtgtgtgtgtgtgtgtgtgtgtgtctgtgtgtgtgtgtgtgtgtgtgtgtgtgtatgggtacacatgtgtgtgtgtgcctgtgtgtgtgcctgtgtgtggagggtacacatgtgtgtgtgtgtgctgctgtgtgtgggggctcacatgtgtgtgtgtgtgtgcctgtgtgtgtgggcacacaatgtgtgtgtgtgtgtgcctatgtgtgtgggcacactaatagggggacaccgcgcacaaactgcgcacacgtggacatagctatcccctgtga

SEQ ID NO: 543605 - DNA, 233 bp, Homo sapiens
taaagcaggtaagctaataagcgaggccttttgcatccacagttaagttgggagtgcgaaggaacaagttctcataaggaaacgaaaagtgctactccactggacacacaaatataagaaaatggaacagccttattgctgacatggagaaagtttgaatggtctgcgtagaagatcagaacagccacaacactctcgtaggccaacgccgaatccagagcaaggccttttct

SEQ ID NO: 543606 - DNA, 260 bp, Homo sapiens
  misc_feature (153)..(153): n is a, c, g, or t
taactattgaaaggctcgtagtccaaggtcaaagcacaggctacaaggaaccaaggtgtgacacttacccccgagagtgtctcctcagttaggatttgacgttggcggatctgtatttcacgagtgcatgtttagaaagtaagcaccattcangcagacctcttccatttactaaaagtccacaacagcaactttttttgggctctggattccgtaaatccaggacttttgaagcactccgtgtgcgctctcttcgcgag

SEQ ID NO: 543607 - DNA, 390 bp, Homo sapiens
gaaaaagtgccattttcatcacatcatacaggcatactttggagacaatgcagatttggttccagatcactgcaatgaagcaaatattacaataaagcaagtcacacaaatttttttggtttcccagtgcaaataaaattttatgtttacactatcctgtagtctggtaaatgtgcaatagcattatgtctaaaaaacaatgtacataccttattttaaaatactttattgctaacatgttactggcacaaacacgaagtgagcacatgctgttggaaaaatggtgccaatagacttgttggtcacagggttgccacaaacttttaatttgtaaaaaatgcaatatcagcaaagtgcaataaagtgaagcccaataaatcgaggaaaaaa

SEQ ID NO: 543608 - DNA, 431 bp, Homo sapiens
gcttcttcaagttctgcctgcttatctgatttaataatctgaaataggattattctcccccatctggaataggattattctctattatcccagttagagacacaatgatataaacatcgctgtaagttccagatttaactttcaaatcagaattatcagtgaaccacattacatcagctttatttataactgtttcttgtcggtcctgttgcaagtgtaagaatttggttggtcagtgatcctagagtagtgtggtgtcttgtctgtaggaaacagccaaagagtggctgggtttatattataactactggaaatggtaacctttggttatggcagaagaagacctgcataagacacaactcttttatatcaactgagtaatgttgggcatgatagaagttcagaagtgtctccactgtatgagttaagtc

SEQ ID NO: 543609 - DNA, 451 bp, Homo sapiens
ctttagggaacctgtgtctgtcagatagtgtttgtgctgttcccaccttttggaacacccgaatgggaccacgaagatgatgccaacctcatgttcatcaccatgtgcttctgctggcactatctgtgtggcctcaacattgtggccgccaactattctcttggttactggcttttgactcggatgaagagacacggaaggggagaaatcattggaattcagaagctgaattcagaagacacttaccacaccgccctcttgagtggctcacatgaagaatgagccgagatgccgagggcgcagatgtcccactgcgacagctggaatgaatggaggtcattccctccacctgaatgcctgctgtgggctgaacttaaaggtctatatatttgcaccttctcattcaacacagggctggagggtctacaacaggtcgcctacagcttctgtt

SEQ ID NO: 543610 - DNA, 154 bp, Homo sapiens
agccgtagacgtgatgctcacagggagggatggagtacggtctgcaccctacatgggattcatatgaggccaccagtaaaccagtgccttttcttgtcccagaagttccaacgcttcacgctcctcgagtaaatcataactactctggtggtgg

SEQ ID NO: 543611 - DNA, 102 bp, Homo sapiens
actaggacacccaatgcctggtggctgatgcaatgccataggcacctgactgatgaaatgaaaccagaacctaaaagaccagaatggcctgaactggcaact

SEQ ID NO: 543612 - DNA, 315 bp, Homo sapiens
tcggcgtcggacttgtcgatcttgttgatcgccacgatcagcggcacacccgccgaacgggcgtgctggatcgcttccttggtctgcggcatgacgccgtcatcggcggccacgaccagcaccacgatgtcggtcagcttggcgccgcgggcacgcatcgaggtgaaggcagcatggcccggagtatccaggaagctgatcacgcccttcggcgtatccacgtggtaggcaccgatgtgctgggtgatgccgccggcttcgccggtggggaccttggtgcggcggatgtaatcccagcagcgaggtcttgccgtg

SEQ ID NO: 543613 - DNA, 954 bp, Homo sapiens
atagtagtccaaaaaacaccactcagtcagtacaagaaatcctcacccgacattttcaaattccacatggcagaggtctccagcattcaaacattgctctgttttacaagtgagaacacagtaaatatggaaggcagtaacagggatacatcacctaggtgacagcttggatgtgacgggactcttagcagtggtacagagacaggtttaagtatgtaagatctaggacgtcttctgggcatccttccatgaccagaagctagaaaactttgggaaccattatctgggaattctgaaaatctaccaagaacacggaatggcaccgatacggacccaggatcagttcagggactctgcttcctccccggtgacgaccatcaaccccaaactctcgttggactaaagttagaaataagacacagggagaaaaaaaacgcagataactgccaaccctggtatatccacaccaagccaagtgaggagtaagactatatggcactgatttatctattttttaataccctgaacttcccatattaatagcttcagaattcaaaatggtgtactgcaaaggaacccaattttaggggacactgtcagggaagaacttcagttttgatccatttatctaccatcctcatcatcgacaggcctctctttaccagatgtggaacagctcactacagaggcctgaaggaaggaaagaacaaatggtacacagcagcccagaatcagacccaagagaagagcacaagtgtagtacatggatgtggttatttcgcatccggccagcagacccctggaaaccaagttacagcaatgtcccattatcaagaaagataggttcgccagttcccacaggggtgggcaggagggtgggctgggaggcaacaatgcttttcttctcactggattctaaaataaaatttgcaagggcctgtgctgaactgtaaa

SEQ ID NO: 543614 - DNA, 148 bp, Homo sapiens
aattcctgtgctgctgctgaagctgttgctgctgaagttgctgttgctgttgtagctgctgctgctgctgctgctgaagttgctgttgctgtggcagctgctgctgctgctgaagctgctgtaaagagcccatgggctgagcgctcag

SEQ ID NO: 543615 - DNA, 371 bp, Homo sapiens
ttatagcatcctaacaggttgtcagatgctacctgggttgtgcgtgctgctccaggctgtcaggtgcgcacctgtggtgtggggtgctgctccacgatgtcagatgctcacctgtcggtgtgggtgctgctccaggctgtcggttgctcgcctggggttgtgggtgctgctccaggctgtccaatgctcacctgggtgtttgggtactgttccaggctgtcagatggtcgcctgggggtgtcggtgctgttccaggctgtcacgtgcacacctggggctacagggtgctgatccaggctgtcagaggctcacctgggcgtgggggtgctgttccaggctgtcagatgctcacctgggtgtgcgtgtgctgt

SEQ ID NO: 543616 - DNA, 115 bp, Homo sapiens
cggtcatggtgatgtgatcttatttagtccctgtgacctgtcttcagctgtcactcgaagaataccattcacatctatctcaaaggtgacttcaactctgtgggaccccacgagg

SEQ ID NO: 543617 - DNA, 375 bp, Homo sapiens
ccatatatgtggctaaggcagtgattgctggtggcacaatataaaaggctcaggaacttgaggtgcgggtgaggcccgctccacccggatgctgtagttgcagcgcaggtcagcggggtaggaccgagggtatccaggctggagatgtagcctgatgcctccgtgtacagctcgcttctgcactcagtctggcaggaatgcctgtcttcctgaagctcatagcctggacggcaggaacagaagtagcctccaacgtagttgtgacacaggtgcttggcactgtggctgggggatcctcctcccctaatttgctccgggaagcacattcatcaaggtccacagcttggtagtaggccagtgaagccttttagacct

SEQ ID NO: 543618 - DNA, 502 bp, Homo sapiens
tctagaggatctcagattgccatttcacctgtcttgtggttcagatcctctccctccaccgtgacctcacagggtatccaaggtcgtgcacggagtctccatcggactagcagtgatacttgaactgtggggtcctcagcccggtccccttcaggctccagttctctcgtgatggtgctgatgatgcgaagctcagggaagaggaacaccccttctgagctttcaaatcagaagctgctcgggcaagatggtggacgccactcaggctgatcttgggctcctcgggctgtaaaaccatcacgtagccatctaccggggggaccgaaatgcaggtggcctcgtttagacacttgattgtgctggtgattatgagtctgcgaattccgggcgtggggaacggccgggagttcaggtacgacgatgtgctgcatggccttatccaattccacaaggtcttctccctcctaggtcaataccaactggctggggtgtgataggcagg

SEQ ID NO: 543619 - DNA, 835 bp, Homo sapiens
aagtcatattttattcattatatataatctcttgaggcacactttttttaacggcaacagcacacagacaccacgtacccgcaattacccatgcgttccccgcccccttttttggagccccccaatttctgtcacaacatacgagtcctttcggtccgcaatcccgtctgccttcccccggcagccgggtcttagagcccacaaagttttttctcttgaaaaaaagctaaaccccccttaaattacccactaggtacaagaaatttccaacgcaaattcttaagcgaatttaaataactaaaattttaagacgaaatttgcaaacccttaaaattcgccattacgcaggccgaacaattaaaaggctttcttcacacacacccgaggctgagaaataactcttttcctaggacgtcaaacaaagtgaatttaaaccaacattcgaggagcaggattccccgagcccccgcgatttattacccctatacgaagcgcccatcttttcagatatccaaatatgaaaggggaattatcacccgccgtctaaattattacattttcaaaacttttaggttgagataaaaaacatttgagcgcgaatcttttaaaaagcagacttcaaaaccccagggctgttattttaagaaccctgtgaattccctgacccccggagaagatgtcgtccatttacagccccagtttacgccctttatcctacggcccgcgcgcaaatgggaagattaattgggagtgtgtcagagatggaaacccatcttgaggagaaataaaatttgtaagatgggaaactggtagaccgcaaattaccgggaggcga

SEQ ID NO: 543620 - DNA, 527 bp, Homo sapiens
  misc_feature (14)..(14): n is a, c, g, or t
  misc_feature (506)..(506): n is a, c, g, or t
cgggaaagaaaganaaaatgactagaaaacaaccagaaaacaaatataaaaattggcaggagtaagtcactgtttatcaataacaacattgaatgtaaatagaataaactcttcaataaaaagacatagagtggctgagtggattaaaaaacaaaacccactgatctgttctctacaagaaacacacttaccctatagagacacacaaagactgaaaataaagggatggaaaaagatatttcatgccattggaaaccaaaaaagagtaggagaaatgacacttatatcagacaaaatagattttaagacaaaactataagatgagacaaagaagatagttatataatgataaaatggtcagttcagcaagacaatataacaattgtgaatatatatgcacccaatactggagcactcatatatataaagcaaatattattatttctaaagagagacataggcttcagtaaaataatagctggagacttcaacagcccactttcagncgtggactgatctctagacag

SEQ ID NO: 543621 - DNA, 171 bp, Homo sapiens
gtacatgcagttcctggaccccctaatcccgcactgggtgagtgttgagatgagtagtgatcactaaggctcaggaatttgagtctagcttgaggagatataacaacgagccctttctcaaaaaattaattaaaaactacacatggttggctgagagcaggtggctcacac

SEQ ID NO: 543622 - DNA, 498 bp, Homo sapiens
ctgcatgctgctggtcgacactagagtatccccttcaactaccaccgacacacacactcgaggatgtacactacagtgtgacctagaaattcaacacccaccgacacacacactcgggatagtacactcagtgcacctagaaatacacatttctgtgaactcaaagcgaacagggtggagaagtgcacaatgcttcatagttgtagatctcagagcacactcaaagctctttaacttttgcattctgcctcaaccatctcacttctgctccccgtgtgtgtgttgaatcataataccgccccagccacactgtgacctgctggctgtgagtgctgtgttgcacctgtcttcacgctgggcaatggaattacctgggccttctagtttggtaggttgttctacggtgaagggcctgagaatctggagttctaatccggtccctggcgattctcccgctgccgatcctgggtgcacgctgggaatatctgcttgaaacgt

SEQ ID NO: 543623 - DNA, 169 bp, Homo sapiens
ccagatagggtctcactctgtcgcccaggctggagtgctgtgacgcgatctcggctcactgcaacctccgctttccgggttcaaacgattctcctggaactgctagcagtgtttaaatgattgcactgtgccagttttactctaatgctgttgcctgtcattttctttg

SEQ ID NO: 543624 - DNA, 1484 bp, Homo sapiens
  misc_feature (474)..(474): n is a, c, g, or t
  misc_feature (513)..(513): n is a, c, g, or t
  misc_feature (595)..(595): n is a, c, g, or t
  misc_feature (838)..(838): n is a, c, g, or t
  misc_feature (921)..(922): n is a, c, g, or t
  misc_feature (930)..(930): n is a, c, g, or t
  misc_feature (969)..(969): n is a, c, g, or t
  misc_feature (971)..(971): n is a, c, g, or t
  misc_feature (975)..(975): n is a, c, g, or t
  misc_feature (977)..(977): n is a, c, g, or t
  misc_feature (983)..(983): n is a, c, g, or t
  misc_feature (995)..(995): n is a, c, g, or t
  misc_feature (997)..(997): n is a, c, g, or t
  misc_feature (999)..(999): n is a, c, g, or t
  misc_feature (1001)..(1001): n is a, c, g, or t
  misc_feature (1010)..(1010): n is a, c, g, or t
  misc_feature (1012)..(1012): n is a, c, g, or t
  misc_feature (1020)..(1021): n is a, c, g, or t
  misc_feature (1031)..(1031): n is a, c, g, or t
  misc_feature (1041)..(1042): n is a, c, g, or t
  misc_feature (1046)..(1046): n is a, c, g, or t
  misc_feature (1049)..(1049): n is a, c, g, or t
  misc_feature (1056)..(1056): n is a, c, g, or t
  misc_feature (1058)..(1058): n is a, c, g, or t
  misc_feature (1071)..(1071): n is a, c, g, or t
  misc_feature (1081)..(1081): n is a, c, g, or t
  misc_feature (1083)..(1083): n is a, c, g, or t
  misc_feature (1086)..(1086): n is a, c, g, or t
  misc_feature (1089)..(1089): n is a, c, g, or t
  misc_feature (1101)..(1101): n is a, c, g, or t
  misc_feature (1119)..(1119): n is a, c, g, or t
  misc_feature (1140)..(1140): n is a, c, g, or t
  misc_feature (1142)..(1143): n is a, c, g, or t
  misc_feature (1157)..(1158): n is a, c, g, or t
  misc_feature (1160)..(1160): n is a, c, g, or t
  misc_feature (1190)..(1190): n is a, c, g, or t
  misc_feature (1225)..(1225): n is a, c, g, or t
  misc_feature (1227)..(1228): n is a, c, g, or t
  misc_feature (1234)..(1235): n is a, c, g, or t
  misc_feature (1240)..(1241): n is a, c, g, or t
  misc_feature (1250)..(1251): n is a, c, g, or t
  misc_feature (1350)..(1351): n is a, c, g, or t
  misc_feature (1357)..(1358): n is a, c, g, or t
  misc_feature (1369)..(1369): n is a, c, g, or t
  misc_feature (1371)..(1371): n is a, c, g, or t
  misc_feature (1374)..(1375): n is a, c, g, or t
  misc_feature (1426)..(1426): n is a, c, g, or t
gtgtgcgcagtttgggtcgctcttgttgtgtccacctagtgtgccttttgtcgaacagcttgcttgtgacacccctgttgttttgtgggctccgcctgatgctgctgctgtattccttgtttttccgcgctgttgttgtcgcccgacgtgttgggttcgtcctcgcgccaggacccagcgctggttctgctcccggggagaaatttttgtgtaggggaccggcccctgtgaaatggtttggcgcccgtgcagccgaggagttgtctcgggagcccgcacaacgcgtggggctgcgccgtgaagcaccgccgcgcgcgaaaagtatcaccaagtttttcccactcgttctttggggcgcacaccacgaaaatatgtgtccgccccctgtgtctaattctttctctgctcctttgtgtggaagatgctctctttctcccccgttgtggagccaagcccgtgttgtctgtggttagncccctgagtgaagttctccgcgccacataggcgtgttgnctttttttgtaagtgcccacccgcccccgactgcccacacggaagatgggtgggaaagaggatggtgggagcgcgcctcccncccacttgggttaaaaaaagccactcggccgcttgtcgtggcccctggtttggtatacgcccttggggttgaaccacttggggtgttctccaccacaagaggatggtcccacatgcggtggcgcacatttggcgccgcgccgttctcagagatctccacagcgtgcacagcacatccccacgtttttgtttggagattttggtgtggcggccccccactctgggcgtctctcacacagggttnggtgcacttctcacaaactcatgtcccacgcccgtctcgcccacactctgtttgggtgtgcccctctgggtgtgggagagacnnctctgggnccccacaggtgacacacagagagagagcctcgtgtgtgngncacncngctctngagagccacacncncncncccacgccncnctcttgtnntgagaggccnctctggggcnntccnccnctggagncncacacacgtgttngagcctcgantngtnatngccccacgcgtngccctttgtgtcacactnggtaacctgggtgaaggggantnngagaggaaaggcgnngngttttcacagagggcccgctgaaagatatnggccgccccttgaggaaaggagttattgaaggagngnnttggtnntggannttctgttgnnaaggaagaagggtgaaggaaagaaaggaagagggagataaactaattatcccattccttttggccctgccagccatgtccatagctccccagaatttcnngcttcnngcttaactgcnanganngttaagctttctggttagattgttttcacttggtgatcatagtcttttccnagtgtacccgtaatatttttcccatcatattctccaagttaagtccattaacatccca

SEQ ID NO: 543625 - DNA, 149 bp, Homo sapiens
ctgaagggttagggccccagatctgagcttgtagcatgcagatctgggacctttgaagcattggtggtatcaggggatgatggtagatccagactgttgcgagttgaccttggtcaagaattggctacgtgagaggtggttttgacaaa

SEQ ID NO: 543626 - DNA, 271 bp, Homo sapiens
aaattagccgggcgtggtcgtggcgcctgtagttccagctacttgggaggctgaggtgggagaattgcttgagcccaaacgtttgaggctgcggtaagccatgactgcactgctgcactccagacagcagcctgggtgacaaagcaagacgtttttgtcagaaagaaaaaaaaaaaagagacgaagggaggaaggtaggaaggagagagaaaggaaggaaggaaggaaggataaagaaaggaaggaaggaaggagaaagaaaggaagaaag

SEQ ID NO: 543627 - DNA, 195 bp, Homo sapiens
  misc_feature (112)..(114): n is a, c, g, or t
  misc_feature (121)..(121): n is a, c, g, or t
  misc_feature (129)..(129): n is a, c, g, or t
cctgataggcctgggggactgactccttggggaagagttccaagagcatcatgcagcaggggccggggaagccagtagggaggacatacacccacagcccccaggcccgtannnttggcgncatggacncagaggcctgctcagccacaggagaggtgctgggctctgtcccctcctcaggtctctctcaggcag

SEQ ID NO: 543628 - DNA, 175 bp, Homo sapiens
cgtggaccaggtgatgggtgcagaaggagggaggggttatctataggtgtgggtgacagacatcaagtacttaacaggataatagaatatctcagagggcaatgtggagacagggcgagaccacgggaccgaagtgaaatgtagaattgctaatgaagtttgggcggcgatcact

SEQ ID NO: 543629 - DNA, 518 bp, Homo sapiens
tcaatcacagtagttcaggtacataacaacattatctctaccagactaacagatccacacatcacagaagtataatgaactgttacactggtaccaggtctggttaagactgcaggcttatcgcacatgcctttaaagaggacacacctgacttataagctttgacacctgcacattttcagtttccatgtctcgtctttgtacaaactaactgaggtgaacattttcagagtgtcaacatctaacagaaatacagtaaatcaatatgcagttcatgtgttagactttcattcgtttatcctgtcttcatattactaacgtgcttattagttcaatctctttgcagaacagctaaatttaatcaactatgtgtggtgtaaacaggcatggacatataaagttacactggtccaactctgtcatttaccagctacagaaaccaagaccctgcaaagtataatgaaaaagctgggagccaggcagattagcattcaggtaccttagcccttcagcctcag

SEQ ID NO: 543630 - DNA, 309 bp, Homo sapiens
ggatggggggcacatctctatcgtgtcttgcctgagctgtgaaagcctcctataataggtgtgtacaaaaccgtgctcttgggcctaagggcccatttaatacttcggcatggatacagagtaaaatacagcaaaacaactctctatgaggggtagtggtcatgctggaaaacaaccagagctgggactgctcccctcctcatcctggaatgtatcacccatcctctcctccactgctttccaagaagaggactgacccctcactcttttccagaattaatccactatttctctgcgataagggttagt

SEQ ID NO: 543631 - DNA, 680 bp, Homo sapiens
  misc_feature (26)..(26): n is a, c, g, or t
gagtagatcttgggtggagctcaggnttccaagtttctgacaggttcccaggcgacttgagcgctgctggtcggcccgtgggacccattttaagaagcaagaacctagaagaggcatggccaacttttgcaggaaagggaagggcctgacagtaaatatttcaggctttgcaggccactcaacactattcctctctgcctttctggtgggaaagcagccataggcaacccagaaagcgaatgggagtgactgtgttaccagtgagaccttccttacaagcacaggcgggaggtggctggcccctgccctcggtccctgtgcaccaggttggatctggaaacgctggtgtcagtggagagttgctggcttcagagagcagtaacaagggcaagaagtcttcataagtgtaggagtgcaagcctgtgtgtttgtgtaggatgtgtgtgtgagtaggtctgtgtatgtgagttgtgtgagtgacagcgtgcatgtgagtgtgtgagcctgtgtaggtgtgtgagagtttatggatgtgtgtagtgagcatgtttatgtgagtcaatgtgtgagcgtaccaacccatatctatgagtgtgtgtctatatgtgtgtgaatctatgcatgtgtagagtgtgtctatgtgagtctatgtatgtgagtccgtgtatgagtgtagcaca

SEQ ID NO: 543632 - DNA, 112 bp, Homo sapiens
agagactgattacatcattataatggaattagtgctaacacaagatgtactcgtgatctaagtcacttactatcttgatgagaggcacttcgttggtttacaggtggattgt

SEQ ID NO: 543633 - DNA, 405 bp, Homo sapiens
  misc_feature (13)..(13): n is a, c, g, or t
  misc_feature (163)..(163): n is a, c, g, or t
  misc_feature (179)..(179): n is a, c, g, or t
  misc_feature (231)..(231): n is a, c, g, or t
  misc_feature (350)..(350): n is a, c, g, or t
  misc_feature (370)..(370): n is a, c, g, or t
  misc_feature (393)..(393): n is a, c, g, or t
  misc_feature (396)..(396): n is a, c, g, or t
gcgatgcagcctngcggcatcgttcacgttgtgcacgccgccccggggggacttttgtggtggcactgagagggcgattgaccaagcttcttttacgacctccatggagtgggatacgcaggtggtgaaggggtcctcgccgctcggccccgcagcttggggnctgaggagccagccgncgccccgcagctgccgtcttggctgcagcctgagaggtgcgctgtgttccantgcgcacagtgtcacgcatttcggacgaatcggtgcacctcggactggaacctttcgcggttccctacagggcccgtggtctttttcccagagttacaaataacgttgtttttgaaagnggcccttttcctatgttggnattttaaaggttcaatttaaaanggntagtattta

SEQ ID NO: 543634 - DNA, 299 bp, Homo sapiens
ttttataactttatttcaaattcattaaaccaaaggcagaaactgttacggagcctgactagagggttgcctcataactgaaccttcatttttggacgggaaaaaaccatggtttaaggaccatgacagaagttcggccatgtcccattataaatgatccaacatgaccagggccacaaagccaaatctgccttcgacagggacttttttaacgattccaccaactcttgaggctaagggaaatggaatttgcgtgggggccccttcttaatcccagtgcagagttacgcactgttgcc

SEQ ID NO: 543635 - DNA, 207 bp, Homo sapiens
  misc_feature (52)..(52): n is a, c, g, or t
  misc_feature (69)..(69): n is a, c, g, or t
  misc_feature (90)..(90): n is a, c, g, or t
  misc_feature (117)..(117): n is a, c, g, or t
  misc_feature (152)..(152): n is a, c, g, or t
gaggattcggcacgaggtgacccgtgccatcctgtgtctggacctggctggncgggacctgactgactncctcatgaagatcctcaccgngcgggggtacagcttcaccaccacggncgagggggaaatcgtgcgtgacattaaggagaagntgtgttacgtcgccctggtcttcgagcaagagatggacacgggtgtttccagctc

SEQ ID NO: 543636 - DNA, 1898 bp, Homo sapiens
  misc_feature (1)..(2): n is a, c, g, or t
  misc_feature (228)..(228): n is a, c, g, or t
  misc_feature (1398)..(1398): n is a, c, g, or t
  misc_feature (1783)..(1783): n is a, c, g, or t
nnttcgtcgtgttgctctgccactacgtttcgttcttgtcgtctggtacacttaactatgctgtttgttgtgttctgcttcacccgctccgctctcctggttgttgttatagtagtgctcgtgcccctgggagggtacgcacgattcacagttgtgtttggttgtgtcagtcagttgctccgcccccttcctgcaatggtggtggtagttctctcctttcttggcgcncacacccaaatgatcaggggaggccttcttttttatgtgctggttggtgtacaaccatcgtagttggtgttggtgtggacgatgcttcgttcccccgcaacatagtgggggggttgcgcccccctccaccgaccatcgcccgtatggtttggtgtggccccacctgtcggagcactaggtaggttctttccggacggcctctctctttctgttgtggttgtataaaccactgtcgtggttctcgcgcgccgctcccatcagcactgcgtgaagtggtgttttttcctagaggcggccgggttgtcccccctttgttgacaggcggtgtgtgggtagcctgctaccgcccccgccccgtcggttgtgttgttgtgtggcgtgtggacgaaattttttttctggtggggttgcaacctcaccttcgacgatgggcggtgtgtttttcaggcgctagcctgcgctccccccacctcggcggtgattgttttctaagcgggcgggtacagtgttcctcattggtgtgccccaaacattgtggtgactacccccccgtggcgcccccaatctacgtccccgacgtggcctgacgcgttcgtctttgttggctgcgggtgtggttcaccaacaacacgggaggttgttgttgttggtcggtggtggttcgtggtcgcgcgtcgtcggtgcaggggagcgctggccggcaaccacgacgaggggggggcgcagacgtcgcggcggcgcgtcgcgcgtcgatgatgcacgaggacgacgaggaggagagacggtcgtcctcgtcgaagagcgactactcgttgtgggtggtggtagtagttgaagaataattggttggtggagtaggtggtcaacaacacgataaatacgccttctcttgtaggaggcgaacaccatttttttgatgaattactctgcaaaaataagaagcatcctccggggacgacaaccacaacaacaaggggtgtccccacctaggggggagacccaccctactccctctcacgggagtgttgttgcgagatgcgcgtcctagtagacactcggagatgatataatacacacatctctgtgtgattatctcccctcgcggagcagagagagtgtgtggacacactcagcagagaggagaccccacgcagcgagatgacactcggngatgacacagcagcagcgggactacagctcgcgctcgcagaggagatgtgcagaatggtacacagagagacacatattctgggagatatgtgttactctctgtctattccgacgaggccatgtgttctgtcgcgctgctgtgcgagacctcacgcatagcgcgttgtgtcgacgacgacctctggtttacacacacagctgagagagcacacacaagtcttcacacatacataatggcgcatatattcgcggcgcaccacgtgcacacatagtgcacagagagcatcagaggcgagttgacgcccgcgcgccacacgcgggagcctctgtgtcacgcagcgagacgacccgcgggttcttcaggcccacacataaattgtgtctncacagaatcttccacaggcatagttacgtatatatcggatattttctatgagccactccttgagccatgcatgagaacaccaaggtttaatggaaaattaacaatcgggctctca

SEQ ID NO: 543637 - DNA, 254 bp, Homo sapiens
gtgtggctggggaggagatgcaaaaataggacttaggtagagccgtgggctcatgacctgacaggaccacaacaatggaggcagcagcccatctccgcaggcattgactaacaaactccttcccccgggaggacgttttcttgaaacacttcctgaaaggagggcagtttatgcctcatgcttgaaatatgttccttgttacgtgtaacacccacagtcacgggggtaccgaggctcggaattccgtaattcat

SEQ ID NO: 543638 - DNA, 225 bp, Homo sapiens
gaattcactagtaatattactagtgaatcactagtaatattactagtgaattcactataatattactagtgaattcactagtaatgcgggcgcctgtagtcccagctactcgggaggctgaggcaggagaatggcgtgaacccgggaagcggagcttgcagtgagccgagattgcgccactgcactccgcagtccggcctgggcgacagagcgagactccgtctc

SEQ ID NO: 543639 - DNA, 132 bp, Homo sapiens
acctccctccaataaattcacttacacctcctgccttgtagttctggtattcactttactatgtgataaggtagcatgttgctgccagaatacaggcattgctttgggcaaattaaagtgcatgtcatttct

SEQ ID NO: 543640 - DNA, 3018 bp, Homo sapiens
tttttttaaccaaaaggtaaataatgcttatttctgcttcctgttttcttggcttgactaattacttttaatggagaactcaatttaactttgttcttttttctactctttaattaaagggtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaagtaactatttgacatgcctatgtatttaatgtatacttgtaactatcaaaatgaatagttcatttttgatagatttgttgtgcagccattatgaattaaatggtttattaggagtttgactaaatttttatttttagtgtgtatagcatgaatactaccaaaggagacgacaaacttgcagcttaaaatgggcaccagttcccacactggcttaatttatataactgcttggctgtattgcgggtaataatattagaagcaagaagcacttcatttttaaaagagatgttactataatattgcttaaatgctttagcacttggacttcttgagatgcagatgtgtgatttggagtgctggcttatttaaaggtcaagccaaggagtttgtggttcagccacaactactgtttcctaagactattgatgtgaaggacttagtgaagtaatttttatattctgggcttcccagcaagatgtcctttttatgactgccatgcttcttttggactcagtaaatatttgtaatgttagaaaagtctcattatttttataaaatgcatgacattttaagtatgtgttgcataaaatggattatagcagttctcatggtttaggatttttaagaaatagtccatttaatttcagcttaaccttttaaatgatctgtaaaatttctttgatagtttaggaatgttgtggggagggttcattaataaaagttcagcaattttttaactgaaatagtttatctcttttacctagtcacaaaaaaggtatgtaaacaaggccattatatgtgtttattgctctttatttccctatctagattttctaagtatcttagctttcttaatataagtttaacttggtacttactgaaaatgcctttttacccctgttaacggtattttgagcttttgaaaagaacttggttgacactgcttttattgtggataaaggagagatggtcagtaattaatggcttgaagtattattggagtggtttatcatttctgaaactaatcgtgtcagaattgactttgaaaagcattgctttttacagaaatatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 543641 - DNA, 373 bp, Homo sapiens
ggatcctgagtcatcccccttcgtctcgccatcgatcgtacttcttcttcttccacctcagccacttcttcctcctccgctacttctactactttgtcttcaatcccaaattggatatgagtggggtctgctccgccccaacagacatccgagtcatcctcctccgcatcagcagaatccacattgtcactttcttcagccagtgggcaacacacaaactctacccctcggaacttgtcaattccgcagggcagcaacatgccgtagtcatgcaagttggtactcttctcactgcatgtctctttggcgacggtgtgccagtgaagatgagtttcgcaaacatccatcctctcctggtgtaagaatttgcact

SEQ ID NO: 543642 - DNA, 869 bp, Homo sapiens
ctgatcggtgttgccttaccgtttgtgaagacctgtcccagcgttgccaatcaatcacagccccccatctgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagccccagcaaaaggagaagaagaaaaccgaaaaaagatcgcccatcttgtgggcgcagttgggtttaaaggaggtattacc

SEQ ID NO: 543643 - DNA, 2502 bp, Homo sapiens
  misc_feature (1)..(1): n is a, c, g, or t
  misc_feature (5)..(5): n is a, c, g, or t
  misc_feature (18)..(18): n is a, c, g, or t
  misc_feature (20)..(20): n is a, c, g, or t
  misc_feature (68)..(68): n is a, c, g, or t
nccanctccatgcctgcngncgctctagaggatccccccttccaacatctcatttctgcatctcaagnaagcacttcatttttaaaagagatgttactataatattgcttaaatgctttagcacttggacttcttgagatgcagatgtgtgatttggagtgctggcttatttaaaggtcaagccaaggagtttgtggttcagccacaactactgtttcctaagactattgatgtgaaggacttagtgaagtaatttttatattctgggcttcccagcaagatgtcctttttatgactgccatgcttcttttggactcagtaaatatttgtaatgttagaaaagtctcattatttttataaaatgcatgacattttaagtatgtgttgcataaaatggattatagcagttctcatggtttaggatttttaagaaatagtccatttaatttcagcttaaccttttaaatgatctgtaaaatttctttgatagtttaggaatgttgtggggagggttcattaataaaagttcagcaattttttaactgaaatagtttatctcttttacctagtcacaaaaaaggtatgtaaacaaggccattatatgtgtttattgctctttatttccctatctagattttctaagtatcttagctttcttaatataagtttaacttggtacttactgaaaatgcctttttacccctgttaacggtattttgagcttttgaaaagaacttggttgacactgcttttattgtggataaaggagagatggtcagtaattaatggcttgaagtattattggagtggtttatcatttctgaaactaatcgtgtcagaattgactttgaaaagcattgctttttacagaaatatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 543644 - DNA, 458 bp, Homo sapiens
ttttttttttctcagttaaatgtttattttgccaaggttggggacatgtgtccgtgacagcctcaggaagtcctgaagacctgtgcccaaggtggttggggtacagcttagttttatacattttagggaggcatgagacatcaatcaatatatgtaagaagtacattggttcagtctggaaaggcaggaagacttgaagtggggaggaggcttccaggtcacagataggtgatacacaaatggttacattcttttgagattctgttagcctttccaaaggaggcaatcagatatgcatctatctcagtgagcacaggggtgactttgaatagaatgggaggcagctttgccctaagcagttcccagcttgactattccctttagcttagtgatttgggggccccagctttaatttcctttcatatttcccccctttcttttcaaaaatcttttggaga

SEQ ID NO: 543645 - DNA, 92 bp, Homo sapiens
ccccccccccccgggggggatttggggcttttttccttttttttgggggaattttttttggggggtttaaaattaaaagggcccccctttta

SEQ ID NO: 543646 - DNA, 1106 bp, Homo sapiens
ctgatcggtgttgccttaccgtttgtgaagacctgtcccagcgttgccaatcaatcacagccccccatctgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttcgccatgtcagcgtattagcattcgcacgtgacatggatgacagtagtgccgaagttgatcgctgcgctgcgacgagctggccagggccggtgagttgccggcgctagatacgtcgtgttcgcgtccaatatgctgcaggtggtcatccatgtgtggcaggcgacctctagctcaacttcccatgatagtggatggcacggaccgttcaaacaaacgagactgagtaaggcgtcaatgggactgatggcaggcaattccgatcagaagcaattgactccttgcggaaggaatacaatagcaaccctggccttcagcagcgtcgcaggaatcgcgctacgtgccaatgggctgccatgtgggtgcaaagcgccagtcaactcgacagccagctgcgatcaccgcgcgtgatgggacgtgctcgaacagcggcgaatttgcgggcagccgcgcgggcgactgggtgaaagactgacgaggagcttgtagggaatgttgtacccagcccgttgcgccgcgtggttgagagccaagggcaccatcttgaggctggctggtgggcacagggcagcgtcagtgaagcggcttggcctatcgcgggacacatttaaaggaacccatttggcttgaagtggctcttggagcaggattgaagcgtcgatccaattggcgtggccaaagggggcttcccttctgaagcttccttatagccatttacacgcaaggaacgcgaccgaaggctgggaaggctgttgtgtgcccaacgtcacaaacctggctggatttttcaccaagtcttggatggcacgaagtagaagctggtcttggcgcttagggagcaaggccccaaggccaaaacacaacacagcacacgggggg

SEQ ID NO: 543647 - DNA, 4878 bp, Homo sapiens
  misc_feature (81)..(81): n is a, c, g, or t
  misc_feature (420)..(420): n is a, c, g, or t
  misc_feature (423)..(423): n is a, c, g, or t
gggacccgaatagggtccacagccctgtgttcttcgaatactgtaaagcagccctgctccagattccttgagggtcacttnatattacacattcgtccacacaggacaacaaagtcaccacttccacccgccaaagcgcgctcaggtcggccgccacttcccttggtacacgcggaacgcaagccgcgccgaggctaaaggaagaggccggaatgcagggcgaaggggcgcagagatgctagccaatgctgccacctctattttgggtataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagngcngaggcgcggcctggagggactagttggcgcgcggctgcccggcgtggtgacgtcagggcggaagcgcacgcaggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctgggtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaagtaactatttgacatgcctatgtatttaatgtatacttgtaactatcaaaatgaatagttcatttttgatagatttgttgtgcagccattatgaattaaatggtttattaggagtttgactaaatttttatttttagtgtgtatagcatgaatactaccaaaggagacgacaaacttgcagcttaaaatgggcaccagttcccacactggcttaatttatataactgcttggctgtattgcgggtaataatattagaagcaagaagcacttcatttttaaaagagatgttactataatattgcttaaatgctttagcacttggacttcttgagatgcagatgtgtgatttggagtgctggcttatttaaaggtcaagccaaggagtttgtggttcagccacaactactgtttcctaagactattgatgtgaaggacttagtgaagtaatttttatattctgggcttcccagcaagatgtcctttttatgactgccatgcttcttttggactcagtaaatatttgtaatgttagaaaagtctcattatttttataaaatgcatgacattttaagtatgtgttgcataaaatggattatagcagttctcatggtttaggatttttaagaaatagtccatttaatttcagcttaaccttttaaatgatctgtaaaatttctttgatagtttaggaatgttgtggggagggttcattaataaaagttcagcaattttttaactgaaatagtttatctcttttacctagtcacaaaaaaggtatgtaaacaaggccattatatgtgtttattgctctttatttccctatctagattttctaagtatcttagctttcttaatataagtttaacttggtacttactgaaaatgcctttttacccctgttaacggtattttgagcttttgaaaagaacttggttgacactgcttttattgtggataaaggagagatggtcagtaattaatggcttgaagtattattggagtggtttatcatttctgaaactaatcgtgtcagaattgactttgaaaagcattgctttttacagaaatatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacagtaagtaaatgttttcttagggaagcagtcttatttggagtttttaaaggttattgctttttctttaaaaattgaacatagattattttcaaagttaggttagaattaggcttttagtatgaggcaaattatgagaaatgagtttggagatgttctggacatacagtatcttaatggcattctgttatattttctcccatgttttttggagaagtgtaggagctacccacaaagtgcttgagggccatagtattgttcataatgtgaaaacttctttttttttttaatttcagttagaaaatgtgtttcattaaccccttattaataaccaataatcaaattaaccagtcaatgaatcttctttagttaggcctgtaattagattgttagctcttcgtggctcttcaatgtcttttgaacatgtgggagatacttaataaaaagcatagctctaggacactataaaaattgctaattactccccttggaataaagacataagaacatttgcttaagatttaatatgttatatataggcttgggcatacagcagtgaggggtggggagattttgaaaagttctggtttgtcatttatgtagctggtagttttgttttgaacctgttatgagcaaccaccggaataatctgttccccatagaaactgaacctaaacttcaaatttttattatctaagctataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 543648 - DNA, 839 bp, Homo sapiens
  misc_feature (799)..(799): n is a, c, g, or t
  misc_feature (801)..(801): n is a, c, g, or t
  misc_feature (807)..(807): n is a, c, g, or t
  misc_feature (812)..(812): n is a, c, g, or t
ctgatcggtgttgccttaccgtttgtgaagacctgtcccagcgttgccaatcaatcacagccccccatctgaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcaattccagcccnanagaaanaaaanaaaccagactagttctctctctctctc

SEQ ID NO: 543649 - DNA, 4434 bp, Homo sapiens
  misc_feature (81)..(81): n is a, c, g, or t
  misc_feature (420)..(420): n is a, c, g, or t
  misc_feature (423)..(423): n is a, c, g, or t
gggacccgaatagggtccacagccctgtgttcttcgaatactgtaaagcagccctgctccagattccttgagggtcacttnatattacacattcgtccacacaggacaacaaagtcaccacttccacccgccaaagcgcgctcaggtcggccgccacttcccttggtacacgcggaacgcaagccgcgccgaggctaaaggaagaggccggaatgcagggcgaaggggcgcagagatgctagccaatgctgccacctctattttgggtataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagngcngaggcgcggcctggagggactagttggcgcgcggctgcccggcgtggtgacgtcagggcggaagcgcacgcaggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctgggtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaagtaactatttgacatgcctatgtatttaatgtatacttgtaactatcaaaatgaatagttcatttttgatagatttgttgtgcagccattatgaattaaatggtttattaggagtttgactaaatttttatttttagtgtgtatagcatgaatactaccaaaggagacgacaaacttgcagcttaaaatgggcaccagttcccacactggcttaatttatataactgcttggctgtattgcgggtaataatattagaagcaagaagcacttcatttttaaaagagatgttactataatattgcttaaatgctttagcacttggacttcttgagatgcagatgtgtgatttggagtgctggcttatttaaaggtcaagccaaggagtttgtggttcagccacaactactgtttcctaagactattgatgtgaaggacttagtgaagtaatttttatattctgggcttcccagcaagatgtcctttttatgactgccatgcttcttttggactcagtaaatatttgtaatgttagaaaagtctcattatttttataaaatgcatgacattttaagtatgtgttgcataaaatggattatagcagttctcatggtttaggatttttaagaaatagtccatttaatttcagcttaaccttttaaatgatctgtaaaatttctttgatagtttaggaatgttgtggggagggttcattaataaaagttcagcaattttttaactgaaatagtttatctcttttacctagtcacaaaaaaggtatgtaaacaaggccattatatgtgtttattgctctttatttccctatctagattttctaagtatcttagctttcttaatataagtttaacttggtacttactgaaaatgcctttttacccctgttaacggtattttgagcttttgaaaagaacttggttgacactgcttttattgtggataaaggagagatggtcagtaattaatggcttgaagtattattggagtggtttatcatttctgaaactaatcgtgtcagaattgactttgaaaagcattgctttttacagaaatatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttctaaactgcttcaaataccttatttaaataaattattaaaaaggaaaattttaatagcaaaatggctgtactggttttctgacaaacttattctttcctccattagatggtagtttgagattattaaaatgcaattcttaactgcattgtgagctattgtaagtcttcactgtatatatggaaaaagtaaatgggagtcgcccaacaatgtgacattaaatgttatattttagcactaaaccaaaaaaaaaaaa

SEQ ID NO: 543650 - DNA, 731 bp, Homo sapiens
tacaagtcccatctgtctagatgcgagtggaacgcgccagcgtggagaaccagaattcagttttggagtgagccgtattgcgatcatgacttcctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagccccagcaaaaggagaagaagaaaaccgaaaaaagatcgcccatcttgtgggcgcagttgggtttaaaggaggtattacc

SEQ ID NO: 543651 - DNA, 4824 bp, Homo sapiens
  misc_feature (81)..(81): n is a, c, g, or t
  misc_feature (420)..(420): n is a, c, g, or t
  misc_feature (423)..(423): n is a, c, g, or t
gggacccgaatagggtccacagccctgtgttcttcgaatactgtaaagcagccctgctccagattccttgagggtcacttnatattacacattcgtccacacaggacaacaaagtcaccacttccacccgccaaagcgcgctcaggtcggccgccacttcccttggtacacgcggaacgcaagccgcgccgaggctaaaggaagaggccggaatgcagggcgaaggggcgcagagatgctagccaatgctgccacctctattttgggtataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagngcngaggcgcggcctggagggactagttggcgcgcggctgcccggcgtggtgacgtcagggcggaagcgcacgcaggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctgggtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaagtaactatttgacatgcctatgtatttaatgtatacttgtaactatcaaaatgaatagttcatttttgatagatttgttgtgcagccattatgaattaaatggtttattaggagtttgactaaatttttatttttagtgtgtatagcatgaatactaccaaaggagacgacaaacttgcagcttaaaatgggcaccagttcccacactggcttaatttatataactgcttggctgtattgcgggtaataatattagaagcaagaagcacttcatttttaaaagagatgttactataatattgcttaaatgctttagcacttggacttcttgagatgcagatgtgtgatttggagtgctggcttatttaaaggtcaagccaaggagtttgtggttcagccacaactactgtttcctaagactattgatgtgaaggacttagtgaagtaatttttatattctgggcttcccagcaagatgtcctttttatgactgccatgcttcttttggactcagtaaatatttgtaatgttagaaaagtctcattatttttataaaatgcatgacattttaagtatgtgttgcataaaatggattatagcagttctcatggtttaggatttttaagaaatagtccatttaatttcagcttaaccttttaaatgatctgtaaaatttctttgatagtttaggaatgttgtggggagggttcattaataaaagttcagcaattttttaactgaaatagtttatctcttttacctagtcacaaaaaaggtatgtaaacaaggccattatatgtgtttattgctctttatttccctatctagattttctaagtatcttagctttcttaatataagtttaacttggtacttactgaaaatgcctttttacccctgttaacggtattttgagcttttgaaaagaacttggttgacactgcttttattgtggataaaggagagatggtcagtaattaatggcttgaagtattattggagtggtttatcatttctgaaactaatcgtgtcagaattgactttgaaaagcattgctttttacagaaatatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaacacgatcacgttctagatcacatactccaagaagacagtaagtaaatgttttcttagggaagcagtcttatttggagtttttaaaggttattgctttttctttaaaaattgaacatagattattttcaaagttaggttagaattaggcttttagtatgaggcaaattatgagaaatgagtttggagatgttctggacatacagtatcttaatggcattctgttatattttctcccatgttttttggagaagtgtaggagctacccacaaagtgcttgagggccatagtattgttcataatgtgaaaacttctttttttttttaatttcagttagaaaatgtgtttcattaaccccttattaataaccaataatcaaattaaccagtcaatgaatcttctttagttaggcctgtaattagattgttagctcttcgtggctcttcaatgtcttttgaacatgtgggagatacttaataaaaagcatagctctaggacactataaaaattgctaattactccccttggaataaagacataagaacatttgcttaagatttaatatgttatatataggcttgggcatacagcagtgaggggtggggagattttgaaaagttctggtttgtcatttatgtagctggtagttttgttttgaacctgttatgagcaaccaccggaataatctgttccccatagaaactgaacctaaacttcaaatttttattatctaagctataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 543652 - DNA, 563 bp, Homo sapiens
ggccgggcgcggtggctcacgcctgtaatcccagctctcagggaggctaagaggcgggaggatagcttgagcccaggagttcgagacctgcctgggcaatatagcgagaccccggttctccagaaaaacggaaaaacaaaaacaaaaaacaaaaaaaaaacaaaacgtgtgtgtgcggcgcgcgcccttgggcccccgcgaagaagctttccaaaacacacattgcgcggtgggggcgcgcggggggcccaccggggggcaacggtgaacacaggggcgcccaataagcgcgtggggtcccataaggcgcagacacctgggggccaagcgagacaaagggggcgggggggactccacacacacaaatataaaaagagcgccgcgggggagaaacacagggagggcgcgtctcgtggaacacaactctcacagaagtggggaggtccgaggagggggaccacataacggggagagctcatatcacacacagaggggaggctcacaaggcgagaggcccggaatattccaatatataaccgccccgggcaccggggggggagcgt

SEQ ID NO: 543653 - DNA, 237 bp, Homo sapiens
cggcttgaatagtttgcaatgagatcttaacaagtccgtgctcgcacagaaactcgagtctatactaatagccttgagttctttagtaactcatgtatccatcttgcaaaaggatcttctggttgctattcgaatgagattctcggagcaagttacacgatatggacatgtctcgagagctattggagacacatcaagtattcacgttagaaccaaggaaatatatgaattctggtg

SEQ ID NO: 543654 - DNA, 822 bp, Homo sapiens
ggttccccgtatctgattgacactctcaggctgtgttctctcggattctcgtatggaagcacagccggcctgagggaggtcggcttcagacgccaagacttcagcgtttcgtttgggaatgtggagcagccgtatgatgtgccatatcgaagtccactgttgtgcctgctcgcagttactgttgtgagtgatgagaaaatctcatgccaaggtgctgtcctcagagttcagggtgggatgcctatgaccagcgttgcgggaagtgcagttgtccctattgtgtgcgcggctcaataacgtttcatgtatgatacatcgggcgccccaacgagcgctaacgttcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagccccagcaaaaggagaagaagaaaaccgaaaaaagatcgcccatcttgtgggcgcagttgggtttaaaggaggtattacc

SEQ ID NO: 543655 - DNA, 4239 bp, Homo sapiens
  misc_feature (81)..(81): n is a, c, g, or t
  misc_feature (420)..(420): n is a, c, g, or t
  misc_feature (423)..(423): n is a, c, g, or t
gggacccgaatagggtccacagccctgtgttcttcgaatactgtaaagcagccctgctccagattccttgagggtcacttnatattacacattcgtccacacaggacaacaaagtcaccacttccacccgccaaagcgcgctcaggtcggccgccacttcccttggtacacgcggaacgcaagccgcgccgaggctaaaggaagaggccggaatgcagggcgaaggggcgcagagatgctagccaatgctgccacctctattttgggtataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagngcngaggcgcggcctggagggactagttggcgcgcggctgcccggcgtggtgacgtcagggcggaagcgcacgcaggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctgggtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaagtaactatttgacatgcctatgtatttaatgtatacttgtaactatcaaaatgaatagttcatttttgatagatttgttgtgcagccattatgaattaaatggtttattaggagtttgactaaatttttatttttagtgtgtatagcatgaatactaccaaaggagacgacaaacttgcagcttaaaatgggcaccagttcccacactggcttaatttatataactgcttggctgtattgcgggtaataatattagaagcaagaagcacttcatttttaaaagagatgttactataatattgcttaaatgctttagcacttggacttcttgagatgcagatgtgtgatttggagtgctggcttatttaaaggtcaagccaaggagtttgtggttcagccacaactactgtttcctaagactattgatgtgaaggacttagtgaagtaatttttatattctgggcttcccagcaagatgtcctttttatgactgccatgcttcttttggactcagtaaatatttgtaatgttagaaaagtctcattatttttataaaatgcatgacattttaagtatgtgttgcataaaatggattatagcagttctcatggtttaggatttttaagaaatagtccatttaatttcagcttaaccttttaaatgatctgtaaaatttctttgatagtttaggaatgttgtggggagggttcattaataaaagttcagcaattttttaactgaaatagtttatctcttttacctagtcacaaaaaaggtatgtaaacaaggccattatatgtgtttattgctctttatttccctatctagattttctaagtatcttagctttcttaatataagtttaacttggtacttactgaaaatgcctttttacccctgttaacggtattttgagcttttgaaaagaacttggttgacactgcttttattgtggataaaggagagatggtcagtaattaatggcttgaagtattattggagtggtttatcatttctgaaactaatcgtgtcagaattgactttgaaaagcattgctttttacagaaatatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttctaaactgcttcaaataccttatttaaataaattattaaaaaggaaaattttaatagca

SEQ ID NO: 543656 - DNA, 1170 bp, Homo sapiens
  misc_feature (399)..(399): n is a, c, g, or t
  misc_feature (988)..(988): n is a, c, g, or t
  misc_feature (994)..(994): n is a, c, g, or t
  misc_feature (1017)..(1017): n is a, c, g, or t
  misc_feature (1021)..(1021): n is a, c, g, or t
  misc_feature (1058)..(1058): n is a, c, g, or t
  misc_feature (1081)..(1081): n is a, c, g, or t
tatagtggtgcatcattttacacccctgtcgcaaatatatattgcgcgtgtatataaaacgtgcgcgcgggaggaagtcacaaatgggctcttcacggaccagtttgtgtccctcatctaggaggccccttttgtctgtcctccccccccaggggtgtcacacgccctgttatagaatggattcccccccttttttgggggcgcctcggggactttttaccacccccctgtgattgagatatcactttgccctctagggcgtttaccccctatttcgcgcaagtggaaaacgttgaagatatttggatgcctacaatgtgcgccaagaagttgcaaaacgcaacagcaaaattttgggggaaatgggtttgccccgcaataactcggcccgaacccggntttgaatgggccacacccacattggttcctggggacatgcttcacatcttgcttgaacgccagtgtccaagttcccgggtgtacacccggagccagttctctggcgccactggattgggcccagtttaatctgcgtccaccggtgggagcccacagtgtaacacagtccacgaagatatatcccgtgagaaattcctcgcaagagatgtctgtgggtgcccctttctgtttcctggagaggagatataatgttccgggtaacacaccaaagctaacccacggagagggtttgcctgaaagcacacaatggtggcctaaaatttacaatatttttagaatgagagttctacgaacacacgtggctgtaaactcgttttgtccataactttctgtgcacaatggagaaggagattgtccccttaagaatctttcccacccactcaccacaatgaaatttgaaagaatgagaaaagagaaactcacgttggctacaaaacacactgcactttttttctgttctaattaatgggagaaacaatcaagaacgtttctgaggtaaagaaaatattctccactggcattagttaanataacngatattgtttaaatcatggtatnacangcaatttatatcagataaaagcagaacacatttttgnactgcctctcttaaatgctgaangtaactgttatgtataaatccatttagttttatgttctaaagaactatttgtgcaactccagattttcagtaaaatagtattactagta

SEQ ID NO: 543657 - DNA, 2781 bp, Homo sapiens
  misc_feature (81)..(81): n is a, c, g, or t
  misc_feature (420)..(420): n is a, c, g, or t
  misc_feature (423)..(423): n is a, c, g, or t
  misc_feature (1205)..(1205): n is a, c, g, or t
gggacccgaatagggtccacagccctgtgttcttcgaatactgtaaagcagccctgctccagattccttgagggtcacttnatattacacattcgtccacacaggacaacaaagtcaccacttccacccgccaaagcgcgctcaggtcggccgccacttcccttggtacacgcggaacgcaagccgcgccgaggctaaaggaagaggccggaatgcagggcgaaggggcgcagagatgctagccaatgctgccacctctattttgggtataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagngcngaggcgcggcctggagggactagttggcgcgcggctgcccggcgtggtgacgtcagggcggaagcgcacgcaggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaagcgaccagctacatttaccaaagcctgggtgatgtggagtggtacatagagatgaagctgtcgtcatggcaacatgagtgaagtatcgaaaatccccaaggagaagcnagtgctctgagaataggtcactggaatcggggactaacaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 543658 - DNA, 727 bp, Homo sapiens
  misc_feature (33)..(33): n is a, c, g, or t
  misc_feature (93)..(93): n is a, c, g, or t
  misc_feature (114)..(114): n is a, c, g, or t
  misc_feature (253)..(253): n is a, c, g, or t
  misc_feature (279)..(279): n is a, c, g, or t
  misc_feature (322)..(322): n is a, c, g, or t
  misc_feature (381)..(381): n is a, c, g, or t
  misc_feature (384)..(384): n is a, c, g, or t
  misc_feature (393)..(393): n is a, c, g, or t
  misc_feature (419)..(419): n is a, c, g, or t
  misc_feature (424)..(424): n is a, c, g, or t
  misc_feature (455)..(455): n is a, c, g, or t
  misc_feature (472)..(472): n is a, c, g, or t
  misc_feature (476)..(476): n is a, c, g, or t
  misc_feature (478)..(478): n is a, c, g, or t
  misc_feature (480)..(480): n is a, c, g, or t
  misc_feature (487)..(487): n is a, c, g, or t
  misc_feature (500)..(501): n is a, c, g, or t
  misc_feature (508)..(508): n is a, c, g, or t
  misc_feature (511)..(511): n is a, c, g, or t
  misc_feature (529)..(529): n is a, c, g, or t
  misc_feature (545)..(545): n is a, c, g, or t
  misc_feature (551)..(551): n is a, c, g, or t
  misc_feature (574)..(574): n is a, c, g, or t
  misc_feature (578)..(578): n is a, c, g, or t
  misc_feature (615)..(615): n is a, c, g, or t
  misc_feature (638)..(638): n is a, c, g, or t
ttttatatgaaattcacagcctatctggaggcngctggcattcacaacccactgaataagatatacataacaacaaagcgcttaccctatttnccaattgtaaactttctattnttgatcgctcagttgccaaaacttcaatacaacaaaaatctgggaatggtctgccgaaaaccgaccgacccggttgattggccagtttatctgctccacggtggagcagtgtacaagccagaagatacctgaaattccngcagatgttgtgggtgcccttctgtncctggaggattatgttcggtacacaaagctacccaggagggtngctgaagcacatgtgcctaatttcatttttgatgagttcagaacagtgctgtaactgtnttncctacttcntcaatggaaggattgcccttagatcnccccnccatcacaaatgaatttgaagatgaaaaganacccagtcgcccatacnaccncntnttccctncctattatgggannccccagncgntctgagtaagatatatcncatggcattagttaanataacngatattgtttaaatcatggtatnacangcaatttatatcagataaaagcagaacacatttttgnactgcctctcttaaatgctgaangtaactgttatgtataaatccatttagttttatgttctaaagaactatttgtgcaactccagattttcagtaaaatagtattactagta

SEQ ID NO: 543659 - DNA, 839 bp, Homo sapiens
  misc_feature (413)..(413): n is a, c, g, or t
  misc_feature (551)..(551): n is a, c, g, or t
  misc_feature (564)..(564): n is a, c, g, or t
  misc_feature (576)..(576): n is a, c, g, or t
  misc_feature (605)..(605): n is a, c, g, or t
  misc_feature (610)..(610): n is a, c, g, or t
  misc_feature (663)..(663): n is a, c, g, or t
  misc_feature (753)..(753): n is a, c, g, or t
  misc_feature (773)..(773): n is a, c, g, or t
  misc_feature (800)..(800): n is a, c, g, or t
ggccgggcgcggtggctcacgcctgtaatcccagctctcagggaggctaagaggcgggaggatagcttgagcccaggagttcgagacctgcctgggcaatatagcgaggaccccgttctccagaaacaggaacaacaaacaaaacgcaagggcacaaaaacaacacaaaacagacaacaacaaaaaaaaactcttgttgcgggcgcgccccgcggcccctggaaaaaagttttctacaaaacaactttgtgggtggggcgcgccgggcgccccaatttgagttaaggtgtggacaagcgtgcgcacacaaagagggtgtgacccacaagagagaaacacctcggggccacagaggcagcagagggtgcgtggcggttcctctcaccacaaaatataaaaaaagacacggccgncgggcgggggagcacacacccgcgagcgcgctgtgcttaggcagccaaaactaccacaggacgagtggacgacggtgcctcaagcgacaggagcagcaagatcacaagtggcgccggtccgtacttccaaacaccaangacggggagtganttgccacaccangaggcagagatgcgctgtcaccgatgatntaatnatagatagagtttagtaccagcgcccgcccgggagggcgtgggagtgtgaggnggggtagatagacgaacggaacagcatgtaagactaacatcgaccgtaccaggagcaaaagggcaaacgacaatcgatcgacaagctagngtaacgcgacaggaaccgangagggcatgaagctaattggacctgcncagtaccagggacaggaacaggtgacggccccacagagg

SEQ ID NO: 543660 - DNA, 899 bp, Homo sapiens
tactagcttaatattgtaattctaattcaaacaactctgaggttctggtcttcatcagtaatagttgaggaataatatactagcaaagaatggcctaatgtttgtcatgactgttacctggactgacaacttcttttaaaagatacaacccattgattgaaccaattataaagtgatctagtgatcaaaattctaaacgtgactgactttacttcgtacggaactgtcttcctaagtggggaccgaagttgcagtacgcgaggcattatgcaaaatcctacacaagctttttatacaattgttgctgctgggtagctcccgcagtgtttcataacggccatcctgttttcccggccaattcccgccattttaggggttgtatgctgtttgtaagagtattttgtgaggatactttatgctgtgttatctaaacagtgtcacttcccagttttgcctaggtcgtgacttgctggagctaatttagggaaacgacgagctattacaacaacctctggggaattgtctcaactgtgactaatctctagatttttgtctacgtttgtaatctgacctttaactgaaacattacttacttaagttttgctgaggatttatgagattttctaaccgccaattcggtcccctttttttaaaaaaggactgtcttgctaggtgtgatactggataggttcagatctgcgataaatggcaagctgtgtctagctcgtagatatgggaacttattcttgacaggtgtgaaaatccgctatgcaattggacgagattgtagcgacctgattaactaagtcatccaatggtataaacatttgtggggcccatttaaccacagagctgatgcaacttggccgaagattcgacccgggagacaacgggcaagc

SEQ ID NO: 543661 - DNA, 347 bp, Homo sapiens
  misc_feature (10)..(10): n is a, c, g, or t
  misc_feature (12)..(12): n is a, c, g, or t
  misc_feature (16)..(16): n is a, c, g, or t
  misc_feature (23)..(23): n is a, c, g, or t
  misc_feature (28)..(28): n is a, c, g, or t
  misc_feature (38)..(38): n is a, c, g, or t
  misc_feature (40)..(40): n is a, c, g, or t
  misc_feature (45)..(45): n is a, c, g, or t
  misc_feature (61)..(61): n is a, c, g, or t
  misc_feature (114)..(114): n is a, c, g, or t
  misc_feature (148)..(148): n is a, c, g, or t
  misc_feature (190)..(190): n is a, c, g, or t
  misc_feature (211)..(211): n is a, c, g, or t
  misc_feature (244)..(244): n is a, c, g, or t
  misc_feature (258)..(258): n is a, c, g, or t
  misc_feature (267)..(267): n is a, c, g, or t
  misc_feature (300)..(300): n is a, c, g, or t
  misc_feature (310)..(310): n is a, c, g, or t
  misc_feature (312)..(312): n is a, c, g, or t
  misc_feature (316)..(316): n is a, c, g, or t
  misc_feature (318)..(318): n is a, c, g, or t
  misc_feature (332)..(332): n is a, c, g, or t
  misc_feature (339)..(339): n is a, c, g, or t
  misc_feature (344)..(344): n is a, c, g, or t
aaaacggacngngccnatgtgcnaagcnttgcattgcncntgcanggtccgactctaaganggatcccccgtcaagcatttccaagcaagccgggtttgccgccaagaacacangggtggtcggtgaaaacctacccctaaaaggccnaaattggggaaaaggaaaaagactcatatcaacattggtcgncattgggacacggtagattcngggcaaggtccaccactacttggccatcttgantctataaatgcggnggggcatcngacaaaaggaaccatttgaaaaattttgagaanggaggctgcntnatantnggaaaggggctccnttcaagntatgncct

SEQ ID NO: 543662 - DNA, 2837 bp, Homo sapiens
  misc_feature (81)..(81): n is a, c, g, or t
  misc_feature (420)..(420): n is a, c, g, or t
  misc_feature (423)..(423): n is a, c, g, or t
gggacccgaatagggtccacagccctgtgttcttcgaatactgtaaagcagccctgctccagattccttgagggtcacttnatattacacattcgtccacacaggacaacaaagtcaccacttccacccgccaaagcgcgctcaggtcggccgccacttcccttggtacacgcggaacgcaagccgcgccgaggctaaaggaagaggccggaatgcagggcgaaggggcgcagagatgctagccaatgctgccacctctattttgggtataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagngcngaggcgcggcctggagggactagttggcgcgcggctgcccggcgtggtgacgtcagggcggaagcgcacgcaggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctgggtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaaggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 543663 - DNA, 113 bp, Homo sapiens
gtgtgaatcgcctatacagctacagcgagcactgcatcaaaactctcatcccaggaattaatataggtcagccacattcatgggcatctcctccactgtagtattgtataaag

SEQ ID NO: 543664 - DNA, 282 bp, Homo sapiens
  misc_feature (108)..(108): n is a, c, g, or t
attctttgtggcgccacagtttggtgtgtgcttccgtgggaccagaccctctttgcccaaaccaccaagggtcttgccacagggcagggtgcctctagcgccatactnaaaaccctgcccaagagggtggtgctggtgttgcgggaacgtggccatttctgccgggacgcgggggtgctgctgggctcgagggccctgagggagcggcaccaggccctgatgggctaccagctcctgccgctacccttcgaggaactggagtcccagagaggcctgccccag

SEQ ID NO: 543665 - DNA, 146 bp, Homo sapiens
  misc_feature (120)..(120): n is a, c, g, or t
tctatgtaagatctacaagacaactactatctctctttatggctgtcttcttcctctccagggtgatagacaacctccgtgcagggatgcgacgcattatatgatctctcatcattttanagcaacaaagtagtcatgcagtcagg

SEQ ID NO: 543666 - DNA, 2036 bp, Homo sapiens
tcccttctgtgttaatagtaaagcatgttgcctaataactacaaccctgaccaaatttgggcctggatctcatgggtcacgtggagttttaaatacgatttttaatttacttgggtaattgagctgaatctttagttttcagattacttttttaaacagataggctcttagaacaaattattaaaaacataataccccattggaggggaatctggattaactacccactgttcccaccccccccaacttttgaaaaattttggccatatagaatgcatgaaaaatcagtatgatcttatgaggactttatagtactgtaaatcttaggagcactttagttgttttgtttgtttgtttgttttaccagtcaaatagcagtgggagattgtataccaactttagtgacactgatattagtaagttctgataacccactaccatcggaccagcctggagcacattactttggccagtggaaagtctcttggagagactttgaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 543667 - DNA, 475 bp, Homo sapiens
ctgcttccacccatggggatccggttcaaatgaggaagtggatgagctgtcagagaagcacctattgcaaaaggggggatttcaattacctcgagttcacccgcctcctgaaacctggagcccaaggccaagatggctggaagaactttagctaaaatcttccagttacattgtcttactcttttttacttttcagaccctccccccccctcataggacctggtgcatgcaacttagtttcccagctttgcctcttctttttgagggatttattcccggcccttttgccccttagcccttggataatccggctgggaatgggggtgaggggggtaattggattgaaaaaggtcgcgaattaaaatcccccaatgtggaagccccgaaaaatatatttggatttttgggtttggtgggtttttccctttttttataataaaaatggttttttgaaataaaggttttgctggcccca

SEQ ID NO: 543668 - DNA, 3134 bp, Homo sapiens
ttttttttttttaaagttaaagcaagtttattaagaaagtaaaggaataaagaatggctactccataggcatagcagccccgagggctgctggttgcccattttaacggttatttcttgatgatatgctaaacaaggggtgtattattcatgcctcccctttttagaccatataggataacttcctgatgttgccatggcatttgtaaactgtcatggcgctggtgggagtgtagcagtgaggacgaccagaggtcactctcgttgccatcttggttttggtgggttttggctggcttctttactgcaaccattttatcagcaagcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaagcgaccagctacatttaccaaagcctgggtgatgtggagtggtacatagagatgaagctgtcgtcatggcaacaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacagtaagtaaatgttttcttagggaagcagtcttatttggagtttttaaaggttattgctttttctttaaaaattgaacatagattattttcaaagttaggttagaattaggcttttagtatgaggcaaattatgagaaatgagtttggagatgttctggacatacagtatcttaatggcattctgttatattttctcccatgttttttggagaagtgtaggagctacccacaaagtgcttgagggccatagtattgttcataatgtgaaaacttctttttttttttaatttcagttagaaaatgtgtttcattaaccccttattaataaccaataatcaaattaaccagtcaatgaatcttctttagttaggcctgtaattagattgttagctcttcgtggctcttcaatgtcttttgaacatgtgggagatacttaataaaaagcatagctctaggacactataaaaattgctaattactccccttggaataaagacataagaacatttgcttaagatttaatatgttatatataggcttgggcatacagcagtgaggggtggggagattttgaaaagttctggtttgtcatttatgtagctggtagttttgttttgaacctgttatgagcaaccaccggaataatctgttccccatagaaactgaacctaaacttcaaatttttattatctaagctataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 543669 - DNA, 349 bp, Homo sapiens
  misc_feature (35)..(35): n is a, c, g, or t
ctgagctgcctcttcaatttagagttgtgtacttnttgctcccccaaacatttctgtatagagggggttgttctaaggatcaaatgtaattaactggataggcagatgtgaaacagtctctgttgtgaggaacaaaaatcaaatgcaggaatgctgccctggcccaggatggcttccaacagcctcatgaaagacccaggacctaatgtcactgccctaccagggcaaagcaacttgcaaaggtggtgactaaatggccaccactaaaggtcccagcccagcccagggtaagtacaggcgctttctcagcttagtgggccccaagagtgctatgtgactctgtcaactc

SEQ ID NO: 543670 - DNA, 173 bp, Homo sapiens
agcatgacgccgaagccagcgccgcgcgccgtgaacgagccgggtttgtgcgcggcatcgagtcgcacgattctcaagcgcgccatcgcgccgctggcggacgcgctgccgcggcgcagcaggaacgcgtggcgcaggcgctgtcgctggtctacggcaccgaagtgttcctg

SEQ ID NO: 543671 - DNA, 767 bp, Homo sapiens
  misc_feature (138)..(138): n is a, c, g, or t
  misc_feature (355)..(355): n is a, c, g, or t
  misc_feature (357)..(357): n is a, c, g, or t
  misc_feature (361)..(361): n is a, c, g, or t
  misc_feature (386)..(386): n is a, c, g, or t
  misc_feature (398)..(398): n is a, c, g, or t
  misc_feature (468)..(468): n is a, c, g, or t
  misc_feature (484)..(484): n is a, c, g, or t
  misc_feature (559)..(559): n is a, c, g, or t
  misc_feature (658)..(658): n is a, c, g, or t
gaagcgtctttcggccggctctgcgcgatggacacggttgagcctgcccgttgcgctgagcgtcacgtccacgtggcccagcccgtcccccagacgggagaaaaggagagagcccggtgaggtcccaggtgcggaagncaaatgagactgccaggcggccacggcgtgggaaaccgggcacttgaacgaagttgtgagggcctccgaagttgatagggtgcgtaccgggtccaggcaacgaaaagccaccttaccctcgaaggtgatccgggaatggcgccgcacggccaggtctgcgatgttaacgcggttgaagattacgtttctatgcagccgcggaagttatgccgatacngnaggnttcttccgcgcggccccaccagacntcgatgaacatntcagtgtcaggttcagcctctcgaagtctccattgagaataaagcgctgcacatagccgtccaggtgaanttacatcgcggccaantcggtcaccgcacatagtgcagtgctggtcattgaggactcgctgcgctcacggtggtgtgacctgtctggctgnataggctgctgccaggctcatgtgcagcagcagtgtgccccctccagctcgagcgtcacgtagtcgccctggggcccctcgggctgcagcagaagaccntccttctcctcggtcttgaagctgaaggcgaacacgtccacaggcttcggctgacccctcgcgggaagcgtaggagatggcatcgtcgccgtcgaaatagagtatgtcg

SEQ ID NO: 543672 - DNA, 685 bp, Homo sapiens
cgagagaagtggggcctgagatctgctgccgtccagcccgcccgccgtcgtctgcgctgctccggcgccctttcccctgtctggcccagtagtggagacccagtgactgaactctccagtgcctcctcccctgagccctgcagctggctggagctcttgccattcctaagtaaaacgaagcacataaagaacacaacaatataagaaaataagaaaaacaaacaatacaacaagataaaacaatacgaaacacacaatacaaaaacaaataagaacacaaacaaaaaacggggcgcgcgcgcgcgcgccctctcaccatcctctctctctcgactgaagagaccacaaatgacaacaacaaatcaaaagcaccaccaaatgaatatattatgaagagaacgaaagagagaaggtctcacaccaatagaggaaggaaaagccacatttaaaaatgaagacccggtgagagagagaagagaatcggaactaatgaacccataaacgaacacaaatacccagctggtaaaacacacagcacaaacagagagaaaagctaataatacagaaacagaaaagcgatctacgggacagaacgtaaaaaacgcctactcgtacagcccgcactgggtggaggaagcggacaatacagtaagagtaacgacaccaaagatagccactgtacaac

SEQ ID NO: 543673 - DNA, 354 bp, Homo sapiens
ccttcctgaaaggatttgtaaaaactggttcttggaaaggggctgcagaagacctcccaaggtggatgtagtagaaccgcccggcgagcaccaaccgtgacaggtccgggcacggccgagcggagcagcgggagaactgccctccgcagccgaaaggggaccacgagaagcgctcctggccggtggcgcagaggtcgaggaagtccgcgaaccgaggcgctccagctccggcgatgccgcctcgccctccccgccgcggttgatgcggcacgtgcacgccgccgcccgcaccaggacctgggccgggtcgcacggcttggcccccggccaccgcttcgacctagctgagtgtgt

SEQ ID NO: 543674 - DNA, 416 bp, Homo sapiens
aaggatcccggtgtgcagacaatattgcctttaagatgttttttgttttgttttgtttgtttgttttcgagacagagtcgcgctttgtcacccaggctggagtgcagtggtgggatcttggcttactgcaagctccgcctcctgggttcatgcaattctgcctcagccttccatgtagctgggactacaggccccgccaccacgcctggataatttttttgtattttcagtagagacagggtttcgccatgttgcccagggtggtctcaaactcctgggctcaagtgatccacccgccttgcctcccaaagtgctgggattgcaggcatggcccactgtgctagcctaggatttttttttttttttaaaaaaagatttagcccttaaaattctattgtgcaatattggtctgcaca

SEQ ID NO: 543675 - DNA, 184 bp, Homo sapiens
acaaggtatgagaaatgggacacccgagacgagcacccaaagtgcacaaagctagagtaaaaagctagcccctatcaagcagaactagactcagttttcaatatccatacctaaaactaccttttaaccacagcttagctatctcaaaggcctaaccaagcctatggcaccgccagatacctat

SEQ ID NO: 543676 - DNA, 800 bp, Homo sapiens
tccattcagtgcacgcgttacttggctaaaaggaggtgagcggcactctgcccttccagagtcaagcatggagcaacaggatcagagacatgaaggaagggaggctgagcgcttgtgcttgaccctggacaaccctggatagtctgcctatgggtcatccattccacggtatggtatactaacatcgggtggtcgttggctgtcgaacatccgcacagcacatgactcatgcgagacaatggtgacaaggagacttacatatgtgtaggaccggtgaattcgatggaagagttcccgctagacgtggctgtggtctgtaagcgtgtccatgttaccattgggagggttgatcggatccctcctgggtcggccctatggatgaagacatattggggccacgaaagaggggcctttgctgttcacaccaacaatagttgtgcgtatcagtgccgtgctggatcgttagatgggatgcatgcatgagtcgccgacctcgattgtgatgcttatcattgatttcgcaagactttctggtgggaatatgtgcaggtgtatcgttccaacgtggtccccatgtacttaggggagctgggcccatataaagacctgctggggggcatctcgtgggtggtgtcctcagactcttcatcactgttggcatccttgtggtccagatcttaggtcttcggaatctccttggctaacgtagatggtgagtacaggaccatactcgggagcatcatccacccttcgacataacctggggctgccctcgcttgtgttcccaacgcacacaacaa

SEQ ID NO: 543677 - DNA, 923 bp, Homo sapiens
tgcggtgtatcttgcctataatcccagacactttggtagtgccgtaggttgggcggatcatcctgaagtcaaggtatttcgagaccagacctggtttacatgtgatgtacccccgtcattactgtcagtactatataacctggtaccagagtgtccgattgggctacattgtcctgtttacctttcatgtcactttgggcagtgcagacgtgtcggtgactaaattaccacgaaggtctgggatgatacgagaacccgatacttggacgtcacctatgatcacttgcctgctgtagcccgggccttgccctcatgttcctgcgggcatataccagactgagtcttcgaagcctctccataagagtgtgtgcaccatagcgtgagtgtatactcagctcaaagcctgtatcctacatccacatgagacatgctttggggtgcggatgtgaagtgggtctactctaggatttactcaatataagtcagtagctaggccatacgaggaattatctatgaaggatcttactataccttgactgaatgtgtcatttggtggcgcatgtcggcaaaaggtaacttttgcttgtttgtctctggtgcttcatgatgctaatcacttcgtgatgcggatagtcttcttatactacaggtacctgtatgactatcacttaaggacctgtctgggtggctattcgtgctagaatggtgttctggttcctaacaacatataacattgcttgagttccaaaaaggccacagcctatgggggggaaaaagcctcttaggaccttctagtacctattcccacttgtagaccgcttcttggtgccccttgcctttgggatcagaatctcagcgggtacgggaacacctgtaccccacctggagccgagaaatccggggcgggggcaacgccagggccg

SEQ ID NO: 543678 - DNA, 163 bp, Homo sapiens
  misc_feature (9)..(9): n is a, c, g, or t
  misc_feature (24)..(24): n is a, c, g, or t
  misc_feature (33)..(33): n is a, c, g, or t
  misc_feature (42)..(42): n is a, c, g, or t
  misc_feature (45)..(45): n is a, c, g, or t
  misc_feature (51)..(51): n is a, c, g, or t
  misc_feature (58)..(58): n is a, c, g, or t
  misc_feature (60)..(60): n is a, c, g, or t
  misc_feature (152)..(152): n is a, c, g, or t
cctgtagtnacctgttgtgctatnaacactagntcttattanttntactgnctatatntnggtgcccattaaccaacctcactccccctgccactacccttctcagcctgtggcaaccatcactctactctatctccactagttcagttgtnttaatttttag

SEQ ID NO: 543679 - DNA, 139 bp, Homo sapiens
tacttgttcccagggtggcaggaaaggctttctgtgccgggggtgatatcagagatgatcgtcggaatgctgaaaaggcaaaacagaagatagctccagttttcttcagatgaagaatatatgctagaataatgctgtt

SEQ ID NO: 543680 - DNA, 610 bp, Homo sapiens
  misc_feature (69)..(69): n is a, c, g, or t
  misc_feature (105)..(105): n is a, c, g, or t
  misc_feature (128)..(128): n is a, c, g, or t
ccccagccgtggtggcacatggaccagacaggccttgccactaacttctatgtgatgtcagtggcctcncacttccagagctcccccaggtgctgcctgtgttcnaagccagtctcccagcctggcgncagcccccttccggtaggtgcccttggctcattcctcacaatcatacggaagccccaaacctcgcagcgcctcagagtttattccaatgcttcattcaaactgagatctgaaatctattttaaactattttaaaaacactcattaaaacacttaacaataacaggttaccctggggggactactgagggtgggggttaggccataaggaactggagggctgatcgccttcttcacctcaatctgagttatggtttcaagagtagagggatgggactgcacagctgtgtggaagtactggatgccactgaattgcacacttaaaaatgcttctggtggcaaatgttatgtgtattttaccacagtataaaaaagcacgatttaaaacagaactcaagatattgctttaaaatgatttcaataaataccagattgagccaaaaaagatgagtataagcataaattaaaaatccatcaagttttg

SEQ ID NO: 543681 - DNA, 178 bp, Homo sapiens
atttcatacggacctcatattaagaaccccacccatcgccaagaaaaaccgcctgtgataagcccttatccacataaggagccgccttacgcggccacacccataaggagccgccacgcggcgaccacagatgaaactcgcctccctcaagcacggccgtgacggaatcctgatagtc

SEQ ID NO: 543682 - DNA, 393 bp, Homo sapiens
ggggccccccccattggggttggggggcccccctccccgtggggaagaaagggttttggccccccccctttgggggggggttccttgggggggaaaaaaattattggtttggggcccccctgggcagggccctggtttaattggttcccttaggggggggggggcccccccctgttcccggggggggccctttgggactgtccctccccccaaagggcccttaagggggcaaaacccctttcctaaaaggggggggggggggggggggggttttttttttttttttttccgggatcccaaaaaacccccgccaaaattcagggcccctgccaaatttttttaaatggccgggtttggggaatttaatcccataaaaccctttttgggggggga

SEQ ID NO: 543683 - DNA, 405 bp, Homo sapiens
tgcgcgcagggcatccagcaattacagttgcgaaataagatattttgactttttggcttcaaatcattattcatcgtaattctgttttcttaaatggctaccactaatggcggagatctttgaggcgagagactgtttaattattgcatgcctggtacctgacacattgactggtatgtggtgtgagctcaatgatcttctgttaaattcatgaataaatgtactcagctgccaatccagttaggttcaagaaaaaaacagaggcttacaaatgaactttatcaattattttctaacattttgcttaatgctttcaagtaaactcttactgacttggatcttaatagaatttgtgaatacaaagtctgaggaaaatgtgtttgctaaaaataaaaacaatgcttg

SEQ ID NO: 543684 - DNA, 455 bp, Homo sapiens
  misc_feature (82)..(82): n is a, c, g, or t
  misc_feature (93)..(93): n is a, c, g, or t
  misc_feature (95)..(95): n is a, c, g, or t
  misc_feature (294)..(294): n is a, c, g, or t
ttcacctttctttcctgccggggttttgcccaagtcaatcggaacggtcaagaaaacccttgaaattgtcaatctggggccnatggaacgganangggtgggggctacccaatggacccactgaactccctggaacatcaggatgctcccatggcaaaggtgttatcatccatgttcttcgtcttcagttcctccctcggcagccttgccctcaccggctttcaatgagctcttcagctgcctggcctcagcctccacgggaccctggcactcgggctgtggctccagctgcgnagctgctctgctggggcagccttcggcatcagtgggtgtgggagcgggtgcgatccggagcaggactgtgtagttgcggccgtggttgttggcccagaaagtgccctcaggggtctcatagcgcaccacgaagttcgcaggcgccccatcgcccgcgccct

SEQ ID NO: 543685 - DNA, 244 bp, Homo sapiens
  misc_feature (133)..(133): n is a, c, g, or t
ttccattggccagtgctggtctctaagtcctggcctcaggtatccacctgacctcagccaaagtgcgtgggattacacggcgtgagccaccatgcccggcctggctgtacatttttctgtattgtcctctacnatctaaatttggtgaagacacaatcacattatacttatatatcgtgttattctaccagttgccttatgactcataggtgatgtactatttcattgaagaactctaggactt

SEQ ID NO: 543686 - DNA, 108 bp, Homo sapiens
tatgtatccaggtatctgcgggaagaggggacatcttcccactgcaggtgggtcagaacataatcggctggactctcatcttcccactgcaggtgggtcagaacatag

SEQ ID NO: 543687 - DNA, 1180 bp, Homo sapiens
  misc_feature (16)..(18): n is a, c, g, or t
  misc_feature (23)..(23): n is a, c, g, or t
tctagaggatccctcnnntctancacagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 543688 - DNA, 190 bp, Homo sapiens
tggcccaaacccatttttttttttccaaaaaaaaaattttttttaaaaattatttttaaccaaaactttttttatagggaaaaaatgccaaaaaatgtccccccccccggggtaaaatttaatttttattttttttttcaaggtaaattaaaaaaaatttgtaagtaagtaacccttaagggtggactta

SEQ ID NO: 543689 - DNA, 1129 bp, Homo sapiens
  misc_feature (86)..(86): n is a, c, g, or t
ctatactctgccttctgtatattttagttacatggtgtgtcagttgctctgggatgaaggcgctcgacatgaattcatgtcgaggnctttcatccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 543690 - DNA, 383 bp, Homo sapiens
gccccgtgttttagaagttcaatagcacaacaggctgacctatagtcaataatttaattgtacatttaaaatgaactaaaagagtataactggattgtttgtaacacaaaggataaatgcttgagaagatgaataccctacttgccatgatgtattatgcattgcatgcctgtatcaaagtatctcatctaccttataaatatatatacctactatatacccacaaaaattaaaaagttaaaaaaaaagaatttgctattgaaacttctaaaactaggcctagttttagaagtttcaatagcacctagtttaagaagccccaggcagcaatgtacttgctgagtaaaaacaatgctattgaaacttctaaaactagggggtac

SEQ ID NO: 543691 - DNA, 101 bp, Homo sapiens
tatccacagcaaaaaactaaaaaaaaagaaacaactgtaacatatggcaaggcggtaagcgaacgacgagcgcagcgagctagtatagcgagagacagcgg

SEQ ID NO: 543692 - DNA, 4236 bp, Homo sapiens
  misc_feature (81)..(81): n is a, c, g, or t
  misc_feature (420)..(420): n is a, c, g, or t
  misc_feature (423)..(423): n is a, c, g, or t
  misc_feature (3929)..(3930): n is a, c, g, or t
  misc_feature (3937)..(3939): n is a, c, g, or t
gggacccgaatagggtccacagccctgtgttcttcgaatactgtaaagcagccctgctccagattccttgagggtcacttnatattacacattcgtccacacaggacaacaaagtcaccacttccacccgccaaagcgcgctcaggtcggccgccacttcccttggtacacgcggaacgcaagccgcgccgaggctaaaggaagaggccggaatgcagggcgaaggggcgcagagatgctagccaatgctgccacctctattttgggtataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagngcngaggcgcggcctggagggactagttggcgcgcggctgcccggcgtggtgacgtcagggcggaagcgcacgcaggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctgggtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaagtaactatttgacatgcctatgtatttaatgtatacttgtaactatcaaaatgaatagttcatttttgatagatttgttgtgcagccattatgaattaaatggtttattaggagtttgactaaatttttatttttagtgtgtatagcatgaatactaccaaaggagacgacaaacttgcagcttaaaatgggcaccagttcccacactggcttaatttatataactgcttggctgtattgcgggtaataatattagaagcaagaagcacttcatttttaaaagagatgttactataatattgcttaaatgctttagcacttggacttcttgagatgcagatgtgtgatttggagtgctggcttatttaaaggtcaagccaaggagtttgtggttcagccacaactactgtttcctaagactattgatgtgaaggacttagtgaagtaatttttatattctgggcttcccagcaagatgtcctttttatgactgccatgcttcttttggactcagtaaatatttgtaatgttagaaaagtctcattatttttataaaatgcatgacattttaagtatgtgttgcataaaatggattatagcagttctcatggtttaggatttttaagaaatagtccatttaatttcagcttaaccttttaaatgatctgtaaaatttctttgatagtttaggaatgttgtggggagggttcattaataaaagttcagcaattttttaactgaaatagtttatctcttttacctagtcacaaaaaaggtatgtaaacaaggccattatatgtgtttattgctctttatttccctatctagattttctaagtatcttagctttcttaatataagtttaacttggtacttactgaaaatgcctttttacccctgttaacggtattttgagcttttgaaaagaacttggttgacactgcttttattgtggataaaggagagatggtcagtaattaatggcttgaagtattattggagtggtttatcatttctgaaactaatcgtgtcagaattgactttgaaaagcattgctttttacagaaatatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgaaaaaaaaaaaaaaaaaaaaataannaccaaannnaaaaaaaaaaaaaaaaaaaacaacaaaaaacattaaaatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttctaaactgcttcaaataccttatttaaataaattattaaaaaggaaaattttaatagca

SEQ ID NO: 543693 - DNA, 226 bp, Homo sapiens
tcatcgagctcggtcctgacgcacattataaggagttaaagagatagtagctggtgagctgttacatagactagtcaaccactttattaatctcattgctattgaaacttctaaaactaggcctagttttagaagtttcaatagcacctagtttaagaagccccaggcagcaatgtacttgctgagtaaaaacaatgctattgaaacttctaaaactagggggtac

SEQ ID NO: 543694 - DNA, 110 bp, Homo sapiens
aacctcggttcccagttccaattgcacctgccattcgaaggagtaagggccgtgtctcagtccccttgtggccgttcaccctctcaggccagctgcccatcatcgccttg

SEQ ID NO: 543695 - DNA, 871 bp, Homo sapiens
agagtaacatctgcatgaatctgttcacatatcatgatgaatcgctggtgcatcgaaaggcttacgagaaatccttttctctgagtccacccggatcctcttcttctacacaccctgaaagattgacagactacgccaagaaagcgagagtggttcctgggccccaacaactactacagtattgccagctctgcgctgagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 543696 - DNA, 238 bp, Homo sapiens
  misc_feature (19)..(20): n is a, c, g, or t
gtcagacgctgaactatgnntttattattgatatagcacttagccttcggcctcccaacactttccctgatagcaccctttactttatctgctatacttaacatttctgatggaaattaactttgcaggatatcatgaaaaggcagtggtagattcacagtccttccattggcttagaacttcaattttgtcattactctgagaatcacatagttcagcgtctgacgggtaccgagct

SEQ ID NO: 543697 - DNA, 734 bp, Homo sapiens
ccgtgaggatcccaaacgacccgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttcta

SEQ ID NO: 543698 - DNA, 3538 bp, Homo sapiens
  misc_feature (81)..(81): n is a, c, g, or t
  misc_feature (420)..(420): n is a, c, g, or t
  misc_feature (423)..(423): n is a, c, g, or t
gggacccgaatagggtccacagccctgtgttcttcgaatactgtaaagcagccctgctccagattccttgagggtcacttnatattacacattcgtccacacaggacaacaaagtcaccacttccacccgccaaagcgcgctcaggtcggccgccacttcccttggtacacgcggaacgcaagccgcgccgaggctaaaggaagaggccggaatgcagggcgaaggggcgcagagatgctagccaatgctgccacctctattttgggtataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagngcngaggcgcggcctggagggactagttggcgcgcggctgcccggcgtggtgacgtcagggcggaagcgcacgcaggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctgggtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaagtaactatttgacatgcctatgtatttaatgtatacttgtaactatcaaaatgaatagttcatttttgatagatttgttgtgcagccattatgaattaaatggtttattaggagtttgactaaatttttatttttagtgtgtatagcatgaatactaccaaaggagacgacaaacttgcagcttaaaatgggcaccagttcccacactggcttaatttatataactgcttggctgtattgcgggtaataatattagaagcaagaagcacttcatttttaaaagagatgttactataatattgcttaaatgctttagcacttggacttcttgagatgcagatgtgtgatttggagtgctggcttatttaaaggtcaagccaaggagtttgtggttcagccacaactactgtttcctaagactattgatgtgaaggacttagtgaagtaatttttatattctgggcttcccagcaagatgtcctttttatgactgccatgcttcttttggactcagtaaatatttgtaatgttagaaaagtctcattatttttataaaatgcatgacattttaagtatgtgttgcataaaatggattatagcagttctcatggtttaggatttttaagaaatagtccatttaatttcagcttaaccttttaaatgatctgtaaaatttctttgatagtttaggaatgttgtggggagggttcattaataaaagttcagcaattttttaactgaaatagtttatctcttttacctagtcacaaaaaaggtatgtaaacaaggccattatatgtgtttattgctctttatttccctatctagattttctaagtatcttagctttcttaatataagtttaacttggtacttactgaaaatgcctttttacccctgttaacggtattttgagcttttgaaaagaacttggttgacactgcttttattgtggataaaggagagatggtcagtaattaatggcttgaagtattattggagtggtttatcatttctgaaactaatcgtgtcagaattgactttgaaaagcattgctttttacagaaatatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgacatgaatcatgtccagggccttcatgccttagaaagggtataggggatgaaagcactgacatgaa

SEQ ID NO: 543699 - DNA, 645 bp, Homo sapiens
taaagagattttcagactaaatagaaatgtcaaaatgatgtatcaatggttcttttttagaacaagttttcaaagcataaaaagaggttgagagaaataacatatttattgattcacataagtatgttttccttcattaatcgtctggagaaacccacttgtcattaattggtttggggctaggttttcaaacttaccaaattgctttaaaaaagcaatttggaaggtaattggataggctttccaatttaaccaaattttttatggtaatcctgggatagtattttggtcttttcaattcattggtcttttccagtatagttttggtcaaggcaaatgtcttcccttaatatccaaatattgctaataaacggtagaagatgcttgggaacattcaaaattatctcgctgtgggttagacttaacactgttaatcttcagccaaatttcactatttggatcaaattatttcctttttggtggtttaccctatcctcaacaacatttttacgtttacattatggtcagagattagacgggggggaaattgaaattatggctccaaaataatagggtgcaagctatttaatgcttaactgtggctctgtcaaaacagctatgcagtgaagttgcattggatgtcta

SEQ ID NO: 543700 - DNA, 123 bp, Homo sapiens
attctactgtctatgtacattatctgccaatgttatggtaaatggaaaaccggtgaatctgggcttatgggatacagctggacaagaagattatgacagattacgcccctcgagcccctaagg

SEQ ID NO: 543701 - DNA, 1947 bp, Homo sapiens
  misc_feature (81)..(81): n is a, c, g, or t
  misc_feature (420)..(420): n is a, c, g, or t
  misc_feature (423)..(423): n is a, c, g, or t
gggacccgaatagggtccacagccctgtgttcttcgaatactgtaaagcagccctgctccagattccttgagggtcacttnatattacacattcgtccacacaggacaacaaagtcaccacttccacccgccaaagcgcgctcaggtcggccgccacttcccttggtacacgcggaacgcaagccgcgccgaggctaaaggaagaggccggaatgcagggcgaaggggcgcagagatgctagccaatgctgccacctctattttgggtataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagngcngaggcgcggcctggagggactagttggcgcgcggctgcccggcgtggtgacgtcagggcggaagcgcacgcaggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacaagacgaggtcttgctacgttgcccaggtcggtcacgaactcctggcctcaagtgatcctcccacctcagcctcccaagtattaaattcttaatagtgttgaaatt

SEQ ID NO: 543702 - DNA, 172 bp, Homo sapiens
gatctcctgacctcgtgatctgtccgcctcggcctctcaaagtgctgggattacaagctagtgccaccatgcccagttgatatacacaatcttaaaacaacattgtaatgggtatttttgtttgcttgtttgttttgagacggagttactctgtcgcccagggctggaattc

SEQ ID NO: 543703 - DNA, 650 bp, Homo sapiens
  misc_feature (629)..(629): n is a, c, g, or t
tcagccgctgttctgtaagacagaaactgttccagaatatccctatggattaacccctgagtacccagagtgaattctaatttacagaacttccttattgatctgctggttcttccagatcatattctggctattggtgtggctggcctttctgaaggcaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagcaggcctctattcctgtatgtaattgctcattttcagcacctggaacctcatctatcgggtctggaaggaatacagcagttcgaaagccgcgtccatttctctccttcagtagtgcagaaatgagtccgattcaccagtacacacagaactgtaccagctcaacctagcaaaagaagaaaagtttccactgtacttaaaatttacagcttgactcaaattgcttcacaaaantattttgatgtagaaggctat

SEQ ID NO: 543704 - DNA, 540 bp, Homo sapiens
  misc_feature (104)..(104): n is a, c, g, or t
actggctcttgacacagcacaacatctgcagatgtgacaggaagctctgttcatatcctgaaggtgtgaatgcttcagtgtgacccagttctcagactctacgnacagtctggaggaaagtcacacagcattgggagataggagttattcagagtcttcatctacatcttcctcggaaagcttgaattcatcagcaccacgtggagaacgttcgagtgagtttttccatttcatgcaactgtgccccatagaggagagagggactcatgatgcttatgaaatctgtggcgtattaaaaccacgcatgagggcctagcgtggtcgtcacgcctgtaatcccagcactttgggaggccgaggtgggtggatcatctgaggtgaggggttcaagacctgactgacctacatggtgaaaccctgtctctactaacaatacaaaaaattagccgggtgtgatggcaggcacctgtaatcccagctacttgggaggctgaggcaggagaatcgtttgaacccaggaggtggaggttgcagttagct

SEQ ID NO: 543705 - DNA, 379 bp, Homo sapiens
  misc_feature (104)..(104): n is a, c, g, or t
  misc_feature (243)..(243): n is a, c, g, or t
  misc_feature (288)..(288): n is a, c, g, or t
actggctcttgacacagcacaacatctgcagatgtgacaggaagctctgttcatatcctgaaggtgtgaatgcttcagtgtgacccagttctcagactctacgnacagtctggaggaaagtcacacagcattgggagataggagttattcagagtcttcatctacatcttcctcggaaagcttgaattcatcagcaccacgtggagaacgttcgaccttggaagacagccgagagccaggccnagcactaggtgacagttccgccaatgcagaggacaggacttctgnggtgccctctctcggcacccacaccttggctactgtcactggaaacggggaacgcacactgcggtctgtcaccctcaccaacaccagcatg

SEQ ID NO: 543706 - DNA, 427 bp, Homo sapiens
gggtgcgagcagtctcacaccagagtgaccaagatacgccggggtgacaaatagtattatgtgaactcaactcttggataccacaaaggacacagcagcagggaagagacaactgtagaaaggaagaacacacttgcacactatccatccaacaagtgactaatattcagaacatgaaaggaactcagaccactcaacaggcaaaaaaaatccaattaacacgtgggcaaaggaaataaatagatgtctctcaaaagaagacatacaaatgtcccaacaaagtatcttacaatgtccaaccgcctctagtcatcagggaaatgcaaatcaaaaccacaatgagtatcatctcacctcaattagaatggctattatcaaacacacacacacacacacacacacacacacaaatgctggtgaggatgcc

SEQ ID NO: 543707 - DNA, 974 bp, Homo sapiens
gtctcgagttttgtttcttttttttttggtacaaaattttataaaagggtctttaaagagcaacatccaaactccaaaatacagctgccaaggaaaccctgtgtattatgcgtggtggggacgtggcgtggggcattggaccggcggcatcgtggcatttcccacccttctcgtgttcgtgaaagtggggggtgggtgggcaagatatctcatctctttaggggtctccacaagtgctcacgttggctcagaggcaggggagctttctatataagggcacaattcttatacacaggtggggctccacatgggcaagcatatgatctctttcaccttgtaatatctgcccaagacacaccctgtgttcgtagaagcaacaacttttggccgccaaatagcatgtgttctcaaccggtgtatgcgtaagttataacacagggggtctcctccgagagtggtgagatctcattacaggcgcacatctcacaagaacactatatcagggtgggaatcataacgcccctctcgtgtgtcccctcaggagaggttttctccgacgaagaacacacaccaaaaacagcgctctcggaagagctcactgtgtgtgggtcgcgcccaaaatctctttccgatatgggaagtgaaacacggcgcgaggcgcagcagcgccaatataagacgaagtgtccccctcttccgcgggaacagaggattgaaaggcgccccctctctaaagagagagtgtttgtggtgaaacccgccaagaagacacttctgttgcgctgtgtgagacgaagtgtggggcccaacgagaaacactgtctataagggtggaccacccctttatttctcaaggacatataaagagccttctttacaacgagttgcccctcttctgtgtgaaaaagggcactaaaaaagccctttcttttcggtggagaaccattagacgggcagaagtgtcaagtgatacg

SEQ ID NO: 543708 - DNA, 208 bp, Homo sapiens
  misc_feature (4)..(4): n is a, c, g, or t
  misc_feature (12)..(12): n is a, c, g, or t
cacncacacacncacacacacacacacacacacacacacacacacacctactttccaaattctttcctcctgtatgaaaaaaacttaaggctgggcacagtggctcatgcttgtaatccagcactttgggaggctgaggcagcaggattgcttgatccaaggagtccaagaccagcctgggcaacatgatgagaccctgtctctacaa

SEQ ID NO: 543709 - DNA, 307 bp, Homo sapiens
  misc_feature (171)..(171): n is a, c, g, or t
  misc_feature (216)..(216): n is a, c, g, or t
caggcgaacagacatctcagataaagaccctaaaagtacaggggagcgtcttggctcccacagcccaggaagtgaggcttggggcacgatcctgtcgctccagccctgcatttttcagccatcctctttcactctacttttagccttggaagacagccgagagccaggccnagcactaggtgacagttccgccaatgcagaggacaggacttctgnggtgccctctctcggcacccacaccttggctactgtcactggaaacggggaacgcacactgcggtctgtcaccctcaccaacaccagcatg

SEQ ID NO: 543710 - DNA, 399 bp, Homo sapiens
  misc_feature (22)..(22): n is a, c, g, or t
  misc_feature (34)..(34): n is a, c, g, or t
  misc_feature (75)..(75): n is a, c, g, or t
  misc_feature (92)..(92): n is a, c, g, or t
  misc_feature (167)..(167): n is a, c, g, or t
  misc_feature (202)..(202): n is a, c, g, or t
  misc_feature (264)..(264): n is a, c, g, or t
ttccttggtgtattccttatgncaaacaatccancaggcagcaaagatgtctgttacatcctaaacttgaataanaaagttttaccaccagntacacataacggcgttggtatggtttatatggattcactttcatccttctagcaataggaaatacagatcattgnaatatatatatatatatatacaggctctgctgaantgaaatggtgaaatcaaatcaccattctaaaaaattattacttatattgataaagcctggantctctcaacttgttttgctttgctttttttctttaaccaatcaatctcttactgatagattttgtgtaaaaagatatatactagtttcttcagaaagattaacaataaaaattgtgtttatttcaaaaaaaaaaa

SEQ ID NO: 543711 - DNA, 86 bp, Homo sapiens
gatcagagcattgtgcaatacagtttcattaactccttccccccctcgccgcgcgtcctccaaaaaataaaaccttaaccgcgggc

SEQ ID NO: 543712 - DNA, 315 bp, Homo sapiens
tgagcgttccaatcactaccacccatgattaatttaatatttgctggttgtgcattattattcatatcaaccgataacggaccgttatctagttgcatattatcagatagtcgtgtgttgatcatgtaatcgccttgtccactgattccactagcaatataaggtggtactccattaactgtattcttaacggcttcaaacgatgattgcaacggtgaataaaaccaccataattgctttaccacaggggtaagcaacgcttgcgtagctgattggcctttgtgtcctttaatccagcagcacgcacaacgatga

SEQ ID NO: 543713 - DNA, 326 bp, Homo sapiens
  misc_feature (26)..(26): n is a, c, g, or t
ggggggggggggggtttccccccaanaacccttttttgtaaggtcttttggtgttttacacaaaatttggtccaacccaaaggggggggggcgtcttggcgcccccagggccccaaggaattaaccccttgtgccccccccccccccagagggcaaaaagggaaaaagagccccccttttttgggggggtccccccccccttaggttccccccccccttttttttccccccccccgggtttttttttgaacccccttaaaggggggggggcctgggggacccccccttttttttgccccccaaaaaagggccctggttccccccca

SEQ ID NO: 543714 - DNA, 127 bp, Homo sapiens
ctgaggatccccttcgtccattctgacttgagcacccataacgccgcgagtttggtccctcggcgtgtgcagcaacaacttcgtccataggtgatttgcggcgttgggaccttcggcgtgtgcagga

SEQ ID NO: 543715 - DNA, 645 bp, Homo sapiens
cggattttttcctatgtgtgcgccggttatccccttttgggagaagatcccacttttaagggcataattgacttttgttcacagggggcctactatcccccaattgtggctgcccccaaggtttttagtgagtccctcgtaagtctcccgcatattttcgcgaggtaggtccacacccacaattgatgggtggcggaaaatggccctttgccatcttctgcccttatagggtgtggcgccaaaatatgctcaattggtgttgaggaaaacagacactgaccctcccccagagggcgggagaactcactgaggatgaggtggaaccagtgatcccgcttatgcagatccccccttgttcaagatgccacgcccggtgtgttgacagacagaaggatgttaagcgatggaaataatagccccggtgccttaacagcattggtgttgggcaaacaacactcttggtgagacactggggccgactggaaaaagattttggcccctaagaagggctgcgtcactttttggtgcccttttgttccaggcccacaccacccagacccagggtccctggccccccccggggggtgtttaaaaaaaagtaatttttagccttttttggttatataaaaaggttttattacccca

SEQ ID NO: 543716 - DNA, 362 bp, Homo sapiens
gggcagagatggacgccaccctgggacacaacctcccagccccatttctgttctgtgcacagacgcagtttgctgttttggtttttacaaaaatggggtcacgccatacatgcattttgaactccatttagaaaaacaaaagtaacaatagattgtgaacattctcccatcggtaaatacaattctactagaatacaaccagcaatcttgatgacatgttttctgcatttttttcctttcagggagaacactttcagtcgaaggagaagcctgggacccttgacacagaagtgacatgtgcattcggaacctctctgtggaaaacacagacccttcatgacacgcaaactcgaagccggtga

SEQ ID NO: 543717 - DNA, 1000 bp, Homo sapiens
caggttatccctgcgaacggcaacattttcaatgcccaaaaaggtttcattcatagttaaggtataccaatcgccccatctacatatatattcctatcctatgtttgccacaaatcgttacacaaggctctcttttgaaaaagggcccctaaccgtgttttttcctccggagccactgtgtggcgacttccgtaattgctccacttaacgctccccccgttgtcccttggggacccccactctggttcaagcgtggtcagttatcacacactggcacaacaatgttccctgacacatgcactaaccgcagacacgttattttcttcgagagattaccttcattctattcttaactcccttaattttcctctataacctcttcggtccttttcacctttcatcgcttcttgaattacttgaattaaaccattgaatcgatctgaactacgcttttagtccagaactttccacacgaggataccatcctatcttttactcacttacttatggggcttttgaaaaattttatttttacaccttctaactttctttactttcctcaaacgcacgataattacttactgtcctgaaatactcgcttttcgtttccttattaatctctaagggtttaacacttccttcttccaaactcactgcttgatctttgctctttgctttttcgttgtctgagaaattgctcttggcgtagactttggcttctggtatagtgtttctgattgcttcctgtcgagcacaaacgtcgagacgactgccatctgagcagccctgccacggggtcgctgttctcacggctgtggcatcgccaggcggcctcctgcaaaccaagggctgggggcaaaggggcatgatccagggtcccccagggtgggctcagctccagggagaggccacccacgtggcagccccacctcttgagagcccccagtgccggagcagaaagactctgacccagattacgattcgtggcggtgtactgaaa

SEQ ID NO: 543718 - DNA, 328 bp, Homo sapiens
  misc_feature (51)..(51): n is a, c, g, or t
  misc_feature (71)..(71): n is a, c, g, or t
  misc_feature (85)..(85): n is a, c, g, or t
  misc_feature (104)..(105): n is a, c, g, or t
  misc_feature (107)..(107): n is a, c, g, or t
  misc_feature (115)..(115): n is a, c, g, or t
  misc_feature (124)..(125): n is a, c, g, or t
  misc_feature (130)..(131): n is a, c, g, or t
  misc_feature (138)..(138): n is a, c, g, or t
  misc_feature (143)..(143): n is a, c, g, or t
  misc_feature (145)..(146): n is a, c, g, or t
  misc_feature (158)..(158): n is a, c, g, or t
  misc_feature (163)..(163): n is a, c, g, or t
  misc_feature (165)..(165): n is a, c, g, or t
  misc_feature (169)..(170): n is a, c, g, or t
  misc_feature (172)..(172): n is a, c, g, or t
  misc_feature (175)..(175): n is a, c, g, or t
  misc_feature (179)..(179): n is a, c, g, or t
  misc_feature (217)..(217): n is a, c, g, or t
  misc_feature (239)..(240): n is a, c, g, or t
  misc_feature (247)..(247): n is a, c, g, or t
  misc_feature (250)..(250): n is a, c, g, or t
  misc_feature (256)..(256): n is a, c, g, or t
  misc_feature (260)..(260): n is a, c, g, or t
  misc_feature (287)..(287): n is a, c, g, or t
tttttcttatgttcctaagaggatattatctttggggaacattttagaganaatttagatctactttcccntcataaagattttnaataattcagtatttgggnngnggttgggnacagggggnnttagnncagtagnggaangnngtggggatatgngtggntngggnntnggntacnatacagttttcgatctctatgatctcgtgatgtttggnatctagtctctctttcctaatnnggatagngtnctattngggntccaattgtcaataccagtcctcaggncctttcctaactttctacctagcacctcaatactctctagg

SEQ ID NO: 543719 - DNA, 537 bp, Homo sapiens
  misc_feature (484)..(484): n is a, c, g, or t
ataataccagtgtatgtttcagttaggatgatttcaaaagcaggcatttgtcttcatggttgcaatacagctgctgcagccccaaccatcacaccttcataaagtactaaccaaagacaggaagaccagggaatgggccctgtgagcaaaaggggagagaagacaatttactgaggctaaagttaaccatcccagatttcatcacccacatttcatggcttagggaagaataagctctggaagttagagtcccacatctccatgtcagcaggccacgctctctctgcaggctctaggggagcccctcctcaccttttccagctcatagcactcctgggtttccttggctggtggctgcatcgctcccgtctccgcctccatcctcacctggccttcttttctgagggtcggtgtctgatgctgatcacgcaaagccgagtcataggagttagccacgggaaaagctactctagagctttcaccnccatgcccttgaaactcaacatattaaagaagcttttatgaaagaaaaaaaaa

SEQ ID NO: 543720 - DNA, 268 bp, Homo sapiens
gcaccccaccattctgatttcttttcttctttctttagagacggggtcttggtctgtcgcccaggcgggagcgcagtgatgcaatcatggcttcctgaaggccttgaattctggactcagcagtgctcccacctcatcctcccgagtagctgagactacagggtgcaccaccatacccagctactatcctgatttctgttaccattgattagtttgcctgttgttgaactttatataatataaatagaatcatacaatatggaaaaaa

SEQ ID NO: 543721 - DNA, 216 bp, Homo sapiens
  misc_feature (77)..(77): n is a, c, g, or t
  misc_feature (180)..(180): n is a, c, g, or t
  misc_feature (195)..(195): n is a, c, g, or t
tttttgagctggagttttgctcttgttgccaggctcctgagcagctgggactacaggcatgcaccaccatgcccggntaactttgtattcccagtagggtttctccatgttggtcaggctgatcccgaactcctgacctcaggtgatccgcctgcctcagcctctgggattataggcgtnagccactgcgcccancctccagttttcttttcttta

SEQ ID NO: 543722 - DNA, 191 bp, Homo sapiens
tttaatctttgtttctattaatttatgaaggccagggtctcactctgtcgctcagaactcccaggctcacatgatctcccacctcagcctcccaagtagctgcgactacaggcaggcaccaccccgcctggctaatttttttattttttatttttgtagaagacggagtttcaccattttgcccagactgg

SEQ ID NO: 543723 - DNA, 214 bp, Homo sapiens
ccccaataaccttggggtcttttattaataaacccctgattgcccttatcccccccttaagtaagggccggttgggtccccctcccccttttggttttttttaaaaagccaaagggagggggccgttttccgggggttcgccaaaaccaacctaaaaataatttaaggcccgttttttggaaattttttttttgaattaatttctttaaattta

SEQ ID NO: 543724 - DNA, 541 bp, Homo sapiens
  misc_feature (232)..(232): n is a, c, g, or t
  misc_feature (503)..(503): n is a, c, g, or t
  misc_feature (508)..(508): n is a, c, g, or t
  misc_feature (531)..(531): n is a, c, g, or t
ctggtgttacatttattccaaaatcaaaagcacaaaacaaaaaacaaaaaacaggagtcccatcaccaggcagccatgaccccatccccgcctgcttcctcgctcctatgctagcaataaataagtttcccagccgcgaataattataagaacctcttcctcatatgccagctgcaacctccgctaggtacgatacagaatgttacacagctacagtatgtacacggggganggggggccaccccagcagcctgtgccctggcctggtctacagttaactccactgtcccgcctcagctgcctctctgagtaagaagatgggagcccccctgagggaaaagttgctttggtgagagtaagaaggccgtcagacctcctccaaacaaaccaactccaccaacctctggctcttaaataacaaacatcatcatccagaaatgtaaggactcagccttggtcaaggtggtaaagggtctgtttgtctccctccattagacaggggnttgtnttgctaccctaatggtaaagggntgacttgggg

SEQ ID NO: 543725 - DNA, 337 bp, Homo sapiens
tgtgtctagaggcggcccatagtccttgggtcatggtcctcttcctctgtcttcaaagccaagagcaccagcaggtcgaagtccgttcgtcatgctgccagtcgtatctgattctctgaccacagcggggtaaaagtgcgtccagtggttaaggactcacatggtgtagatttgggccacttatagatcattggtatcccaaagtccttaaaaccaatcacacctgcgaagcccctttggccattgaaagtagtattcacaggttctgaggattagggcatgggcaaggttggggaatgattctgcttcccaaaatactaaacacaatccgcagatg

SEQ ID NO: 543726 - DNA, 1315 bp, Homo sapiens
  misc_feature (325)..(325): n is a, c, g, or t
attcgggacctatgcaaagacaggataaatgaggacttgatctcgagaatttacctgaccaatttgggatcctgtgttcctcgtaggtaaaccaatgcaaaaacattgaattgttactcttaacatattcctgtctactgtggtgtgggacaaagtaggattatagagccaatgtatttataagtggccttctgtagcttcacttcttagtcagtgttactcttccagtccgtccatagttattggtccgtgttgcgtcagaattttcaagtgtaactctgattgctggtgtgaagcgttctagccaaagcacgaatagtgaagntcaagaaagaagttgggactctatcactctcgtgcgtctttttcttctttcaacttgactttaacacatcatctgtttgcgcgccacagggtatcctctgtggctcccttgattcttaaaaggcatcatcgaagcttaaggatcccgagagaaaacggagaagaattattgatggacacggggttacgagatcgtggaacattggcaggacttgtgatacccacttatatgtaagtttggaagcgtattttcaaagaaggaagggaagggtcaaaggaacttggggagacaacaaatagggaatttgaagtagcacaattgggaaattacgcggagttcaaaaaaattcctccccaacgtgggtggagaaagaaggaactctggggcgcccccaaggttggtgaacatttaaggacccgaagaattgcccaattcctttttaacttgaaggtggcggccacaacccccggatgggtcgcctttgtccaaggatacgttgctcaaccggtagccaaaaaggcgttaagcccgagggcacaccaaagggggggccaaattcgcaaagcagtggggtatttccctgtttgacaaatgggttcgtctcctgtgcggcaccacaagtggctgcgagcttattcaatgcaaggtaatttccacccaaggggaattttcggcaaagcggagcggcgttgtttgtaacccccgcctgaagttgcattgtcaccaactgttgttactcgaattctgccaaaagaaggcctctccagtaaaagtttaacccccaattggtgggcgcaataccaacaagtttcaagtctccgaaattggcggacaactaagacttcgcgcacaaattaacgaggtggacgacataaccgttgagagcatcccacgttgaacaaggcacaaatgcaattaaggtgtgctcccaagagaaagagaaaaatgcagaccagattgtagagtggcaaagggtaagaaaacagtccc

SEQ ID NO: 543727 - DNA, 449 bp, Homo sapiens
aggtggattgaaagattttctgatgggcaattggtttacagagttattatctatagatctggaatcaatagaaaagagtgactgggttaagataggagttgtgaatagaaaggagtgactgggtaaaggtaaggggttgtgaagactgagattcttttttttttttttttttaaacactcttgctctgtcacccaggctggagtgcagtggcaagatttcggcttactgcaatcgcttgaacctgggaggcagaggttgcagtgagcagagatcgtgctgctgctaaaaaacacaaaaattagctgggcgtggtgacgggtgcctgtggtcccagatgctcaggaggctgaggcaggagaatcgcttgagcccggaaggtggaggttgcattgagctgagattgagccattgcactccagcctgggcaacaagagcaaaactccatctc

SEQ ID NO: 543728 - DNA, 258 bp, Homo sapiens
tcataggttcgcaggccatgttggcaggatggtctggaactcctgacctcaggtgatccacccgcctcagctttccaaagtgctgagattacaggcgtgagccaccacgcccggccaactttttatctctcttacaagttggcttaactgttacctcctttaggaatcctcaataattttcttactcttctttggccaggacactcttctgtgtctccgtagtatcttgttcataattctatccctgcgaacctatga

SEQ ID NO: 543729 - DNA, 824 bp, Homo sapiens
gcttgataacctgacagagtgcaacagtgcctacaacgaagcggattctacccttaccattgaggagggaaatctggacattcacaagaccaaagcaggaagaggaagaactcacgggtgacattcagtgaggatgatgagatcatcaacccagaggatgtggatccctcagttgtgtctgacttcaggtagacatggtgccaaactgctacgtggtcccagtctaacgaagaagcgtgtggagggccctggctccctgaggcctgggcaggaatcagggcagcaggcgcattgcagtaactttgccttcagcggaggactctacgggggcctgccccccacacgacgagtgaacgcaggctcccagccacattggcattccatgggagatgcacgtcaatcgtgtggtcttgccccatttgtcctattaacctcggaagaccttgtcccacgtgaatcgtgtgacatttgacttcctggttgtagcctgtacaaggcgaggttgcagatcattgcagatccgctgggaaccaataggccttgcagttctatagaccctggacagctgtaaaatgaacccaagaagaagaaatatgcaaaagaggcttgggccaggccaagaaagccacacaccttccttgctgatttgatatttaaggtcatggagaagggtgggactgggtgggaatggggtggaagggtgatggggaagctaatgaactagggagaaaaactttccatgtttgcgagatcgtctatcagaattgtctcctggcatcctaaaccatgtaatatgacacttgggggtggggttgaaataggca

SEQ ID NO: 543730 - DNA, 899 bp, Homo sapiens
ggcaggcgatgccggacgccgctcgcagcatctggatgagggctgcactgcaaagtgcgggcagcatgacctgtgggagatgccctgtgtgagctggagtctggacacctgcctcggagtggaagaaatgagtgtagcgtgctggttccctggaccctggccatgcccgtcccctgttctctgtgatgcccatgctgcctgtctctgtgccatgtgccatgccctggacacttgatgctggtgcctgatgctgcgatgtcccctgtgctgtcctgtgctgtgatgctgaagattgcatgtgatgtcccctgcttgtgtgacttgcttgcgctggtggccctgcctgctgtggcatgcctgtgacccagtcatcctgaccgctgcacctttgtggcgatgcttgcttgacttagagaaccatgacccagcactgtgtggtggctttacctgtctccaagcactcccttctgggatgtgtagtgtgggatgcacctgtgaccccttgggcacgactcaggcttgtagagaaggttttcgcggcaggggtattgtgtgccccgatgtctcttgacgggcttgtggtgtgttagggggggaccgcgagcctacacggttctgcctgagggacgtttccgttgccagtacttcgtttgccaccaagtcccctgtgggttgccttgttgcgcttgggggcttccgtcgattataattagtggcaacaggccgactgctattcgttacgcagtttctataatcagcatggaacgagttttatatcgcgagcttcccaaacaggcatcagggttacatttttacatacacccatttgcgaatttatatggattggcttttgacctttgaagcaacttcattattggcactacttctgaccgcttatg

SEQ ID NO: 543731 - DNA, 338 bp, Homo sapiens
catgtggtagcatggttccgcgagtgtaaaaggagggcgagtgaactcctgtttcttggtgatcgcaagagccccatgatctatagcgcgcagggcctgaggggctggccccgggttggtaactagatcgtggggtggtcaggtgttcatgagtgaggcaggagtccgaggaggccagttgtggcaataaaacatgattacggatactagtataagcagcatcaggttcgtcctttagtgttgtgtatggttatcatttgttttgaggttagtttgattagccagtagtgggtcagccagtagtgcgtcagccagtcagtgggtcagccagtagtggg

SEQ ID NO: 543732 - DNA, 392 bp, Homo sapiens
  misc_feature (146)..(146): n is a, c, g, or t
  misc_feature (181)..(181): n is a, c, g, or t
  misc_feature (184)..(184): n is a, c, g, or t
  misc_feature (219)..(219): n is a, c, g, or t
  misc_feature (289)..(289): n is a, c, g, or t
  misc_feature (336)..(336): n is a, c, g, or t
aaactgggggatcatcttcatctgggcgtaagttcgtcgacagggtgtctctgatcaagggtgtctgggattctttcaaattttttcttctgactcgcatagtaatttgtagagatgtccttgcccgtttggtacgcttgtgcttncatgattctctccatgttgccagaccatccgtacnggntggccaccaaagcacacggagattctgtcaggcgntgagacaccacagccttttcaatcttgtccttaagggctttatctttcatccaattcaggcagagggctnaaattctttgctcaactgacttacactactacttccttaggttttcntcactttcatggaacttgcactcctttccttggacaacattctggaacctcttccc

SEQ ID NO: 543733 - DNA, 1037 bp, Homo sapiens
ggaaagtattgtgaagacaggcttcttggagtaggggcagccacaattcagaagacactctaggctcggaggcatgcattggatttggcatgctcaggttgggctggttctgtgctgtatggatggacatagtgaccgtggggctggtcatctttcatgtcgtttcctctctgtatcaatggaagtgcaccccgggcgttaactctttcagatagttgtaagccaattcttctcattgtacacttgaggtgaaagtgaataaagagtgagaaaataaagttatgataccatatgagatgatctctacgagatgtgatgtggttgacatcgaaaggggaggtgggtaggctaagtgagtgaatcgtgcgtggactcgttaggatcaaaaggtgcgtgaggaaggtgtagagcaagttgatctcaatggacatgagttgatttcaagtaggcaatagataatactgtgggcttgcatggtggagtccttgagacctagttgtaaagtgggtgaaagcgtgggttttgtgaattcgcctgtggagagggagtgagtgttgagaagccagtacattcgtgtggtacacttgtaatcttagaatcctatgaagggccgaaggtgaaatggggtgagtaagaggatagcggataaggataattgggtgatatcctactcagggaagtggagatgaagtttatgattggaaacagtattataaaaaccagaacttgtgtggaagcaaaagtgtagatctgtttgcagtgcctggacaaatgagattccaagcagcagagtcagaaattagatggcaacccttgtgatagtacaaaggatgaactgggggcaatgtgtgtagatagaaagcattattgagaaaggagggaatcatttgagataaatagaaatgtagcgctgaagtgaaagtaacaggactgagtagagagaggttgaagaagaaaaaaagggagagtaagtaaaagtgggaagaggacttgtataagataacacttaagaagattaactaaggctatgagtagag

SEQ ID NO: 543734 - DNA, 351 bp, Homo sapiens
  misc_feature (282)..(282): n is a, c, g, or t
gggtcacaggttaccggtctctttcagctcaccaagcttcagctcctttacttgctgctccaactgcagtgcactcttgttctcattattctggacagagagaagcaatcagtggccacccactaaaactggagaccccagaacttggtgtctgcctcccatggcaccgggaagggtggaggcaggttagaaaaatatcccctttctcccacagccatcagagcaggactctggctcacaggtgcctttaggaagtaccatttcatgtgaaggctacaatgncccattttacaggtggggggaaacaaaggcctttgagggttaggggaagaggggcagccttccccaggt

SEQ ID NO: 543735 - DNA, 918 bp, Homo sapiens
  misc_feature (11)..(11): n is a, c, g, or t
  misc_feature (20)..(20): n is a, c, g, or t
  misc_feature (41)..(41): n is a, c, g, or t
  misc_feature (47)..(47): n is a, c, g, or t
  misc_feature (60)..(60): n is a, c, g, or t
  misc_feature (67)..(67): n is a, c, g, or t
  misc_feature (74)..(74): n is a, c, g, or t
  misc_feature (135)..(135): n is a, c, g, or t
  misc_feature (142)..(142): n is a, c, g, or t
  misc_feature (144)..(144): n is a, c, g, or t
  misc_feature (147)..(147): n is a, c, g, or t
  misc_feature (173)..(173): n is a, c, g, or t
  misc_feature (191)..(191): n is a, c, g, or t
  misc_feature (196)..(196): n is a, c, g, or t
  misc_feature (207)..(207): n is a, c, g, or t
  misc_feature (215)..(215): n is a, c, g, or t
  misc_feature (241)..(241): n is a, c, g, or t
  misc_feature (248)..(248): n is a, c, g, or t
  misc_feature (279)..(279): n is a, c, g, or t
  misc_feature (281)..(281): n is a, c, g, or t
  misc_feature (294)..(294): n is a, c, g, or t
  misc_feature (296)..(296): n is a, c, g, or t
  misc_feature (300)..(300): n is a, c, g, or t
  misc_feature (302)..(302): n is a, c, g, or t
  misc_feature (306)..(306): n is a, c, g, or t
  misc_feature (327)..(327): n is a, c, g, or t
  misc_feature (334)..(334): n is a, c, g, or t
  misc_feature (352)..(352): n is a, c, g, or t
  misc_feature (355)..(355): n is a, c, g, or t
  misc_feature (368)..(368): n is a, c, g, or t
  misc_feature (374)..(374): n is a, c, g, or t
  misc_feature (381)..(381): n is a, c, g, or t
  misc_feature (384)..(384): n is a, c, g, or t
  misc_feature (386)..(386): n is a, c, g, or t
  misc_feature (415)..(415): n is a, c, g, or t
  misc_feature (422)..(422): n is a, c, g, or t
  misc_feature (547)..(547): n is a, c, g, or t
  misc_feature (551)..(551): n is a, c, g, or t
taaactatgtnggggacggnaaccgggacccggtgtctgcncctgtngccttcgcctccnaatcccnagccacnatgcgtaaatacatctccatccacgttggccaggctggtgtccaaattggcaatgcctgcngggagcncnacngcctggaacacggcatccagcccganggccaaaagccaagtaanaaaancattgggggangaaatgantccttcaacaccttcttcagtaaaangggcgcnggcaagcacgtaccccgggctgtgtttgtananttggaacccacantnattnangaantacgcactggcacctaccgcnaacactnccaccctgaacagctcancanaggcaaggaaaangctgcnaataacnatncncgaaggcactacaccattggcaaggagancattgancttgtgttggaccgaattcgcaagcaggctgaccagtgcaccggtcttcagggcttcttggttttccacagctttggtgggggaactggttctgggttcacctccctgctcatggaacgtctctnagtngattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcta

SEQ ID NO: 543736 - DNA, 258 bp, Homo sapiens
  misc_feature (77)..(78): n is a, c, g, or t
  misc_feature (121)..(121): n is a, c, g, or t
  misc_feature (245)..(246): n is a, c, g, or t
gaattatccaacagaaaccactaggtcatagagtacggtagtattctaattaaagcaaataggacactcaccatagnnataaaacgacatattcaccaaatgctgcattcacctttaagtnactccatcataaaaaatatggattgagtcaatattcatatgacataaaatctagaacctggaagccatttcagtagatctctccatgttcgcacaattctaatatctatggttcaggtcactannttggtagtccta

SEQ ID NO: 543737 - DNA, 616 bp, Homo sapiens
acggtacgcagttccccaactttagatcattccttgtattcatatacattgttaatgtttctaatggatgtgtaaccattataaaaacttttttgggtggggtgtggtgtctcatgcctgtagtcccaacgctttgggaggccaaggtgggaggatcgcttgagcctgggagtttgagaccagccaggacaacagcgtgagaccccatctatgcaaaaaaaccaaaaaattagccaggcatggtggtgcatgcctataatcccagcactttgggaggccgaggcgggccgatcacctgaggttaggagttcataagaccagcctgactaacatggagaaaccccacctctactaaaaatgcaaaattagccaggtgtggtggtgcatgcctgtaatcccagctactcgggaggctgaggcaggagaatcccttgaaccccaggagttcaaggttacagtaagctatgatcacaccactgcatttcagcctgggtgacagagacaaactctgtctctaaattagaaaataaaaaaagaaagaaaatatggtggcacagttatacaacatgtttatgttataagctgtttttatgaaagacgtgatatgttacaaaat

SEQ ID NO: 543738 - DNA, 336 bp, Homo sapiens
ttggttattgttgttaaattatattatggagggggagaggtttgaggaaggagtggttgggggtttgaattgtaattagggtttgaataggttgatgttggttgtgtgtgatatgatggttaatttttattttaatgatttggaggtgttgtatgaggatgatgttgagggggagggggagtgggattgatgtttgtagaggtgattgaaaagttgtatgatgatgtttttgatttttttgttggttggagttggttagttgtttgaagtagggaagttgagtgtgttgttttttggtttattgttttttttataaatgtaaatgggttatgttta

SEQ ID NO: 543739 - DNA, 341 bp, Homo sapiens
ctcatatgatgctcgaccctctctgtaatgagatcctattactttcacactttactatacttcctatctataaggcctctgctcttcgagttggttcccatctgacctggcagactctctggcccttcctaagctggctacctctatatctgtccctggcgatgcctgcggctcgacgccgagaggccatcaaccagggcggcaacgcccgccgagctcatcgtcttgttgttctcctctgccatagccaagatctcctctcttaaccccgagctactcgtggaagccgtcgaccacaacggttccgctcttggggtcctgctggatgtcgactaacgccg

SEQ ID NO: 543740 - DNA, 433 bp, Homo sapiens
  misc_feature (20)..(20): n is a, c, g, or t
ggattcgctcctagacggangtatggggtcagagcctgggaaatgtacagcccaatccactatgtgggacaccagagcactcctcctaaagttgggcctaaccaacttacagattctacctctgctgcttctcatctgcaaatgccacctgctggcctgcatagcccattgcaaccattgccagcacaagtgcatagttcttgggacccagaagagcatcttgccactgctactgccatgacccacagcacagcggctgcccaaggacttgagagcctataagcatctgagaaagccatgcagaggcccatgaatcagctcacttggaaccactaacacaggtgccagcatacgtaacaccatgatatgaggatagacatgcttggccaaccactgctacctctgaagcctggagatgagcccatctggcact

SEQ ID NO: 543741 - DNA, 147 bp, Homo sapiens
ggagtaatattagctatgttttctctcagaagaccactttatcttctcaactatagaccaaaatctccttgatccattttagcattgtggtagtataaattccatgtggtttttaaattgttgccttcttaataaactattacattc

SEQ ID NO: 543742 - DNA, 392 bp, Homo sapiens
  misc_feature (226)..(227): n is a, c, g, or t
  misc_feature (244)..(244): n is a, c, g, or t
  misc_feature (322)..(322): n is a, c, g, or t
  misc_feature (368)..(368): n is a, c, g, or t
tcagattctgtacggagaaaatatcgtcaagttccgcttcagtcaacagaccgcgttccagaacgacttcacgtacactcttaccggtttcggcacagattttacccacgatgtcaccgttgtggtgaccgatgaacgggttcaggtaagtaacgataccgatagagttgtaaacgtaaccttcgcacacttctttgttagcagtgatgccaacttagtataaaanngcaggcttcaacggatncatttttctatttcatagcccggagcaacctgtgaacacattttcagtttcccgtctggcgctggcattggcttttgncgtgacgctgaccgcctgtagctcaaccccgcccgatcaacgtccntctgatcaaaccgcgcctggtacc

SEQ ID NO: 543743 - DNA, 107 bp, Homo sapiens
ggctggcagcagcacatacagtatcatgggaggacagaaggcaggaggccaaggaaagaacagaggcccagaaacaaaaagagacctaggcgctagagaaataagag

SEQ ID NO: 543744 - DNA, 132 bp, Homo sapiens
cggcacgagaaggtctctgaaaaatcttcaattggattatgttgacctctaccttattcattttccaggtgtctgtaaagccagtgaggaagtgatcccaaaagatgaaaatggaaaaatactatttaacac

SEQ ID NO: 543745 - DNA, 101 bp, Homo sapiens
agagtctaagtaactggtgctccgtatcagaggtgggatgcagatcttcgtgaagaccctgcactggataagaccatcaccctcgaagtggagcctcatgt

SEQ ID NO: 543746 - DNA, 382 bp, Homo sapiens
aaagggttgatggaggaattcacaggtgactgacacgtctttgtaaagaatgggatctgctcacttctggtctttttggccgggaactcctgattggtgttaaagcggtaatttcccccatgtgagatttaaaatcactgcgtttgagctagatgaattgttaaaatttctggttggctattagactgatgaagtgaaggttattttcatagaaccggtctttaatacaacaaaatgcttacacagagcccagacctaatttttgcctgcgcacaaatgtcttaactaatgggcgggatttttctttaaaaggtaagaatctatttgcggtttgggaaattactgaaaagacatgcctggtttggttaaacccatcaaatgg

SEQ ID NO: 543747 - DNA, 220 bp, Homo sapiens
actacaggactcatttcagaatggccgaacagtaaggggcttattcttcccacaccaccccctaataaaagagaggggaaaagaagaagagactcccacactgtcgacgcaccttttttcagaatggccgaacagtaaggggcttcttcttcccacaccaccccctaataaaagagaggggaaaagaagaagagactcccccacactgtcgacgcacctt

SEQ ID NO: 543748 - DNA, 427 bp, Homo sapiens
  misc_feature (150)..(150): n is a, c, g, or t
gcgatgacggtggatggactatccttccttggcactagtctctctgggcagcgagcagcctttacagtgcactggtggtggtgaatggacttggagcttctagtatctgctccccaaagttcaaggactcatctgcctccttgggtttgngccggggcttcagctgctctagctttttggctgcagcctcaatggcggctgcagctcccaggagggcattgcgcagcaatgactgtggggtcctctgggtctacccattctgttcccttcatggcttcagcagcctggatgagctcagtgacggaaccagccacacgctttgaatgtcctgtcaactgctgcttcagttctgggcttggcttctgcagggtcagcagtacatggtccagcagttcccggtagccattgcactccgggcgggttacga

SEQ ID NO: 543749 - DNA, 483 bp, Homo sapiens
tcgtgttatatcggatatcatattaagattctagccggctgggctcggtagcctcattctcgtgctgccagccacttagtgcacgccgaccgcggctcgggtcacttgctgatcacggagtttgcaagaccagcctggcgtacacttgcggaccctttctccacaagggatttcggatattgattgggcataatggcacacacacttgtaatcctagtagctcaggaggctgaggtgggaggatagcttgagtccagtaatttgaggctgcggtgggctatgattgtgccactgccctccagtctgggtgacagatcgagacctgcttcttaaagaaagattataacagttacccctagaagttttggggtatttgttcagtaatacaaattactgaaattttgagtaagttacttttttaagcacataaaaagattctgaagagacaggcttcttaaaattccttcagtgccctcaccatat

SEQ ID NO: 543750 - DNA, 539 bp, Homo sapiens
ggctgagacaaagctagggcttcatatgtgccagacagtcatcctgtccctgagctacagccccagtccttagactcactgatgaggtctagtgagtttgcagagtcttaagtgaggttaccagagtcctgaaggtcacacagactaataagtttcctgctcttcttgttcaagtcccagaagagagagatctgttattgtcttgtggtttccaaggagtttgctgcccctggaatctacagcttctttcctgggcatagactcttacaggcaactgtgctgggctcaggaggatctgcagagctcctgtgggcctgctctccagatccttacagcgtgggagactcagcaaatcttctttaaggacaggggagatagtttgtacatagcctgtatgtcagaccttttatttgaagattttagaaaaatacaaagttctaaagtatttagacactgggtaatatacaagtgagagtccaaggccagcctggtacttagtgtgtttccaactggctagagcttcattgtgagactgactt

SEQ ID NO: 543751 - DNA, 156 bp, Homo sapiens
attttgacccatttgtgacatagtacagctttacatactttactacttactaggatacgcgggacgatcggcctatcgctattacctacacagcgcgggacgcgttattacggcaggtgtcgggtcctaagccttccacagcggagcgagttaggt

SEQ ID NO: 543752 - DNA, 321 bp, Homo sapiens
tagcaggatccctctttacctcctaaaaatcacgcatctcgtgagtctagtaacggcaataaatatttcttgggattatacttatctgattccacccctataggaagatgatatcttatgttctttgcaactatagaagctgtgaagatcatcacaagtgcctcttaaagcgagtgttaggttcgttagagggtttaatattttctgcaatggttagtaggaatattaataaatgtagtataatatactgagatgataaagtaaaagtactatattaaatatcaaatcaaccaatacattcacatttgtgttaggcacagg

SEQ ID NO: 543753 - DNA, 231 bp, Homo sapiens
ctgccgcctacgtactacctagtgcgtgccggcagcacgaatggaagaatcgatggacatggacatgagcccccgtgagggcccagaactatctttgcggttgtgaactaaatggccggacgaaagattatcactattaatggtgtgataagtgatgaactagtgcagcaccaggttatctttgaatgaacggtgcagtttagtgggtctggtgcaaatggattgagttgc

SEQ ID NO: 543754 - DNA, 364 bp, Homo sapiens
gcactacaggcggctactgccgtaggcagttgcgggcggcaaatcagtgttggtgcgcgcacgctaacgggataaagggcgctaattaacgcgtaaacctgatgagtatggtagacacacacaggccgcgtacgccctgccgtgggggactaccgcgggagcgacgccacgcgtggatgtaccgctgtgtgacccctacaaggagagagacactagttacttgcgtgcgcccgcggtgatataaggagtcacccccgaacactgcccccgattatagcggcatcgttactgcctgactggctaacctgtaccttcatcaaaagtggtcatcacgtacccggggtttacctcgggggggggcggt

SEQ ID NO: 543755 - DNA, 169 bp, Homo sapiens
agcagtgaaccatcgagaatgtcaaggcgaggatacaagataaggaaggcattcctcctgatcagcagaggtagatctttgccggaaaacagctggaacatggtccgtaccctgtctagactaccacatccagaaagagtccaccttgcacctgggtaagggatgctgt

SEQ ID NO: 543756 - DNA, 253 bp, Homo sapiens
cctgtccagccctagatacgatatggatcctgtatgcttcaatataccggaagactgggatgagcgggccaagatcgatatcccacagactccaagcctgaggactgggacaagcccgagcatttccttcaccctcatgctcagaagcccgatgactgtgatgaatatgatcgacggatagtggagaacccccagctgattcagtaaccctgagtaccaggtgcttagtggagagccctcgcgccagtatcga

SEQ ID NO: 543757 - DNA, 384 bp, Homo sapiens
cccccaggcagaaggccgcccaaaggcggggccggtgtcttccaaattaggggctgggggcggccacagcgggcctggaaaccacagcccttaccccaatcccccgagccccgccacgaacccacaggtgtggggtttaaaaaaccatggaaggccggcccccaaccttggggggaacccctttccctcaaagccgggccccggccccgtttgggaagctcatcttgcgaagctgagggagctcagggcaaaggccaggctagcccggcccggaaggggccgaggctgcacgggcctttgccagaacgctcaggacatcccggcctgggttttcaacgctgttaggaaaattaaccaatgaataaagcaccgttcagtgcgcca

SEQ ID NO: 543758 - DNA, 131 bp, Homo sapiens
atcggggttctcgacattacagaacaggctcctctagagggatatgaagcaccgcacaggtccttatgagttactaagctggggctcgtagtgtactaggcgagacagcagtgtaagattaaactagttga

SEQ ID NO: 543759 - DNA, 279 bp, Homo sapiens
cgttttaagccagggtttcgctcattccccccggctggggggcaggggtggaataataactcactgcacccttgaactcccggattcaagcaatcctcctgcctgacccttccgagtaattgggactatggggggggcccccccccccccgcttttttttttttcctcctttttgtaaagacggggtctccctatgttgcccgggggggtttcaaactcaagtgttccttccccccccccctctataaaatttgaataaagttgtagatgagtttggta

SEQ ID NO: 543760 - DNA, 106 bp, Homo sapiens
  misc_feature (98)..(98): n is a, c, g, or t
gatcttctttataattctactttggagtgctggtctccatggtttgatggtatctgaggcagggttgctccacagggtaggctctaggaggggctggnaaacttag

SEQ ID NO: 543761 - DNA, 128 bp, Homo sapiens
actgctctggctgctgggtagcgacacgtacagcttgcgctgatcgttgaccggcttgagtgcggagacagcttgtcacgctccatgcgcgacagaatgccggtcaggctggggcgcaggatgcaggt

SEQ ID NO: 543762 - DNA, 739 bp, Homo sapiens
  misc_feature (497)..(497): n is a, c, g, or t
tctgaaggaaaaattaaatatgatgcaatgctcgacaaggacagtcaaaagacaaggtcatttatagcaaatacactgacctggttccacaggaggttatgaatgcagatgatccagaactgcaaagggccgatgaagaagctattaaagagataacacgaaaagacaagagtagaccttagaaaaatactgtatcacagaaggtcgccgcagccatagccagttcgagcagctgacaaatagggtcctgcgtcacaatataccgatacacaccatactcagcaaggagtggcggatgtcaactctaggagctgaaacaagagaggggatatcggcatcggtcagaaatagcacgaaagatccaataggagcctcccaacagtgtcaacgattcaataagaaaataccccagggggaggcaccatactccatccctgcgccagtcaatgcatactacctaaaccagaacagaaagacactgtcaacagagaaacaancaacgaagatgggagaagaataacactccctcgctatatctacacatggcaaaaaatgcaaaagggggactacaaatccacctcagacaacacgtctggcgtgctgatggaaagaaggacaacacacagaacacatcaacatgaagaatatctgcacaaaggcagaagcctctacatagctgatcggaagatcgcgaaactgcggaaagcgtgcccagtaagagaaaaaggtccacaacaca

SEQ ID NO: 543763 - DNA, 490 bp, Homo sapiens
catacctctgtctaggctatggaagatcaattctgaggacaggctgtatacgcacatattgttttagtcagaaactaggatggagctaggtgctgtgactcacacgtagaatcacagcactttggaaggcccaagtgggaggatgacttgagttcaggagttgaagaccagcctggacaatatggtgaaaccatctttacaaagaatacaaaaaattaggcaggtatggtgctgcgtgcctatagtcccaactgctcaggagaattaggtgagaggatcggctgagacgatcctcccaccctggttcactcctctcaggctagactctctctccttttcattggcttgtcttagctattaataagaagtctcggccgggcgcggtggctcacacatgtaatcccagcactttgggaggccggggcgggtggatcacgaggtcaggagatcgagaccatcctggctaacacggtgaaaccccgtcgttact

SEQ ID NO: 543764 - DNA, 162 bp, Homo sapiens
gggttatagcagtgaagacagaaaacaaatggtggtcgtttcttccttatttagtcttacttcagtgggaatcaggtacattcctatgtgaggccatatttatccttatgctcagggtctgtatgctggggcgaccattgaaggttggacaactccccgctt

SEQ ID NO: 543765 - DNA, 918 bp, Homo sapiens
  misc_feature (369)..(369): n is a, c, g, or t
  misc_feature (372)..(372): n is a, c, g, or t
agtggtgtacaacatgccgtgaggatggcgggtgcatgtaggatcaggtgtgctcctggtcagtcgcgtggccccgtacagtgtagatcggcttggcatctattcgatctgaggtggcttgcgttgtcatcatgcaagtacctcaagggcctcgggtggatgatgcgggagcgttgcatcattcgacatccctttatgtgttgtttctggggtgctcattacctggcatctattccatatcaaggagctacgtatgccgtacatgcgcatgtcaccttgttagtccaccgcaagctgtggagaccatatatttaaacgggtaaccagcccgtttgtcacattgggaagacgtctccaaaagaaccctanaangcctttggaattgaaacttttaacagcggggaaacataatttttgggtacctttttcattcctaatccctttgtgggcatttccacccttttggttggtgcttcctacaggaaaattggtttggcttttaagtggacaaagagcttaaacgaaattctcaccgatggttgaacctggttgacaggttggtccgcagttctcaaggggggattcccaacttttagccaattcttgggcgctggcgattcacaatcaccaccaaaggaaaagaacatggggtggcgtttgtggggcccacatttgaaacatacggaactcttgtgtccagactttaaacttaagacagaattttccgcgaggacttacggttgttgctggtaagaacgggttcctggatctttggcaactaaagaagcggtctcttccattaatttggaccccaaatggaggtcatcaagcattttgagccgtcaaacgaatctcccaagtggggccgaagcgtggaaagaaacctccggttggtgacgggggtcccgtatgtagaga

SEQ ID NO: 543766 - DNA, 323 bp, Homo sapiens
caggaagtcccttgccatcctaaaagcccccccccttctttttaaggggaatggcccagtcctttcccaagtccccacagggggggtgatagccttgctttttgtttaaattatggaaggcaaaattttttttattttccccctaaaaccttttttattttgttttattttgaatgatgggccttcgggcccccccttcccccttttttgtcccccaactttagatgtatgaaggcttttggtttccctgggagtgggtgggggcagccaggggtttcctgttccctgacttggggcccgttgaataaaagggccccccttta

SEQ ID NO: 543767 - DNA, 286 bp, Homo sapiens
cacccaggtagaagtgcagtgccagagatcttggtcaatgcaacccccgtcccaggttcaagcgattctcaagcctcttaaatagctggtattacaggcatgcaccacagcacccggctaatttttgtatttttagtagagacaaagtttcaccacactggtcaggctggtctcgaactgcctggtgatcgaggtgatccacccacctcggcctcccaaagtgctgggattacaggtgtgagccaccgcgcctggcccattttatctttatttttatttttgtggg

SEQ ID NO: 543768 - DNA, 345 bp, Homo sapiens
gtagcagggtgctggcaaaggtggtgggtagctggtgccagtggtttactggccatttgaggttattcctcaggtattggaattaaaatgggatgcaagtcaaggaaatcaattggcaagatcagcatggaacacagcggcaggtcctacaaagcttcccagatataagggtgggatctcaaaagctggcccggtgaggcatttggctttaacaatgggcagttggagcagccaaggtgtggggacccaaaatctgccgggaagataatgtgtaaatgaggggtggtgaagagtattgtgggaggaggggatcatggtggcctgggcagttgggaaaccgggaga

SEQ ID NO: 543769 - DNA, 601 bp, Homo sapiens
  misc_feature (591)..(591): n is a, c, g, or t
tgattaatggcgcatcaggagaaacacaagattgctgctataataaatgcactcttacacgcttgagcggatattcagccaacgtagaagacatgcggacgattaaggtgaagaacttggggtcattaaagaaagtctgacggattggcttgcagcttttgagacggatgataactaccatcagtgagatgacctgaaacaaccactcttaatgacttgaaaaagtacccatcccaaagtcaactatgggttttcaatattgtatatttaactgaagataaagttcatgttaaaacccattttattgaagtgagagaagaatctcgtgtacatcatgattctcaagccatatatgaagaaagagatggcaattacattccgaaagtgtgcattaatatacacaaaatgtgactgtgttacccatgctgtcctcgagctcgtaggttcaagcgaccctcctgccttgaactgccaaagtgctgtgatatcaggcatgagcgcacactcccaggtgtgagtacattactgtgggtgtttaatgccactaacacaggaggttgccgaacacatactgattggcgtaagcacagngattcattct

SEQ ID NO: 543770 - DNA, 267 bp, Homo sapiens
tgagatgaggaggagggtatggaatggaggtgagaaggtggtgccagagttggtattgccttggaagcgcgtggcctggcccctcggaagacagatgccttaggccgggtccgtgttgtctaaagtacaccacgttcccaatggatgatgcttgaagatagagcgtgaggagtccagctgtagcaccagaatgcaagggagctggtacagggatagaaggtcctctaaggatttgaccctgtaagaggttttggtgaccgaaggagt

SEQ ID NO: 543771 - DNA, 99 bp, Homo sapiens
ttcttgggccttggggggggtttctttttccccctgggccccactttggcccttgggccttttttggtgtcccttttgttcctgtttgcccccgggccc

SEQ ID NO: 543772 - DNA, 759 bp, Homo sapiens
tgacccctgtaagttaagatatactgatctctacccagggttcggcagataagtctcccatcattagtcaaactatactaactcacggcaaaggacccaaccattggtgatgaccactatgagtgtgcgtactgagctatgatatcgatgggatacctagtggtcaaccgagagacgcatcaacatcactgatctaaactcgtaaggcgactaagactgtagatacaacgagcatatctctaacctcctgccatacactataatctatctgctatgcacacaccggctgtcaaagtattaagctgacatccgccacactccactgggaagcaatatgaaatgatctgctgcagtgctctagagcgcctaggattcatcttgcttttcggccgtaggtggcctgactggcatgtattagcgaaagctcatgcacatagacatcgtactacacgacacgtactaccgttgtagctcacttccactatgtcctatcaataggagctggattgccatcataggaggcttcattcactgattatcccctattctccaggctacaccgctagaccagacctacgccaaaatccagttcactcatcatattcatcggacgtaaatctaaactttcttcccacaagactgttgctcggactatccggaatgcccccgacgtaactcggacttacccgatggatacaccacatgaaaacatcctatcatctgtaagggtccttcatttctctaacagcagtcatatta

SEQ ID NO: 543773 - DNA, 542 bp, Homo sapiens
ttgttgggggtttcagggtctcccagttaatgtatgtgtctcacctgagtttccagcctgttttgaacttgggcttttgtcgttgatggtggtagtattgttttgtctataactgttgttacaggtctgtacttgatcggcacctcctgctatcttctttcctgatgggttgccagttattgttatcggtggggggagtgggcggccttatagcccatctgcttcttaaagttccctatcccattaattgaacatagtaaattagtaagaattattctctagtattcattcagacatttaatagattttttatactatctgcacttctcgtttatcactctacaatctgcacaggtactttttgattactcttatttcacccctccctccattaaggcttttatttactgtttctggagaatcctcgctcagccacttacgttttcttcccttgattctttcaagcttaggaaactagtatattagactatttttagttttcctaagcttgaaaccaatcccagtacaggaaaaaaaaaaaa

SEQ ID NO: 543774 - DNA, 745 bp, Homo sapiens
ggccccccacattcggggaaccaagggtgccctcccctacaggctggggttgcgcccctctcagggcgaccggtgccctctcctcggtccactcagcttgggcttcccccctactttcatctctcccccacggagatctcccctcccggcggtcccacactttggcgccgcccccccgctgggcgaggtgtccgctgcccagctggcgcgagtctttctttccccttcgcgggagtgccgctcctctcccctgcgcggggtggttgccagccgccaccttcgtccggcttgccccccgtgtattcggcggcctgcagcgtaggaagcagtttccctgggggaatattctcttcatcgccgagtttccgtgcttcaacatgtcccgcgcccggtcgccccaccgtaatactcccccctctggcagccgcctgcgcactcgttgtccgaccgccttcccccacgccgaggtctatcgtccatctgcagaaaggcatctggtgggcagagaggggcccaccccgctgatagagagcggtgccgggcgacacactagtgcgtcccgctttgctcaccacgacagatattagcgccagctctcgctcacatgcgagccgctggcggggatcccctccctgccctccgcgggtgccccccccaggtgggtcgtgcgcgcgcccgccttcgcgggtctcttttctatttgcaagccacatcaaaagacccaacgttcttatcaatgacgaaa

SEQ ID NO: 543775 - DNA, 391 bp, Homo sapiens
tcgctggcgctctgaaggcgtgtgggatggcaggcgtgggacgggagcagtgtggtgctgcgctcccagcgcctctgcttggtcccgatcttgatatgtgcgctgacatctgccggatctcgctgatcttgctgtcctggtgcccgatcacacaggcaatcaaatcgttgggagcaaagaactcctgtgagctggactgagtgacgggatccagtcctggcaacaagctgggtgtggcaaaggggaccgcatggatagagaagcatgttgagcatggtgacctacagttggggtcacaagcccccaatactagaccctggaacagagaaaggccctggtatggcagagaagaagaaaaagtacctagggaagaggctcggatggaagggga

SEQ ID NO: 543776 - DNA, 396 bp, Homo sapiens
tttgcctctcacagtgacagcataacaggatgtgatggccttctctggggttgagacaggctctgtcaatgtggagcgcaagaggagatgttcatataacttggtaaaagcatgttctaaggcatgtgtaagctaggctgctaagttgtgctgtgtgaatgaaaagccaacagtaagcctccagtgaagggttttttgaggccgtatgtgtggtattagaatatattgaggttgatacatgaaaatgcttggaagtgatggggattagtgagaaacttatgatggtgcattgccttttataaacatggagtgaaagccatttgactgaacgtttgctgtgcttgaagaattgcttcaggacccgagcgtttgtatgtatgctgttcctgcagttag

SEQ ID NO: 543777 - DNA, 108 bp, Homo sapiens
  misc_feature (18)..(18): n is a, c, g, or t
gtctcgactctggcctcnaagtgatcacttccttgaactcccaaagtgcacaaagtgctgggattacaggcgtgagccactgcgcccggcctgtaacactcattttag

SEQ ID NO: 543778 - DNA, 207 bp, Homo sapiens
aggccgggtacgctgtcgtcacctcggacgagttcgagggcgatcccgccagcgtcgtcaccgagttcgacccctacgaggcgtgagccttgctccggggcaggtcgcgacctgcctcagtcatgaacggcggtgtggagggggcagcccgaccatccttgtatggacggtctccgtcagtgcgtatatgcacggtctgtatggacg

SEQ ID NO: 543779 - DNA, 862 bp, Homo sapiens
gggcggcgcaggtgagagcgcgcgcttgcggacgcggtggtattaaaacggttgcaggcgtagcagaagtggtcgttgtctttctaggtctcagccggtcgtcgcgacgttcgcccgctcgctctgaggctcctgaagccgaaaccagctagacttttcctccttcccgcctgcctgtagcggcgttgttgccacctccgccaccatgttcgagggcgcgcctgggtccagggcctccatcctcaagaaggtgtggaggcactcaagggacctcatcaacgaggcctgctgggatattagctccagcggtgtaaacctgcagagcatggcactcgctccccaacgtatcattatggtagcagatcacccctgggggtctgagggcttcgacacctaccgtgcgaccgcaaacctggacattgggcgtgaacctcacccagtatgtccaaaatactaacatgcgccggcaaatgaagatatcattacactaagggccgaagatacgcggataccttggcgctaggtatttgaagcacaaagcaggaggacagttcagacttgttgaaatgaagttgatggattaaggatgtgtgaacaacttgggaattccagaacaggagttacgctagtgtaggtacagatgcgttgctgttgaatttgcacgtttattgcggggattaggcatatggggagatgcatgtggaaatttctgtgcataaagaaggggtgaattattaaggggggaatttgaatggaacgtaatggacggaaggaatgcgaaagaggagacacggaactaaagaggaacagtacagtagtgatgggcagaattaaaaggatcaaattaaggaaatttgtgcac

SEQ ID NO: 543780 - DNA, 771 bp, Homo sapiens
ggcttcaattcaacaagaagacctaactatcctaaatatatattcatccaacacaggagcacccagattcataagtaaagttcttagagacctacaaagtatgtttcacagtaatagtgggagactttcacactccaatgacagtattagatcattgaggcaaaaaaatgaacaaagatattcaggacctgaactcaacattggatcaaatggatctgatagacctttacagaactctgcactcaaaaacaacagaatatgcattcctcacatcatcatatgccacatactctaaaatcaaccacataattggacataaagcaatcctcagcaaatgcaaaacaactgaactcataccaaatacacactgagatcacagtgcagtaaaaatagaagactaagaaaattgctgaaaatcatgcaattacatggaaatcaatcaacatgctcctgaatgactttttaataaataatgaaattaaggcagaaaacaagaagttctttgaaaataatgagaacaaagttgcaacatactagagcctctggacatagctaaggcaatgttaggagggaaatttatagcactaaatcccacatcaaaaagttaggaagaactcaaattaataacctaacatcacaacggacaagaactagagaagcaagacaaaacccaaagctagaggaagacaagaaataatgaaaatccgagctgaattcaagaaccgagacatgaagaaacaaaattccaaagatctacggaatcagggtaag

SEQ ID NO: 543781 - DNA, 194 bp, Homo sapiens
cacaatgtttcttccggttcgatattgtgtagaatttatgctcacagccattggctgaccacacacacggctatactcctgtgtgagtcaaaatgtgacggctcagctggtagtccctgatgcaggccttgccacacccttatgccgaaaatactttcagcatcagggtgagttgactgaaatcaaagaacatc

SEQ ID NO: 543782 - DNA, 332 bp, Homo sapiens
  misc_feature (24)..(24): n is a, c, g, or t
gagacagagtctcactctatcacncaggctggagtgcagtggcacaatctgggctcactgcaacctccacctcccgggttcaagcgattctcctgcctcagcctcccgagtagctgggattacaggtgcctgccaccatgcccggctaatttttgtattttagtagaggtggggtttcaccatgttggccaggctggtcttgaactcctgacttcaaataatccacccacctcggcctcccagagttctgggattacaggcatgagccacagcgcctggccccctggatcatccttgattcaccctttgtctgacccttctgtcgtcttctc

SEQ ID NO: 543783 - DNA, 423 bp, Homo sapiens
cctgcacctgataaagttgaaacatttgcgttcgaaattgcgatttgtcttatggcgtgattgaaacaatccacaacaaataaaatcgtattatcattgctcaatgctaaactatgaggctgattgaatcttgcggttagttccaattccgtctgtgaatccaatttgaccaagaaaaccagcaaaaagtgttgcgtttgcgtttgggattgaaattcttcgaattgagtgatcttgaagttcactcacaaaaagagagttacttgaagaatgaaaaatgtttccaaaaggaaaattaaatgaagtactaccaaaagttgaaactgtggataaatccgctgatttttttttattttattgggttttttgtttttcattttcattttcattctcattactagataatctacgaattaaaccatt

SEQ ID NO: 543784 - DNA, 1090 bp, Homo sapiens
ctgtttgccacagaggatgcacctgagaggtcctggcggcagagcctggccacaaagatccaagactgcctgcgagggcgctttcactggacggcagaaattcctccgggctgaacgagatcagccatcatgcatccagtcgtggatggcagtggaacactggagccggaggaaggcagccaagaggaagctgggcaggcacagaccatccggcggcctcatccgaggcttcgtcctgcgccacgccccccgctgccccgagaacgccttcttcctggaccatgtgcgcaccatcttcatttgctaaacctgaggcggcagcatgccccagaatgtcctggacacgctcgtggcccagcgcccaccacctgccctgacgctgaggcctcagagcttctgcgggagtcgtgcataacgaccatggtgtggcaactactgccggagtatcagccctgagctggaagcagcagcctgcaagcagaaggccgctggctacgtgagcatcttccagggcaagaaggataactcaccctcagaagtgtaccccaggcctctctcatcacgcactcgacgcttggtacacgatcgcgatcacgccccgaagtgcttgcaggaccttgggctctgagccaattcacgcactgcggtgcctcgcatgtgacaatccaacccgcaaagggctcaaagcctcgctcccgggaagctgagcgagaaaagcccaacgccgcaccaacacgagaacgacgccccaacgcctaacaccacgactggataggcccaacgccccgggagcaccgccacacgcagagagacaaatacagggcgacaacgtacacagagtcagacaccaagcacaacgggcaacgagcagaataaaaagcacacgaggaacgagaagccgcacacgaccaccctcagagccacagcgaaaaagtgcaacacgactacaggagaaacccacacgaaggagaccagacaaagacggacgactcaacccacgagagagacctgtacccacggacaaggctgcagtgagcacacagaacacgcagaacaagacaccccacaacgagacaccgcaaaacacaca

SEQ ID NO: 543785 - DNA, 184 bp, Homo sapiens
caaaccaaagttgcatcatttaggtcaagtgtttgtcctcagcagggcaaaaacccactgcacacatttcacattagccagtgctgtgcacagcttcttcacctaataccaaggcctcaaaatcagcctgcagtggaggtttcagtcctctgtacaggtgcttagacaaaagccctccgctgat

SEQ ID NO: 543786 - DNA, 279 bp, Homo sapiens
caatgtagctcagggcagcgctgagtggcacgccctccgggccaagtacttcaccgcatccgaagcgccggcaatgatgggcgtctcgaagtatcaaacccgcactgagttgttgcaccagaagaagacgggtatcgctcaggaggtaacagcggcccagcaggctaccttcgaccgcggtcacgcaactgaggagcttgcccgccctatcgtcgagcgaatgatcggcggggatctcttcccggtcgtgggcaccgaagacaatctgctggcctccat

SEQ ID NO: 543787 - DNA, 389 bp, Homo sapiens
ccttcctacaagctgccaaatcagtcacaaaatattaaacaacaagacacctctctaccggtaaacttgagaggggtgtaaaacaaaagactcttgagagcgcacttaagctgtaaaaacactcattcctattcctaaattgagtgtaccaggttacatgtactaagtgccttacaataaaccaggcaatgtgctttatctggagaaagggagccctaacttcaaagttagagttcctccaacttatttaatagttaaatttcaagtacgttagactgaaaatcatatgggtttccacgtcaaagattagaacaaatcatcattaaagatcataacagcagttcaggtctttaaattctattttcctttgttcaccaatatttccgttt

SEQ ID NO: 543788 - DNA, 311 bp, Homo sapiens
gggaggttgtactaccaggtctactgctacactgttcacaattgccaagatttggaagcaatctaagtgtccatcagtaggtgaatgaataaggccgggtgcagtggcttgtgcctgtaaccccagcactttgggatgctgaggtgggcggatcacaaggtcaggagatagagaccatcctggctaacacggtgaaaccccgtctctactaaaaatacaaaataaaaaaaaattagccaggtgtgatggcaggcgcctgtggtcccagctgctcgggaggctgaggcaggagaacagcatgaacccaggag

SEQ ID NO: 543789 - DNA, 223 bp, Homo sapiens
aagtgaactctacttctgtatcaggcagctcagagtagaaagtaaggggcagagtcatacgtgtggccaggaagtagccaggatgaagagagactcggtgcgggcaggagagaatgcctgcggggtccctacacctgagctaggtgagataccggaattcctactgatggtacatgaagcacttctagggttctatcctgtctgctaacccatgggagggtcc

SEQ ID NO: 543790 - DNA, 203 bp, Homo sapiens
accggcccgttgggaaatgcatgtgaggcacttcctcaaagaactaaaagcagaactaccatttgacccagcaatcccattatttggcatatacccagaggaatataaattgttgcatcataaaggcacatgcatgcatatgttcactgcagtgctattcactaagagccacgcgaagagcccgccacgtgccccgccatgcg

SEQ ID NO: 543791 - DNA, 517 bp, Homo sapiens
  misc_feature (170)..(170): n is a, c, g, or t
agcacggttcggtcagggtatcttttccccgcccctaagcgattgggggatagaatagaaagaatggtttgcctcagtttgaaccttgcccctgatgcaaaggtggaagaagaggccgaagaagacccttaaggggccgccgaagccccccccgaaggcccagggccagncgaagattaaaaaatggatgtggggcccgatgaagaagaagaacccgcaaagggatttcccgctgaaaaagatggattgttaattatactctccccctttgggtcctgggtggagagggaatgtgaaatttacctcctttctttttgggggaggcttgttttggatgccccctaatccccttttccccgggcctgtaaaatgtggggttttggggcccaggaaaaagggggttttttagttgaatttttttttaccttcctcctgaagggaaatttgggctttttaactggctttttttgatggaaaattttgtcatggggtttaaaataaaaaaggttcccaatta

SEQ ID NO: 543792 - DNA, 139 bp, Homo sapiens
tggggcccccccttcccccttttttgtcccccaacttgaaatgtttgaaggcttttggtttccctgggggtgggtgggggcagccagggctttcctgttccctgactttagaccagttgaataaaagtgccccccttta

SEQ ID NO: 543793 - DNA, 478 bp, Homo sapiens
  misc_feature (107)..(107): n is a, c, g, or t
  misc_feature (128)..(128): n is a, c, g, or t
  misc_feature (133)..(133): n is a, c, g, or t
  misc_feature (185)..(185): n is a, c, g, or t
  misc_feature (195)..(196): n is a, c, g, or t
  misc_feature (206)..(206): n is a, c, g, or t
  misc_feature (216)..(216): n is a, c, g, or t
atagatatcaaaatggtgccgagagacgatgggaaaaattctagcagatactctgaacaatccagagaatcaaaaaaatcaggccgggctgcccccgggccaaaaanaaaaagggggggaaagggggnaaaanaaaaaaaagaaaggggttttttcctttctcccccccaaaaggggccccaaanaaaaaaaaanncccaaaaaanaaaaattatnattttttcttacaaaatgacataaactgggccatgccttatattcagttgaaacaaattattttttactttgacgaactttatagagaattcttgtataaagtattggtttgtatttgtaaatttaaaaaatgttttcattttaacatgttttataattgatacatctcaaggccctacccataaaattatttgaaaactttcaccagaaagggatgtaagtctcgcttatattttgtgaataaaatgatcaaaagctcaaa

SEQ ID NO: 543794 - DNA, 173 bp, Homo sapiens
gcccacagggtccctgggcggagggcaggagcatccagttggagttgacaaatatttctgtgagtgttgcagagagctgctggacacagtggataactatgccgtcctccagctggatatagtgtggtattacttccgcctggaacagctggaatgccttgatgatgcagaaa

SEQ ID NO: 543795 - DNA, 717 bp, Homo sapiens
cacttgcccctccttgggcctttccatccatcttttccaacctttcccatgattctggtaaactttcttgaatggtttcatgattattggctctcctgtctttctgtgtttctatttcaaactcccatcactcgctatggggctttcagaactagtgttccactttatcttccccacctccgttttctacgtggtctttttgttttggtgtgtgtagtgtgtgtcttcaagacaggatctcactctgaaatgagacggagtctcagcctggagtgcagtggtgcagtcatggctcactgcagcctcaaactcctgggctcaagtgatcctcctgcctcagcctcctgtgtagctcggactacaggtgtgtgccgccacactggctaatttttgtagagatggggtctcgccatgttgcccaggctgttcttgaactgacctcgagtgatcctcacgcctgtgattccagcacttttggggaggctgaggcgggcggatcacctgaggtcaaggagttcagggaccggccgtggccaacaatgggtgaaaacccctgtccactacttaaaaaataccaaaagatgtggctgggcatggcggtgggtgcctgtaagtcccagctactgggaggccggggtaaggaagatcacttgacccagggaggcaaagttgcgggaccggagtgggcattgcgccaccggggcaaaagacagatcg

SEQ ID NO: 543796 - DNA, 433 bp, Homo sapiens
  misc_feature (11)..(11): n is a, c, g, or t
  misc_feature (414)..(414): n is a, c, g, or t
cccagcccccngtggaacctgtgaagtaccattaaaacccctcccttcccttaataaaccttacccccagtcctcaggtatgtcctttatccagccagccatgagaaatggacctaatataagtaaattggtacctgatagagtgaagtgccttctgtaaagataccccacaaatgtggaagcaactttggaactgggcaatatttggagggctcagaagaagacaggaaaatgttggaaagtttggaacttcctagagacttgttgaatggctttgactgaaatgctgataatgatatggaaaatgaaatccaggctgaggtggtctcagatgaagatgaagaacttgttggtaactggagtaaaggtgactcttgctatattttagtaaagagactggcagcgtttactccnaccctagagatttgtggaa

SEQ ID NO: 543797 - DNA, 299 bp, Homo sapiens
cttgcacatttgcccctccccttacactaaaacctttaccgatgtcactctttgcgccacttaacttcaacatttggcctactcacgctcttctgcagttctcctgagatgacttgaatatgaaccaaagctgcactgtgctgtacttttcagcttcaactgggactactcttcccaggataaaagcagctccagtccctgacggtgttcgtgccaacaagcacagcggtaaccctccattctctaacccagttagtcaatatgttttatcgcctcttgatggaaaatattcagaaaaa

SEQ ID NO: 543798 - DNA, 500 bp, Homo sapiens
  misc_feature (212)..(212): n is a, c, g, or t
  misc_feature (267)..(267): n is a, c, g, or t
  misc_feature (317)..(317): n is a, c, g, or t
  misc_feature (327)..(327): n is a, c, g, or t
  misc_feature (335)..(335): n is a, c, g, or t
  misc_feature (337)..(337): n is a, c, g, or t
  misc_feature (349)..(349): n is a, c, g, or t
  misc_feature (455)..(455): n is a, c, g, or t
gacgctgacgatctcctccacgtccgacaagtcctcgttctcgtggtatcgctggcggtcaatcgggcgctgcgaggacccaaaccagagagcccgggacattattgtgggggctggaggtcgcctctcaacctgggcccagcactaacaggtgcagcagccgagcgccccctgcaccccaccattgcaacccaagcaactttgcgcaattnccaaagatgctgaaaagcaggacaaggagaggggcccgcaccccgagggtccagntgcgctctacgcggggtactcccctccggtgtcttcggaagcactgaagngacatctggngaccctcncntgccccccgccnccgaaatgtgctgggcttcgcccactcggccgggagcctggttatgtaacccgcgaagggggctccggacacgggctggcggggcaaatgtaggccccaggagganccgctgcggcgcccggctcggcggtaacagcagccccagcggccg

SEQ ID NO: 543799 - DNA, 773 bp, Homo sapiens
  misc_feature (8)..(8): n is a, c, g, or t
  misc_feature (114)..(114): n is a, c, g, or t
  misc_feature (477)..(477): n is a, c, g, or t
  misc_feature (676)..(676): n is a, c, g, or t
tagccggngactcgcacactagatctctcctcacatagttatgattcctattcttacccactgtcttgcatttcgcttaaatcgggcgccgcttgcccgccatgtattatcgtnatacactttctcattctctcgccacacccatctccttatatctctttactccggtcgaccttgctcgctgcagtgttcctcattttcgctccccatgctattctgcgcttctctgtgtcaatccttttcagcataatccctttttccagtttcgccccttctcaaacctttcccgatccctttcctctccatgacatttctctacacttctccacttctaccttctttctctaccctctttacgactcgttacccctaatatatacaaattcattcctccctacataacctaccttctctttttatctctctcctctctaacaactccatatgtattttttccctcattcatatccttctctngtcacatttatcctatcatcactctgctatattctctcatttcaatatattctgtttgcacaccacacaccacactttcctcttttgtcacatccaatatcctcttatacatcaatcatctctactttctcggaacaattacatcttcatttataacatcctctcacactttcttttacgtttttcatttctcatacanacactatatcctactctctcgcatcatcttctttctcttcatatacatcctttacactacatcttcttatacccatctcatcatctctctcctcccg

SEQ ID NO: 543800 - DNA, 890 bp, Homo sapiens
tggcacgagggcgagaggacctcccgttcttctctccttttttccgtcagagtccgtcctgagtgggaggacgtccctctctccgtctccactttcctcgagtttcctcctcagggggaggacttccagtcttctctccagagtcctgtgacgctgtctgctcttccgttccacttcttctgagtcgttccccgagagtttccctgagagtcctcagagtcctcctgacggggctggtcacgtctcctctccaggagacctgtctagctgcgcttcttctcctacagctttagcgaggtcttagtccaagagttcccatgagagtcctcagagtcctcctgaggggcctgcccagtgtcctctccagagtcctgtgatgctccttgccctcgctccacttcatcgagtctttcccagtaggttccgcctgtgaagactaccttccccttcctgccattttgatcgaaaatgctttccaaggagttgcccctgaggagcttcctacgtccgaagagtaccgtggtgatactccttttcttcgcttcctgcgcaagtttcattgtaggcccattgcagtgtacagtgccatggcaggccccagataagacttaaattagtacaaagttcctccagacaaccccttgacttaatgaagaagatagaattcccctttggatcaaggaacgacggcggaaagatacccttattgagttagaagaaagccgaatgtcccccttttgttttcggaccctaaataacaacctggggttcaaacaacagcgggcgggacccgaaatctccacggcaaggggtttctgttcgcccctctcgaaaaaatcccaggatcgaaagcaagcctatatattacagaaggcgccaaaatattcttc

SEQ ID NO: 543801 - DNA, 846 bp, Homo sapiens
  misc_feature (807)..(807): n is a, c, g, or t
tagtttgttatggggttgtgttaattatactcgatcttgttctgcatttttaacttatctttttgtatatgctattaaaggttctttagggtttttggctatgcaggtcttgttaaatgttatgttactcgtgttcttatgtttatatagaaaccaccccgttgtgtccggtttgccaatctgtgttgattctttagggacttgaatgaattgggaagagttgtagtctagacctagtttagcccgtctctgtggttccttgttacatgttcccatgtaggaggcttaaccatatttctggaagtgtctatgttacttccattaatgactttaattttagtgattatgatggtcttggattgtctgtcctcagttagctattattataacatcaatgttactatctgtatcaggccctacatagtacatacagttgagtgggagtatacattaatagatttacatgcgtgttaatggctgttcgtagagaaatcggatataaaagcctaaactaggactacttcatcacagtgttgtatgttggacacatagatggtgatggcaaaggtttagaacacattattttcaaagactaaatctaataaccctagagtaaacatcaatgctctagtagttagcataatttggagctattcagggattgcagagaatgcattttcacagataatcaagatgttatttttgtatactatatcacttagacaactgtgtttcatttgctgtaatcagtttgttaaaagtcacgatggtaagagttaacgcagggctagatcatattaatgcgangggttcattccataaggtcgggcgtctttcgtcgtgtcg

SEQ ID NO: 543802 - DNA, 394 bp, Homo sapiens
agccttcggtctacaaacacactgatatctacactgttagctctgaaacttcacattaaactgagctgatgtgtacatgacaaataggcataaaatacaaatacagtatctgcttacaggtaatatacggaacaataacaagggactgaaggtacaaaacacacacggacattatggtcataataaatatatagaagtacctaacgttaacaatattagtaagaagttgcacatttagctatattattaaagcatttccccacatatttaatcatctgtagatcctctgcagtaaagattgagcacccccccgaaacttataatttggatacaaagcctcgcactgacactcaaggctggagtgccagtggaatgatcttagctcactacaaac

SEQ ID NO: 543803 - DNA, 951 bp, Homo sapiens
tacacgtatcctgaacactggagggcttcacggctctcatcgctgctcagtacagcggggctcaggtccgcgtgctctccgcaccaccccacttccatttaggccaaaccaaccgcacccctgaatttctccgcgaaattctcctgtccggcaacggtcccagtgatttgagggtgatgatggatatctgtgtgtttgagagctaacgccgagttgccgtactatgtgagcaatgaggagctgctggggaagttactccagaggcagcagcccaggtggtgcgagtagggtgagctttgctgatgccggatatagtgcccccagcgccagtaccctgggtgttccccgaccgttgggcatcatgcaagcacaacgaaacaggccacttgaggaatgcaagaggaggaagtgaaggcgaattctggggctgctggatgcttacgttgaagtacgaggactttgctggtgggcgaacgagtgacattggctgacatcacaggttgtctgcacccctgttgtggcctcttataagcaggttctatgagccttcgtttccgcctaggcctttccgcaaataccaagccgcgtggttccgtcacctgcattaaccagccccagttccgggctgtctgggggaggtgaacctgtgtgcgaagatggcccagtctgatgctacaagtttgctgagacccaaccttaaatagggtctccccacggtgtgagcaggtcacgggaagagaagcggagagcccgggctgagcggctggcgtgtcaccatggggtggccctgcttctgtgggacgggcatgggttgatgtgagccgcgcggtggttgtgccaggcagggccttcgtcccttgccggcgtcctttggttgggggggttaggcgcgtctcctggggagcctcctggggggcgcttctggggcctgtagcgggggccccggacccg

SEQ ID NO: 543804 - DNA, 517 bp, Homo sapiens
  misc_feature (104)..(104): n is a, c, g, or t
gggacaaagtgctgaacagctggacagcgagaaagtggcccatctgtgctcggtcaaaggcatagggctcgtgacagccgccagcctaatgtcctacctccccnagttgggtgaggtgggcaggcacgagatcgccgcattagcaggtgtagccccctataacgacgacagcggcaagcataaaggtaagcgtcacatcagcggtggacggtttgctgtgaggcgctcgttgtacatggccagctggatcgtaattcggtatcagccagaatttaatgcccgatacaagggttacgcgacaaaggcaaatgcccaaagtggcactcatcgcctgcatgcgagtcttgctgatccgcttgaacgcgatgatccgtgacggttctgaatggaaagaacacgtcgcctaatgtggctgcggttgtttccttaagaaattgcatggcctagagctgtgggagcttgaccgtcccttgaaatgattttcaaaaaaacggtcaagacagttgctcgtcgacgc

SEQ ID NO: 543805 - DNA, 202 bp, Homo sapiens
caggctgaggcatgacttctctcatctctcatttctggtccggctgctatgatgggtgcatttatctcctgctatgaactttcatcgtcttcctcatgggagccgggttcctcttacttctcctttacctcctcagaatcatccttcctcaaatggctcctatccttgaccatgtgtgtcctcggtgcgtgtatgggctgat

SEQ ID NO: 543806 - DNA, 319 bp, Homo sapiens
ccaagctagtcccctgtacgactttgacttcagagagaagcaaggttttacacaacaaagatgatctgcttattatcaggatcattcagatgctgggttgagcaccgacacaggggacaacagcagaaacgcgggtcagttagcaggctgcaataatatatgttgtgcaaaagtacttgcagtttagccattacttctaatgtaatgcaaactacttttgcacaaacccataatgagatgagaagtgatacaagctgggaaccagagtggtagttctggaggtagtgcaaacagtgatcatagccaagcatgatggcac

SEQ ID NO: 543807 - DNA, 484 bp, Homo sapiens
  misc_feature (58)..(58): n is a, c, g, or t
  misc_feature (69)..(69): n is a, c, g, or t
  misc_feature (73)..(73): n is a, c, g, or t
  misc_feature (82)..(82): n is a, c, g, or t
  misc_feature (89)..(89): n is a, c, g, or t
  misc_feature (107)..(107): n is a, c, g, or t
  misc_feature (119)..(119): n is a, c, g, or t
  misc_feature (125)..(125): n is a, c, g, or t
  misc_feature (131)..(131): n is a, c, g, or t
  misc_feature (140)..(140): n is a, c, g, or t
  misc_feature (146)..(146): n is a, c, g, or t
  misc_feature (153)..(153): n is a, c, g, or t
  misc_feature (155)..(155): n is a, c, g, or t
  misc_feature (161)..(161): n is a, c, g, or t
  misc_feature (163)..(163): n is a, c, g, or t
  misc_feature (166)..(166): n is a, c, g, or t
  misc_feature (168)..(168): n is a, c, g, or t
  misc_feature (172)..(172): n is a, c, g, or t
  misc_feature (176)..(176): n is a, c, g, or t
  misc_feature (383)..(383): n is a, c, g, or t
  misc_feature (398)..(398): n is a, c, g, or t
  misc_feature (420)..(420): n is a, c, g, or t
  misc_feature (425)..(425): n is a, c, g, or t
  misc_feature (435)..(435): n is a, c, g, or t
aggttgaagtggtgagacgacgccacagaggttagacgtacagtcccagtcttggagntcgcctggctncctnagaaatttnaaggccngcttggagaacaccttanggaggtggaggncccctncccctncaaatggancagctnaacgggntncttttncnccntnagtnaaanctggcccaacccgggcaaaggggcagcgccaggccccggagtattaggcccttcttaacatcaaggtcaaactggagggtgagattcccccccccccccccctgttggaaaatggggagggcttttattttggtgatgccttgggcagcagcaactccatgcaaaccatccaaaagaccccccccccccggatagtggatggcaaantggggttttagaccnatgaccccaaagtttttaggcnttaanccaccaaaancaggggaccctttggggagcaggaggcccataaaaagttcagagttcca

SEQ ID NO: 543808 - DNA, 214 bp, Homo sapiens
caccgctcctgccacaggttaaaaggggcaaggtacacctcaggccatggcttcagagggtgcaagttccaagcctttcaggttctaggtggtgttaagcctgcagatgcaccgaagaattaacgttcatgaacctccgcctagatttcagaagatgtatgaaaatgcctggaaatccaggccaaagttggctgtgcacgggagcggtggagca

SEQ ID NO: 543809 - DNA, 849 bp, Homo sapiens
  misc_feature (397)..(397): n is a, c, g, or t
tggactataaaccatttttttggtaatacagtttagggggggaaaataaaacgggggccaaccccatataaaaaattaaaaaaaccatgtttaaaaatatattggcagggacgtatttttttttctcaaagtcccccctcttttattgttcctctctcgagtgtgtgtggtccctttaagcatctcaacgtggtgggggtgggagtgatgactagcaaagatcttatgggcataacaatttatttgtggggcgtgctcagcattagaggaaaactccaaccatttatatctgggggtagatccaaaagctctatgtgaatctccctcctctagtcccgcccggctctctatattgctcttaaagtcacttgtgccgaaaggcagaatgggggctttncaacagcctataaagattaaaaaccgagctttcctctcgcccgaccactaaatgtttgcgtggtcaccaaactccccctccttttaaatagggtagaacacggacaaaggttgagggagttgagaaacacttatcacttgggacgagaattctgggagagactacacgtggcaactaaagggggccccaaaaccccggaaaatgggcgataagcgaaccttgcaaaatgtcgaaaaagacgcgggcaaaccccccagttccataacagttattacaaaagtctactacagcagatcctcggcgaggacaaaaagcatcgggtacagggacagatggaccaaaggcctgaaaagacacagcgaaaaccaaatcaccccacaacgagagcagttgacccaggggcccccatgaaggcgcccagaaaccacagcgcacagaagcacaaaaaagga

SEQ ID NO: 543810 - DNA, 643 bp, Homo sapiens
  misc_feature (344)..(344): n is a, c, g, or t
ttcatcttcacaccttctctgcgcacccatggtgtgtggctggagccctggagtctgtgcggatcctaaagagcgctgagggacgggtgcttccccgccagccccagcgcaacgtcaaactcatgagacaaatgttaatggatgccggcctccctgttgtcccctgccccagccacatcatccctgtgggggttgcagatgctgctaaaaacccagaagtttgtgatgaactaatgagcagacataccatttccgggcaagcaatcaattacccttgggtgccccggggaaaaaagttccttgggattgcccccccccctcccccccccccccagatgatgaantacttccttgagaatttgctagtcccatggaagcaagtggggctggaactaaaccccccttcctcaggtgagtgcaacttttgcagggggcccctgcctttttaagtgatgagtgaaaaaaaaaagtcctttttttcgggcttgagcaagttgggttttgctcaggcctgggcatgcccccaattttttcccttaacccccggcccttttcatatccaaatggttttcaaagttgtctttatatgtgaattaagttattttaaattttaatttatagtaaaaacatagtcctggaaata

SEQ ID NO: 543811 - DNA, 296 bp, Homo sapiens
  misc_feature (232)..(232): n is a, c, g, or t
agaggggcctgcaatttcgtgggtccttgtgaagaaaacgtctcaagcctcctcttcctgctggcccaatgccccccggccgccacccgccgtcccacggaaacttggagacctcagtgcccgccctggggtgggggagccaggttggatttccctcctgggcacctctcacctgcctggacaccttggacctcatccgttcctctcccagggcctctggagggaggaaggntcccacaggagcaggtgcaatggaaggcagcctggtcagctctggtccatgggctacacagggc

SEQ ID NO: 543812 - DNA, 152 bp, Homo sapiens
ctaggaattgctaagaatggttagaattgctggcattgctaggaatggttagaatgctaggaattgctaggaatgctaagaattgttaggaatggctaggaattgttaggaatggttaggaatggctaagaattgttaggaattgctaggga

SEQ ID NO: 543813 - DNA, 262 bp, Homo sapiens
tccatctcgtcccagccccgagttgacccacgttgttgctcctcaccccatggtgatgcaggtctcgtagtgtgggcacaggtgtggatacatcatctttgtagtgcctctgtcctcttccacaggatgggctcccacaggtgcagcagctggccccgtacttgagcatgtgtggttatcctctagagcttttcccaagaagggtgtttgaattgagagtcttaataaaatcttaccaaataaactttgagaatgatcgtca

SEQ ID NO: 543814 - DNA, 113 bp, Homo sapiens
gctttatataaggttactccagacatgtacacaaacacagcactcttgaaatcacaagtcaaccacagagagtcctcactcttacacgagtactgcagtgatgcgacccatgg

SEQ ID NO: 543815 - DNA, 168 bp, Homo sapiens
tcagtgctgaagctattatgacttggcagggcttatgtcctgacaacctccatatgataagggagccttcaaatcgaaatcactttccagcagagtacccattcaaaccaccgaagatcacatgtaaaacaaagatctatcacccaaactcgcgggtactgagctcga

SEQ ID NO: 543816 - DNA, 719 bp, Homo sapiens
tgtgggggacatttgattcaggccaaaaggggctggcagttcgggaccccccgaaccacatttggagtggtgggtattcccataagggccctttgtaaacccaaaaaacctttatggcttttggggaaaatatgggggattaaaaaaaacccccctataagggatagattctcaaaaattcccacaccggggctgttttgaccttgtgggaaacaaaaatatttttggggaaaatttttgtgagactagttccgcgggtgtctctaggaccaaaaaaagggggttttttatttccagaattaatatccccggattttgagaaaaattttccacgcgaggggaggatcctctagggtttatattttagcggtgttttttttttgtgtaggagagaaatctttctccgcattcacgttcttgtggaaaaagaacccgaagaaaaagtctttgataagggcctccttgttttttgtaaaaaggggcaacacgcgggggggggggaagcgcttaacaggaaccccgggggggaaatgtaacagtgtggccgaaggggtttttaaaagggagggggggggccccccctcttttggggtattgattaaaggagctgggtgctattgttttttccaaaggagctttgttgtttaagaacccgactccacaaaaaaaaaatgggggctttcttttataataagggggaccatatttagaagttcttg

SEQ ID NO: 543817 - DNA, 322 bp, Homo sapiens
ccagctcccagcccccctggctaaaattttttttttgttgagacggattctctatgttgcccaggctggtctcaggctcctgggctcaaatggtcctcccccctccaccttccaaaggcacaggccaagttgtagctttgtcccttcccctcatgcccaacaaaaggttttatcccttttaatgaattgcctttcataaattggttatgttggtgggcaagttctttaagctggaaattgtaaattccccctgaaatgttttttcatcccgttcccctgaactaatactccaataaaggatggttttgggggtccattttta

SEQ ID NO: 543818 - DNA, 682 bp, Homo sapiens
  misc_feature (43)..(43): n is a, c, g, or t
  misc_feature (216)..(216): n is a, c, g, or t
  misc_feature (234)..(234): n is a, c, g, or t
  misc_feature (279)..(279): n is a, c, g, or t
  misc_feature (600)..(600): n is a, c, g, or t
  misc_feature (618)..(618): n is a, c, g, or t
  misc_feature (630)..(630): n is a, c, g, or t
agtggccattttgaaactggggcccctaaatggttgaaaccancccagcccatgggaaagggttttggggaaacaggataatgcaaaggcccctgtggtggaaacaacccagctgtggttgaggaacaacagcaaggcagccagtgtggctggaagtggaagtgagcagggtgggcccaggggtgagggagaacaggcccagagagagggattagnaccaggtcttgtagggcnttttatggcatagaaggagctctgaagcaatgaagtgccttgccntgtgtcacataccagccgagacagtctgcctaactcgggagcccaagctcgctgctgggcttgaggcccctataagaggacaatgtaacccaggctggtatgggcacattctgcatttccacttaaactcagatggcaagcccatcaaaccttggtgccatggctgccctggtaattcctggctgaccagtgcaaccagggagctggcccatgacctgggtggcagctgagtagccaggactcatgcggccaagagtcagccttcttcctgtgactcatccaggtgcaccctgcgacatctgaaggtcaggctttcagccnctgtggcttccacttccnactggctccacntccccccggaaggatcacatagaactttgcccacacaatctattgcgtgtta

SEQ ID NO: 543819 - DNA, 934 bp, Homo sapiens
gcaggctggcctcaaactcctgggctcaaggcaatcctcagcttcccaagccggacacggtggttcacacctgtaatcccagaattttgggaggccgaggcgtgcaaatcacaaggtcaggagttcgaaaccagcctggacaacatgtctgccgaatgcctgcgattgcaggcacgcgccgccacgcctgactggttttggtggagacggggtttcgctgtgttggccgggccggtctccagtcccctaaccgctggagtgatctgccaacctcggcctcccgaggtgccgggattgcagacggagtctcgttcactcagtgctcaatggtgcccaggctggagtgcagtggcgtgatctcggctcactacaacctacacctcccagctgcctgccttggcctcccaaagtgccgagattgcagcctctgcccggcgccaccccgtctgggaagtgaggagcgtctctgcctggccgtccatcgtctgggatgtgaggagcccctctgctggctgccagtctggaaagtgaggagcgtctccgcccggcgcatcccatctaggaagtgaggagcgccccgccggcagcgcccgccgggaggtgaggggcgctcggccggcgccctactgggaagtgaggagccctcagccggcacaccatctggaagtgaggagcggtctcgacccggcagtccgcccggtccggagcgaaatgggggggggcagccaaggcggcagccgcacccacgtgagaagcgtgagcaacaccacgcggacacagacaaaaacataggagacacaccacaccaaaaacccgaccaccaacacgaaacagcaccacctacaataaacgccccactcacgcaccgacatacacacacgcctaccgcgcacagacacagaagcacctcacccccccacaccgccgacaccaa

SEQ ID NO: 543820 - DNA, 491 bp, Homo sapiens
tagcaaggtaagtgaaaaataaaaagattggcacaagcattctaaaggctatacactaaacctacctatagtggtgtaccacataatatttgggtcagcgagggaccactattcaaggatagtcccataagattataaggaacggccctataacaggtatacttttttttgcacggtaccttttctagttaagatacacaaatacttatcatggtgtcacagtagtcagggtagtcaggcggggcgggttggtagccaaaaagcaagcaacaggctatataccatatagcctaggtatatagcaggccatacaccatatagcccaggtatatagcaggctatacaccatatagcctaggtatatagcaggctatacaccatatagccaaggtatatagcaggctatacaccatatagcccaggcacatagcaggctacaccacaagtccctaagccccggggcatggaccattaccagtccattaccagtc

SEQ ID NO: 543821 - DNA, 212 bp, Homo sapiens
cccatcccagctacgcagtcacataccagtgtatatgccatctcttcccagggtggactgaaggcctggggtgggatgtggcacggtcctcactgggatctcatcaacatgagcgatccaggcccgggccttagcaagagcctccttgagagcctggatgttgggcaggtgagcagggatgttgaccgcctcacggattatggcctcaagtg

SEQ ID NO: 543822 - DNA, 1129 bp, Homo sapiens
gggaaactcaagagaagtgagcctgggacttagagctacttttcccataagggcacctgctgattctggaagaggcagctaagaagctgagtagaactttcaacaacttcttgtgttagggagccagcttcatgaatgctggcagaaaacacaggattacttgggcagagactactgctcagggcacagcaggcagtgtgttagccttggtctcccttgccctccaagtcccacagggcaatactggcaggcccaggaaagtgttacacactgcaggtttgcatgacggctaaggaaccacaatcttagggagatactatctctgtcttctaaggccatttgctgtacaaaaatccttgaaatacctgggcacagtggcacacctataatcctagcactttgggaggctgaggcaggcggatcacctgaggttgggagttccagaccagcctgaccaacatggagaaatcccgtctctactaaaaatacaaaaattagccaagcgtggtggcgcgagcctgtaatccagctactcgggaggctgaggcaggagaatcgcttgaacccaggaggcggaggttgtggtgagccaagatcacgcgttgcactccagcctgggcaacaagagtgaaactccatctcaagaaatgaaaatcttggacatagtctggaacaacaatctgtcaaccattctcagaccacaaagtatcaccaaattggcattcggtgcatttcaccaactttcaccgtggggtcaaacgcgttacaaattctgaccactttagtacacccaaaagaaaatccgaaatgatcttccccattcagattgtttctatacacctgggcccccccaaattttgtcaaggggcgcaacacctcgtcataaaaccccgtgtgggtctgaacctggtgacaaccatgaggtgaacccacgaatctcccgactatgagacacaggagcaacaaggtagcggacaacaaatcaccaccgatgaactcaccgaagagacacacgagaagtataccacacacacactacacaaacaacaagacgacggaccataccgacccaacatcgcacgcgccgacggcattcgtcacgaagcgacaccaacgagagccgatcacc

SEQ ID NO: 543823 - DNA, 189 bp, Homo sapiens
acgacacggcgatccatatgaaattccctcttggtatctgcactagaacatctctacttttcttaagcctcaaactttgctcatctctttgacccttcagtctctacagagtgatctgttctcctcactttccaaacattgttcaagtgtcatcttgatgaagtggccgtctaatttatttttcacgta

SEQ ID NO: 543824 - DNA, 196 bp, Homo sapiens
tgcgacgcacggagatgcgacgtcagagcgctgcgcgaaagtgcccccgcttgtcactgggatcaccttcctgtctggaggcagagtgaggaggaggcgtcatcaacctcaatgccattaataagtgcccccatgctgaagccctgggccctgacccttctcctacggccgcagccctgcatggccctctgccctt

SEQ ID NO: 543825 - DNA, 224 bp, Homo sapiens
cgtgcaccgctcgtcatttgttcacagccatcagcactagcatgggggcggcacacctgtcagtaggtggcagcagagctggcaggacaggacggctgggcctggtctggtcaggtgtagcatgtcccagcagaacagcagcaacagtatagccgtcccagcaggctgtgaggcaggtggatagacctaagactcatctcttctatggtcttctaccacataca

SEQ ID NO: 543826 - DNA, 523 bp, Homo sapiens
  misc_feature (92)..(92): n is a, c, g, or t
  misc_feature (134)..(134): n is a, c, g, or t
  misc_feature (138)..(138): n is a, c, g, or t
  misc_feature (149)..(149): n is a, c, g, or t
  misc_feature (152)..(152): n is a, c, g, or t
  misc_feature (160)..(160): n is a, c, g, or t
  misc_feature (162)..(162): n is a, c, g, or t
  misc_feature (166)..(166): n is a, c, g, or t
  misc_feature (169)..(169): n is a, c, g, or t
  misc_feature (171)..(171): n is a, c, g, or t
  misc_feature (178)..(179): n is a, c, g, or t
  misc_feature (184)..(184): n is a, c, g, or t
  misc_feature (189)..(189): n is a, c, g, or t
  misc_feature (192)..(193): n is a, c, g, or t
  misc_feature (195)..(195): n is a, c, g, or t
  misc_feature (200)..(200): n is a, c, g, or t
  misc_feature (204)..(204): n is a, c, g, or t
  misc_feature (208)..(208): n is a, c, g, or t
  misc_feature (217)..(217): n is a, c, g, or t
  misc_feature (246)..(246): n is a, c, g, or t
  misc_feature (257)..(257): n is a, c, g, or t
  misc_feature (259)..(259): n is a, c, g, or t
  misc_feature (261)..(262): n is a, c, g, or t
  misc_feature (275)..(275): n is a, c, g, or t
  misc_feature (281)..(282): n is a, c, g, or t
  misc_feature (289)..(289): n is a, c, g, or t
  misc_feature (292)..(292): n is a, c, g, or t
  misc_feature (314)..(314): n is a, c, g, or t
  misc_feature (322)..(322): n is a, c, g, or t
  misc_feature (329)..(330): n is a, c, g, or t
  misc_feature (333)..(333): n is a, c, g, or t
  misc_feature (335)..(335): n is a, c, g, or t
  misc_feature (338)..(339): n is a, c, g, or t
  misc_feature (344)..(344): n is a, c, g, or t
  misc_feature (349)..(349): n is a, c, g, or t
  misc_feature (352)..(352): n is a, c, g, or t
  misc_feature (355)..(355): n is a, c, g, or t
  misc_feature (359)..(360): n is a, c, g, or t
  misc_feature (363)..(363): n is a, c, g, or t
  misc_feature (366)..(366): n is a, c, g, or t
  misc_feature (376)..(376): n is a, c, g, or t
  misc_feature (405)..(405): n is a, c, g, or t
  misc_feature (422)..(422): n is a, c, g, or t
  misc_feature (427)..(427): n is a, c, g, or t
  misc_feature (436)..(436): n is a, c, g, or t
  misc_feature (461)..(461): n is a, c, g, or t
  misc_feature (471)..(471): n is a, c, g, or t
tcaacgaccctcaaagtgacagtcattgtcagataacaagcacaatctgctacagtctgtgacctggtaaagagaccaccttttcattttgngtcccatcaccaactatgccaatgtccaacctaccacacagntcanaatgactcagnggnacattttngngtcngancngcaaagnnatatngggcnggnngngcaangggnaagngtccttggngtattagacagggtaaatacaaacaaggnataaagggggnangnnaacttcttctgtngcctgnntccctangtntcttccatcttttctcatgatngggggcgnggggggnnggngnggnnagggnggggnctnggncgtnnggnggngggggggggntgtttgccttggaagactaaagaaagggngaatattcacatgaggnaagancttgaagtnggggttataatacataggccaagtntgcctgctgncaacccatctctgtaactccaactttgggcctgcatgaattctgcgacatgg

SEQ ID NO: 543827 - DNA, 483 bp, Homo sapiens
agaagcaacagagttactgttacatcgcgccagcagaatacacaaattcctcatcggcaggggggcgggcaacaatcgcaaggtgcgcgacagcactggagcacgttcatccttcctgcggctgaggcaaggaccaggtactgatcaccatcattggaaaggaggacgccgtccgagaggcaccagaagagctggaggccttgatccaaaacctggtagggagcgggcctcggcggccgactctgctggggccgtgatggggtggcttatcttccatctcttcttaacactgcaggataatgtggtggaagactccatgctggtggaccccaagcaccaacggcacttcgtcatacgcagaggccaggtcttgcgggagattgctgaagagtatggcggggtgatggtcagcttcccacgctctggcacacagagcgacaaagtcaccctcaagggcgccaaggactgtgtggaggcagccaa

SEQ ID NO: 543828 - DNA, 128 bp, Homo sapiens
gcacggtgtgagtgccgccctggaggtgcgagtgcctcagtgaccaggctggctcctgggatggcaggtacaaccggatgccagcccgtgccagagcctgaggaagtgggaaccctccctactgtgga

SEQ ID NO: 543829 - DNA, 767 bp, Homo sapiens
taagggcacatcccgcgagctgcctgccagcgcgcagacagagcccagggagcaagagaacgggcggtgcgggtggtgtgctcacggcctagggatggcgcggagcgcatctggcagaggctgtgtgtccggtgctgggccagcttggggtcacgacgcggagggagcgggttgccggggcctgaagctggggcgttgggcgcggagcgcgcttggggggcaccgaaccacctcacctggcatgcctgggtgcttgaggggccgcggtggtgtgggtgctgcggagcagttctaatggggagccatctggtgtgggcatgcgtgcgcactggggtcctcgccaatgaccccgtggggctgcccaggacaatccctagactgcatggcggtgggcctggaatcatgtgcgtgtcgcttggttggcccagtgcgacggaaacgggcatgagagaaggcttatatcccctgcaggaaactcctttcggtggagggcgcgaccccaatttgacctggtgtcgcgccgctgtgaaccatggagataacccgttggccttacacaactggaagcgggtgctgattgttttgtgatgcaaacgcctgcatatattcggtgttcgtggtcttttgcttcgcaacggttgggtgcgacagcacgcgaaatcgcccgcattgatgattcacctcaaaaccggaaactagcagaggactggcaaggtcttttcacgaggcgcaacggcaaaccggagcagagcccgggcccaatcggg

SEQ ID NO: 543830 - DNA, 622 bp, Homo sapiens
  misc_feature (1)..(1): n is a, c, g, or t
  misc_feature (4)..(4): n is a, c, g, or t
  misc_feature (10)..(10): n is a, c, g, or t
  misc_feature (86)..(86): n is a, c, g, or t
  misc_feature (294)..(294): n is a, c, g, or t
  misc_feature (411)..(412): n is a, c, g, or t
  misc_feature (461)..(461): n is a, c, g, or t
  misc_feature (474)..(474): n is a, c, g, or t
  misc_feature (491)..(491): n is a, c, g, or t
  misc_feature (546)..(546): n is a, c, g, or t
  misc_feature (560)..(560): n is a, c, g, or t
  misc_feature (609)..(609): n is a, c, g, or t
  misc_feature (613)..(613): n is a, c, g, or t
nagngtttgnctgtgtccctacccaaatctcatctcaaattgtaatccccacatgtcaggggagggacgggtgggaggtgattggnccatgggggtggtttcccccatgctattcttgtgatagtgagtgagttctcactagatctgatggtttggtaagcagctgtttcccctactctctgctcttttcctgctgccttgtgaagaaggtacttgcttctccttcaccttacgccatgattgagtttcctgaggcttccccaatcaatcaggcagaactgtgagttaattaanccttttctcctttataaattacccagtctctggtggtatctttatagcagtgtgaaaatggaatacaggagattataggcatgaaccaccacgtctagccaaaattattattatttnnggagacagggtcttgctctgtcacacaggctagagtgcagtggtgtgtncacaactcactgnagcctcgacctcctggnctcaagtgatcctcccacctcagtcctcctgagtatctgggactacaggcatgtnccatcatgcctggntaattaagaaaaaaaaattttttttggggagagatgaggtctcactatnttgnggaggtttg

SEQ ID NO: 543831 - DNA, 475 bp, Homo sapiens
ccccggccacccccgtagaagctgtcagatctagggctggactctaaggagctggactctcacctgtccctggtttcatggggaacaggaaacaggctgggctggctggttccctcccttcagggcagcctccagctcaccacagcagatggaagggctggacagagctcagcatcgatgtcagggaggcctgcactcagcaggactttcaaaagccacctgatcctttgggctctctggagggttctgggtacctaaccctcctctctgatccacccaccctgggcatcccagaaactcaagagcctgctgtattcacttgcccgctgccctgcttggcacctaccctggtcttcctcctcatgtatccagccatttcatttcggactgtatggcctggggtggggggtggggctcccacggtgacttgtttacagctgggtgtgactcagtaaagtgaaattttttttccttt

SEQ ID NO: 543832 - DNA, 451 bp, Homo sapiens
ctgaaacaggaatgcgttgagactgagttaattaataaagaaaaggggttggctgggcacggtagctcacacctgtaatcccagcactttaggaggcagagacgggtggatcacttgaggccaggagtctgagaccagcctagccaacaggtgaaatcccgtctctgctaaaaatacaaaaatgacccgggcatggtggcgtgcacctgtaaacccagctactcgggaggctgaggcacgagaattactcggacccaggagatggaggttgcagtgagcagagatttcaccattgcactccaacctgggcagcaaagcgagattccatctcaaaacaaaacaaaacaaaacaaaaaaacaattaaggtagggtaagtggcacagagtggtggggtgttcagattgtagatgaggtggccaggcaaggtcctttggataagatcaccatatc

SEQ ID NO: 543833 - DNA, 1012 bp, Homo sapiens
  misc_feature (765)..(765): n is a, c, g, or t
ttccaccagtgtccgggttttatcggtgggttccttttatgcgagcatgttcggtctacccgctcgcggttgttccccgtcacaaagggtatctctctccgcggactttagggtctcaaccgggcgccggcatgttgcggcgccttgtaccattcccccgcacctaattgtttggcccgtcagagcaccttggccggcctttattttcgcgcgaggccccccccgctcggttgcgcccggagttttcttccaacgcgctttgttctctgcgggatagtccgacaggggcgtcaattccttttgcttcggcagcagttgtgtcgcttgccccgctgcgctcaatttagtgctggccatcagaactggggtgccttttataaatcggcgattaggaccagcgtgcatccgagttctatagtggcaagagtagcccgtcccccccttcggggtcgttggcggaagaagaccacgcattgtcgtggtcaataaccctgtttatctgcgcagaattctgacaggctctttcttaacgagcacagtggtctcacagagaaaagcgcgcgctatcttctttgagagagcatctatcctaggaataacagttcgccagtgctgccacaaatagcgggccccccgcggcgctctctatgtatggagtcgtcgttaatctcgcccgccgccctccgcctgtgtgcgtttgctgcgcaccgtggggacccgccacgcagaagtcttgtcgcctgtatacgatcaacaatttgcgcnccgtaggtctcggcacgtggcaaaaaaattcgttagttacttatggagagactcgtgtctccccccttctatgctgtttataatactcccatgcggactttctgctcgttattaacaataactgtacgtacgaagagcttgggtacgtatacgaaaagaaagagggtgtcgggcaagactctggtagaacaccagaagatcggtccactgggaaaaaaaaatcccccaagttttttcaaacataaca

SEQ ID NO: 543834 - DNA, 343 bp, Homo sapiens
taacgataacagataaagtaattgtgttaaatcaaatttattatacttataatatagacccactcttcaggttacagtctctagcttcgccatgtacatggaccttccgtgtccatggatagggcggtgaggtaacataaaagatccatttacacaatacagtagatgatcatgctacatgaggtaaggtcctcataatcacacacttccaacacacggtagatcagaaacccactatgatactcgctacctgtctgtaagctaaggcactaataaacatggctagaaagtttaatttgcaaaccttatgcctccatttggaatagtagacaccagttcagag

SEQ ID NO: 543835 - DNA, 149 bp, Homo sapiens
agtcacacatgctcattgtagaatattttacagctggtgcggtggtctaagactatctttatctccctaggtatggtgaacatgtgcacacaagatgaccgtcctaaattccttcattctgcattcaagcctccttccatgagcgtggt

SEQ ID NO: 543836 - DNA, 139 bp, Homo sapiens
aggacccagaagattaaactcatgcattcagtctgtggctgtgcaatgttctaattcaaggcagcatttgtcagggcagcattagtatagagaggtagagttttttttgtgatagtggttcactggctcaccaatatag

SEQ ID NO: 543837 - DNA, 326 bp, Homo sapiens
tccgctcctagtcatagatacatagtgaaatgaaaacatgtctatgcaagactgtctatgctacgtttcattgcagcgttattcataataacccctgacaggaagtagcccatatagcccctagctgtggaaatgggtgagcaaatttgtggtatagtcctatgtatgaattatgactcagcaatcacacacaggaatgaaatattatatcacacaatgacaagaagtcaattcaaagacatgctagagaaaagaagtcaaacacaaaagatcatatatggtatggttctttttcatgaaattctagaaaatgcgaaatagaatct

SEQ ID NO: 543838 - DNA, 180 bp, Homo sapiens
tctagaggatctcctgctgctccctcttcatagttcttgtgtctttgccttattcatcatttttaaggctaatctaattaactgtgtatggaactgctataaatacatcaacaaaccggaaacgtggcggagattgctgtgtaccctggcctttggaagccaccttcctccagtacgttt

SEQ ID NO: 543839 - DNA, 1892 bp, Homo sapiens
  misc_feature (346)..(346): n is a, c, g, or t
aggccggtgagggaaacaccgtgttgtattagcacatggtcaaccccgagctgtgtgtcttacgaccacttgctcggtcgagcgcgtggagcccttggggtccgcggtactctcgtttgatgctgtaatgcacgcacatagtgtactcgcaagagcacagacgaggaacatatttatcgatgctcctgatgcagctgtgagcagtaccaggattttgagcttgatacaggcggttgtcctgacgttgacaccaggacacttgagttcccaagggggttgtccactgtgtgtcaggcggtagagatgacctttgcgacggcgtgcccagtacattaagtgcatcttngtgttagagcaaaagctcgcgagtcctagtcgtgtgcgagtgaatcggttcttgagagtgagttcgatcgagacctctctaagtcctttaactatggctactaaccgcgggatcccttggactaccttctgtggatctcaggtcgcgtcaggcatgccatcgtgaggccctcaaacaaccaatactcgtgattccccaattgtatgtatatcaaatctttggcgttcctgaccaaagggattctggacgttagtggtatcggaacttgcggcgaaaaggcgaggtggaatgtgactgtatcctgtagaggcaacgaacgttgtgaaccacgggagacgcgtcgatttggacaacgtacgatttgcgctgtcactgtggcccaacgttagaaggaacaggcggtactgagcccagaggtcccgagtgagattacctgtcgcggaattgaacacaatttgcgacggagagacggacctcagcccgaatgtaagacattgtccccatggaatgaggatccaccaattggtgggacggggtacacagctttcaaggagggtcctcgcctgggatagtggtacaattcccttataggcgggcgaaacacaccaagatactgtagaattggtaccccctaattcaggtagttagaacgggcctaccaagtgagtcaaggatacggcggagaacattctggtccccaaagagtcccctagagagaaaaagggtcggagcagacgcaaaggcacaaataaacagttaacgtaggaggcattgacagcgggtatgcggatccatccaggcgataggcagtggcatacacaagtgagtgccgacaggtgatttccccaaagatagagttatcaggacccgatgtcgcgtgggcgcccttgatcaaacaagtttaggctttgtgagagcaataaggaacagttttagcagaaccaactggatgcaccacagcctaggcagtagtcgacatctggatatccacacaaaatatgagaaacaccctatcagaaattaagtcatgttatctaccccaatatgaaaggaccacagacggatgggtagagcaccaccgaccggcagacacataggaagaaagacccgagagaacagacgaggactaaaaccaagaagaggaaacgtcaccgacaagggtgagcgaaaaggagcgcatgaaacaccgtgcttagtgccgaggacaccaaaaatagaaggagagcagcaacaacgctgaatagacaccacacgcagggtccgccagataaagacgagaacagtcgaaaaataagaggaagaagacaggcgaaccaaccgcctatgttaccaaacaagaaccacaccaaacaggagggaagaatgaagacacaagacagataaaacaagacatcaccgacagagacgataagacaacccacatacgaataaaacgcgaaaagaaggggaagaacgaatgaaaggagaaacagtaacgagcaacacgtatgacagctcactgacgtacaacgcaagcagcataacgcagactgagagaaacaagaac

SEQ ID NO: 543840 - DNA, 260 bp, Homo sapiens
cgctttaaacagagagatgccatagaaagcctgaagtttatggcatataatataatgagtggttagcttggggttttggtggaggacccacagttcatatccaaatcagcttaacagggccgggagctgacaggttataagcacgggtgaaggcacgggagtggcaaacacaggaatgagtaacaaccttgcatcctctatggcacatgacgccttcccatgtgctttcatgtgacttaatccatcccatccccgaaatg

SEQ ID NO: 543841 - DNA, 504 bp, Homo sapiens
cgcggtggctcacgcctgtaattccagcactttgggaggcctaggtgggcggatcagctgaggtcgagagttcgaggccagtctgaccaacatggtgaaaccccatctctactaaaaatacagaaaattagctgggtctggtggtggatgcctgtaatcccagctactcgggaggctgaggcaggagaattggcttgaaaaaccccccaaaggcggaaaggggttgggggaacccgggggttgcaaggtgaggcttaattaactccagccgtgggcaacaagagcgaaactctgtccttaaacacataaataacatacaacactacaataatacacaaacaagaacaaccgtggtgtgcgggcgccgccctgggggccccccttggggaaaaagacgctctctctctgtgagaacaccccacttgcgccggattgtggggggccccggcgccgccggcgggggcccccccccgggttagcggtatcgggtgcaccagtgggccc

SEQ ID NO: 543842 - DNA, 140 bp, Homo sapiens
gtctggtctccccgtgggagagctgagaaaggcaagttcaggggctccccgcaccaaaccatggaatcggctgtctatggtgaggcccaactctgtgattaacaagctctctagatgattcttacgcacacgcaagttag

SEQ ID NO: 543843 - DNA, 821 bp, Homo sapiens
ggtttatttatatggtctcttgtttctttttgttttgagatggagtctcactctttggtccaggccagactgcagtggcgctatctcacctcactgcaagctccacctcctgggattcaaggggattctcctgcctcagcctcccgagtagctgggactacaggcgcatgccaccacagctggctaatttttggtattttgtaatagagacggggtttcaccgtgtaggccaggatggtctcgagtctcctgaccttgtgatctgcccgccttggactcccaaaagtgctgggattacaggcgtgagaccaccgcgcccgcctggggcgtctaggtatctagatctccgatgggggtcggactgctcgtgctcgtgtactagccaggtaccataccagcagtgcttgatctgcaagatccgctttcgtagtgtggacacaaggtcaggaagctgttgaggccaaccaacagataggtacctgtccaagaggtgccatgggacggttatacgacgatcgacactctacgaagaattgccagtatctcacagtgcgggcggggtagcagctcgcccagggtcgctaccgacaaccagacaagcttcctggggcgggagcgccagacaaatgcgcagtgaggcacgggtcgtaccccgagtcccacggacaaccacgggcagctgccactgccccaatcccaatgcgcagagcgaacacaatacctggcaatagtcagcgcctgacagcactcacgaaggaccgcgccagacggccccaaagcaagaggcgccgggccgacgcgatcaccccaggcagcgcaca

SEQ ID NO: 543844 - DNA, 428 bp, Homo sapiens
tgagtaagacaagctcctgcccgcaccagttcaccaactaatacagaaagtgacaaggagcaagccattagaaggcagcacatgagtgtggcacgcaccagcagtcccagctacttcggaggctgaggtgggagcatcgcttgagcccagaggttcaaggccagcctggacaacgtagtgagatcctgtctcttaaaaaataaaaaagagaggctgggtgcagtggcttatacctgtaatcctagcactttgggaggccgaggtgggtgaatcatctgaggtcaggagttcaagaccagcctggccaacatggtgaaaccccatctctactaaattgggcgtcatggcaggtgcctgtaatcccagctacttgggaggctgagacaggagaattccttgaacacgggagacggtggttgcagtaagcc

SEQ ID NO: 543845 - DNA, 125 bp, Homo sapiens
catctaagattcttcaatttctcctaaaaacatcacctctttctgactgcaggtttttggccaaaatttcagcagtcctctgatcactggctctgttagtgttgtatctttctccaggaactgta

SEQ ID NO: 543846 - DNA, 304 bp, Homo sapiens
  misc_feature (192)..(192): n is a, c, g, or t
taattttctctttaatttttacttttatattttaactttttattatattttctttttttttttattttttttatttcaattttattctttattctttttttgttattctttctttctctattttatatttattattttatttatagtttttgagtgttttttttgcattttattttatttattttgtttttncattatttttttttacttttttaattttctatttcctttctttatatctatcttatttttttttttattccttctttctacttatttatcttttagttttttattttctttt

SEQ ID NO: 543847 - DNA, 319 bp, Homo sapiens
  misc_feature (49)..(49): n is a, c, g, or t
aatttccatttttggtcagatttcccccctttcccttgcatttatgggntacccccagtttacactcccaatcatttttttcccagactggtcccctttgttttgtgttttttttaggggaaataaagaaaaataaatgggggccggtttggaaagctgcttcccgtggatagtttattagaatcctggcccaaagaaggccccccttgctgttgggataaacaaatgggcctatggggggggagggggggtccccttccccctgtggggttttttggggaagggtttcccccaatttccattaaccagtggacagtga

SEQ ID NO: 543848 - DNA, 739 bp, Homo sapiens
  misc_feature (318)..(318): n is a, c, g, or t
ctgcacggtgtctcctgtttgcattacattcttggaagatttcaatatgtaattttgatggcttgatgctttgaagtcttccataaatatttagagttttgaggcctatgcgacctgaaggcttactgctgaattcaattaggtagcaatctgcaaatatttagcacctataatttgctaaatactggaattagatacggatttataatggggtagaggcccttgcccttgagtttactgtcctgtagttgaaattacttcaatctaaggaacatttttgaactccttcctgcactgtgctaaattcttgaagaaacnaaggatatagacacatacctgtgacaaggttaaacatttagtgacaagtattctaacttttccagggacaagggtttgtatgttagagtggaggaggtttgtgaaagttttggaactcactggtgataaggagtagaaccttatcatattggaaaccagaagaaaccagaacactcgagtgtttgaagagactagtttggctggaatggtggtttttcagggagtagtagactgggatggatggagaggtcagttttagattatggagggccataaaaacaaggttaggaatgtggactttatcttgtggagagttactgaaggcttttccagcagaaggctgacataatagcaaagagatggtttagagacagtatcgcacatttgtgtgtagggtgaagttggggatacacgttcgcga

SEQ ID NO: 543849 - DNA, 156 bp, Homo sapiens
ttggcgacattttacagactcgtgcgtccttcttttccaggcactcacagacagaaatgcaataaatatgatattgtatcaaatagtaaccaagttggatttctgtgattgaggctggagcgtattttaatggtgtcggggagacaggggaagctt

SEQ ID NO: 543850 - DNA, 182 bp, Homo sapiens
ctactctgatctccgcgagcatcttcacgacacttctttcaattcatcctgaggtgacttgtaagggagatttttagccaaaatgtgttctcgcatctcgctctttcttactgtctttgcctttgggtttctctagtttaatttacagtcgccaaaagaactatacaaaccagtgagttcca

SEQ ID NO: 543851 - DNA, 1380 bp, Homo sapiens
  misc_feature (220)..(220): n is a, c, g, or t
gcgatgtcctggcgccgggatgaggagcggggagccatgcctggagacggagctcctagctgcacctgcgcctgcgcaggcgcgcggctctgcccagtccctctaccacagcgtgctcccggtccccgctagctcgtggacgacaattcgaacgcttgccaggtccgccctcagtgcaaggattcatgctgagccgcgtatgggcatgagtgctttgccntacggttgcatgacgaattggtaacctgatggcccaagaccaagcaaatggttaacgccgagggacaactccttggactagtgagtcctgcatttctgttgctgaagcttgctccaactcccaggcggtgtgagtagacccatcgtccctagttcgtgtctgcctagtgggcgttcgttgcccgatgctccccttgatcggcggcttgttcgccggctaggtaccctcgtatcgctcagtcccagcggtgctatcggttcctagcggacggtgattgtttctccttcgcgttgaccgttgcggtacgattcgggtggcatggaactgtgtgggaactgttgtccacaggttcgcccgtggttgggtcccactgtgaggcgctttggtgagggctcgcccgtcgtatccgatcgttacgaggacgagcccgtctcgagctcactgttccattcggttgagtgaacggtcgcccaattgtttgactccttgtccgggcttgccggcgggggctgaccttaggcgctctggcttcgtcttcactttgactggctttggcgccttacatgtctttagcaaacggcgctctaggggagaccgttaacccttagttggggagaaggttacagcccagcgcggagtcttttcaattcccttggccgccccaggggttccacatcgggcccttgcccccccgtgcgggaagctttacttccccgagggtttcgaacctttttttgacgttttccatttgtgtggcccgttacaattcaaacgcgctcttgggagcgctaaaagggcacacaggttggcccccgttggttgtattccttaagctgaggggagcccccttcagattccactttgggaacgcacaaagtttccaattcaatttcaccgtccaaatcaacgcgcgattcccgggcccattcccgggttttccggaccataggggaaccggcctggaagcccccctgggtggggaagcccacaatggccggtgtcgcccccattagggcgcctatggccacacactggggccaatggttcaggaggactttgaacttggatcacagtggacagccgggggtgtgggagggggccctgtggcgaatcattctcctttgggcaacgttcctttggagccgaacgggaagaaccaa

SEQ ID NO: 543852 - DNA, 393 bp, Homo sapiens
tccactagtgtaggcactcacaacaaaactaaacatatgggattatatcaaactaaaaggcttctgcacaacaaaggaagcaatcaacatagtgaagaaacaacccagagaatgggagaaaatatttgcaaactattcatataacagggaattaatatctggaatacacacggaactcaaacatctcaacaacaaaattgtataaaaatggacaaataatctgaatagacacttcccaaaaagaagacatacaaatgaccaacaaatatatgaaaaaatgctcaccatcatcaatcatcagggaaatgcaaatctgcaaatcaaaaccactatgaggtataatctcaccccagttaggatggctattatcaagacagcaaacaacaaatgctg

SEQ ID NO: 543853 - DNA, 724 bp, Homo sapiens
cgggctgcaggaattcggcacgatatatagatatatatatagtagtagtagtagtagtagtagagagatagagagatagcgagtgatatacctatattcctttgttgataaatgcctgacatactcctctctttaacctattctcccctctagtcccgcctatatctacatcttcatttcttttcttctaacctttttctgggctacttctatccttaccttctttcctgtactcttccccactctgattactaccttctctcttactgcttctttcttcacatgatctcactcttctatcaccacactcagattggtcagaatgcttactctcctttagctattcacaatgcctcttccaacctcttttatcacccccttagcttcctcagccttcccttaacttttacgtacacacgttacatatccttctctctactctgatacactacctacattattatcttttacattctatattcgcctgtgcacatcgtctcacacctgcactcccttccttttctgccgctcatattacatgattcctttacgcctgtccttgcactacatgccttgccttcatccttcgaccttcactatccctcttctccctttcacctttcccgctgctttgccctaccccctctataccttgccttttgcatcgtttcccttcatccctctcccttgtctctactccaccccttatccctcttttttctct

SEQ ID NO: 543854 - DNA, 635 bp, Homo sapiens
gcctacctgtaccccagacagacttttctgtcttagaactacctgtccctctttgaacagtgtcttcctggtagtacacatgaagatgtcccgctctcccctgctcaaggagagagtgcctgacctgagctgggcccatcagatccagtacttacctggaatacgaaaaagatggagagagtgaccaaagattacaaaaatctctgaagcttatctacttgagagagagtccctgaagatactggcctctcattcctgctatgtatatccaatgtgactgaactctgaataaaatatacaagttataacaatgtagcaattgacccagcaaacgaggacacaaacgtgttggagggtaaggtggtgagaggcgtgtttgggggtggtggtgatgagcaagtatgtgaaggagaggtagtgcctaaacttgaaaatcaaaaagtaataatatctatttagacataaggagataaataacgaaataattgcttctatgtgatgaaactctgggagtacacaaggggactgctattttactaaacaaattttcaaatatatataactttgataaagtatccaaataaaataattcctttcccatataagtatgtgtatatatgtattccattgtattt

SEQ ID NO: 543855 - DNA, 231 bp, Homo sapiens
cccgactagcccgacaggcgtatatgacaagctgcatctgtctagcgagaagagagagctaggatcggtcatggcatagctgcttcaatgcaggcacatagcgcctcgtagtaacagccattctcatccgaagcccctgaagcttcacgggggcagtcattctcataatcggccacgggctttacatcctcattactattctgtcgggctagtcgggggggtaccgagctc

SEQ ID NO: 543856 - DNA, 150 bp, Homo sapiens
tccgaaggggctctgagttctggggtgggagttttgctctctgtcaggtgtgataaaatcgtcgacccctccccaccaccactttttttcttctacaaccagggatgtctgttgaaatcaaacattcagtccgacaaacaaaaaaacaca

SEQ ID NO: 543857 - DNA, 583 bp, Homo sapiens
ggaatttggcccgaaaaggaaaaaaatgggcattttattaattccttaggggcccaaggagggcaaaaaaaggtgattttttgaaatttgaaaaacgtttttagatgcccaagcaaaaagactttaaaaaatggtaatgaaaatggaatgcagctcctgcaggtaataaaaaattttaaaaagcaattgtttcacccatatgcctttataggtagcccttagaattatgaaagcatggggttaacccttttattatttttcccccccttttcagggttttaaaaaaagggaaaaaaaaaagttttgcctgccaattgaaagattttgtagctgaagtaaaaacatttaggtttttggagcattaaattgggaagacaactgggggggggcttattgaaaaaactttttgtatgtcctaaaaaaaaaaacaaaaatgggggggttttgattttttttgcattttaaattttcagccaccccccacccatgttttttagcccagggatatccccatgactttccaaaaagggtttaaaatttggacccttccccccaaatgaaaaaaaaaattgattaaaggtta

SEQ ID NO: 543858 - DNA, 426 bp, Homo sapiens
  misc_feature (8)..(8): n is a, c, g, or t
  misc_feature (426)..(426): n is a, c, g, or t
taattttnccagacacctcagacccaatactgttgggccccagaagagtgtgcagtctgccaaaggctaggtttgaaaatgacaacttgttgtagctgcttagatcgcagaaagggtgtgggaagcagtgcaagcacactcgctagagcagtttcatctcacagtatcctggaaacttcctgtgttagtttcagggactaggaggttcaaggggctctccccttggcaagattgcacagttctactgtggggatgtgggccactggaagtctctcacttatcactctctgtgttgcttatttccaaatcccacccaatcccagccaaacagactgcaactttccttctccgtccttgcttttggtgtttcctgtcacttttctgttgttcaatgttctttctttgattgtttttgtgtccttgttn

SEQ ID NO: 543859 - DNA, 1124 bp, Homo sapiens
  misc_feature (910)..(910): n is a, c, g, or t
ctaccagacaaccttagccaaaccatttacccaaataaatgtatagtgcgatagaaattgaaacctggctgcaatagatatatgtacctgcaagggaaatgatgaaaaattataaccaatgcataatatagcaatggactaacccctataccttctgcataatgaattaactagaaataactttgcaatggagagccaaatgctaagaccccctgaaaccatgactgagctacctaatgaacatgctaaaatgatgcacaccctgtctattgtagcaaaatatgtgtggaatgatttatacgtgtagatgtgctgacaaacctacctgagccatgtgtgatcagcttggttgtccacagcatcagaatcttcagttcaacatttaaattttgccacacagcaacccatctaaatcccacttgtaaatttaacttgtatacgtcccaacagcagtgaaccagctccttatggcacaactcaggaccaaaacccttgctagaagaagcagtaaaacaaatttcaaccaccccataagtacggcctcaacaatgcagcacaacccaactatccagaaaatgctgttccaagcctcaaagcacccagctacctaaagaaaatcccaaaacatatcaacttgaaactccttcaccaccccaaatttggagccagagtcatattcacacacattatacgaaagaaagctaaagtgttgaagttactcacggtaaaaccattgcaacaacaatcacatcccatcccgacacttacacgcccatggccggtcacgaatttacacaaagccactctggaaaactggacaactttaaaagcaatgcccccaaaactcattcttaaccaagattcaaaacccagcacacaacagatccccatctgtaactattaacacacncttaccagctttgggatccaaatcaccccaacaccaacaatggttgcacatttgcctccacagttacattgtgggcatcatgggtgtttcacacaacaacagacaggtcacaccactatgtgacaccttcaggtgcagcacatgacctttgaaccccccctggacactggatgtatcacaccccagaaagtaatcagtttaacacctaccatag

SEQ ID NO: 543860 - DNA, 217 bp, Homo sapiens
cgcacttaaacagtcagtggagaaataacatgttcagaactgtatgctgggtgggaccatgtacttgtatgactggcgaagataggcctttgagtggctgcaagggcttctggagtgggaatgcgaaaattctctgctaagactttttcaggtgaacataacagacttaggcaagctagcatcttagcggaagacagatctccaatgctcttacgcc

SEQ ID NO: 543861 - DNA, 364 bp, Homo sapiens
atgagaatggctgttactctagggctatgtggctgattgaagagtatgaatgagcgattttaggtctgctgtcccacgcagatggagcttgttataattatgcctcatacggatatgtccatgacgcaaggggtaggctatgtgttttgtcagggggtcgagaatgagtgtgaggcgtattataccatagccgcctagttttaagagtactgcggcaagtactattgacccatcgatgggggcttcgacatgggctttatggagtcataagtggagtccgtaaagaggtatctttactattaaagctattgtgtgagctagtcttattatattgccgattcttcctatcctttctacggggtac

SEQ ID NO: 543862 - DNA, 380 bp, Homo sapiens
acactgtcaaacagttgtgtgacagaacggcggtaccgggtggataacttcgcaaatgctagatatatcctactgaagatgtgctcgaaagctgtgagccacggcaataaacccttcagtcatcacgtgagataactgcgagccagcattacccccgggaccattctgatcatcctcactggacgccacattgtctagagggtggtatacctgaagcagctggctagtggcttattacttgtgactggacctctggtcctcaatcgagtacctctacgaagaacacaccagaaatttgtcattgccacttcaaccaaaatcgatatcatgcatgtaccaatcccataacatcttactgatgcttacttcaagacgaagaa

SEQ ID NO: 543863 - DNA, 747 bp, Homo sapiens
gatgtggaaggatctacttctcctcaaataggagataaggttgaatttagtattagtgacaaacagaggcctggacagcaggttgcaaccttgtgtgcgacttgttaggtcgtaattctaactccaagaggcgtctgggttatgtggcaactctgaaggataatcttggattgtattgaaacagccaatcatgataaggaaaatctgttttccacttacagtgagttctctggtgatgttgatagcctggaactgggggacatggtcgagtatagctggtccaaaggcaaaggcaacaaagtcagtgcagaaaaagtgaacataaatactactcgaagtgaatggcattactggaggaagcgtgatcccaccatttatctctggcacaaacgtatcttcgacccctgaggagtgtcgatccaactacagactgagtaaccaaggtaatgatggagatgtggaggagggcgatatgaaaggtgaggtctatgcattaggtcatcgttgggatggcaacaaagtgggattgctgtagaaaggtggagagcgtcaggttctcaattgtgtgtctctgggcataatgtacaaattatggtttacaaatcaaaccgtggcagggcccagtggaatgtgtgaaagatcagtgggttcattagctatgaagtaggagatagaagaagatcttttccatgtgaaagaagtcaggcgggttgagacaggggagatgaggggagccaggatctaaag

SEQ ID NO: 543864 - DNA, 418 bp, Homo sapiens
  misc_feature (27)..(27): n is a, c, g, or t
  misc_feature (99)..(99): n is a, c, g, or t
  misc_feature (169)..(169): n is a, c, g, or t
  misc_feature (184)..(184): n is a, c, g, or t
  misc_feature (186)..(186): n is a, c, g, or t
  misc_feature (210)..(210): n is a, c, g, or t
  misc_feature (223)..(223): n is a, c, g, or t
  misc_feature (244)..(244): n is a, c, g, or t
  misc_feature (253)..(253): n is a, c, g, or t
  misc_feature (267)..(267): n is a, c, g, or t
  misc_feature (299)..(299): n is a, c, g, or t
  misc_feature (306)..(306): n is a, c, g, or t
  misc_feature (317)..(317): n is a, c, g, or t
  misc_feature (334)..(334): n is a, c, g, or t
  misc_feature (395)..(395): n is a, c, g, or t
  misc_feature (402)..(402): n is a, c, g, or t
ttgaagtatccgggtcaaatgaaaaanccaccatcctaccctgcctgccccaagtggtcgaaatccaaccgtgaagtggccttaacccacccaaaaatntagattacgtggccccctccatccatgaagcagtccccaaaatccagtgaagaaacccccccgtccagtncccccaaagtagttntntgtcatgtgtgttccctgcctgcncaaacctacatgnacataccatggattagagacncttgcaggnctgaaaggctgctntggtgaggcagcctctgtttaaaccggccccncatgaanagaacatcccntgagacgaatttggagnctgggattagagcctttggaggtcaaagcaaattaagatttttatttaagaataaaagagnactttgntcatgagaaaaaaaaa

SEQ ID NO: 543865 - DNA, 147 bp, Homo sapiens
ccttccctccaccatccagcaaacacgctggcaggcatctgcctcattggcacagaaaactcccctgctcctcatgctccctccacctccagttgctaactgactactgggtacctgatgctctgaattctgtaatacatgtgtcat

SEQ ID NO: 543866 - DNA, 130 bp, Homo sapiens
tcgagggcgagaagagaggcttcctcagttggggacctgggagcaggcagcattatgcagaaatccaggtgtggatgagatttcaatgagtatgctgtaaaaaaatgggcatcgaccataagggacaggt

SEQ ID NO: 543867 - DNA, 414 bp, Homo sapiens
  misc_feature (6)..(6): n is a, c, g, or t
  misc_feature (34)..(34): n is a, c, g, or t
ctggcnagtgtaatatccagatgtttaacctatnggaccccagaacctaagatgtggagacctattgccccatagacccacaatgtaaatttttaaagtgaggaaggaaaaatcaggaatcaaaaggggccccaggtgcagtggctcacatcctataatccccagagctttgggagttcgaggcaggaggatcacttgaagccagttttgagaccagcctatgcaacacattgagaccctatctctacaaaaaatagattagctgggcacggtggtgcatgcctattgtcctacctactgtggaggctgaagtaggaaatcacttgagcccgagagtttgaggttacagtgagctatgattataccactgcactccagcctgggcaagagagcaagaccttgtctcttaaagaa

SEQ ID NO: 543868 - DNA, 870 bp, Homo sapiens
  misc_feature (412)..(412): n is a, c, g, or t
  misc_feature (483)..(483): n is a, c, g, or t
  misc_feature (526)..(526): n is a, c, g, or t
  misc_feature (555)..(555): n is a, c, g, or t
gccggaggtcgcacagcgtgagacttctccggcgcctccgccgcagacgccgccgcgatgcgctacgtcagcctcctacctgctgggtgccctagaggggcaactcctccctcgcagcgccgaaggatcatcatagaaggatcttgagacagcgctggagtatcgaaggcgagacagacagaccggactcaacaaggttatcagtgagctgaatgcgaaaaaacattgaagacgtcattgcccagggtattggcaagcttgccagtgtaactgctggtggggctgtagccgtctctgctgcccctaggctctgtcagccccatgctgctggttctgcgccctgctggcagcagaggagaagaaagatgagaagaaggaggagtctgaagagtcagactgatcgacatggganttccggcgcgtttgggattatagttgcctgctcgcccgtgcaagagtaaacgcgcttattctacctacatngcagcattaccaataacaaatgaactaccttgagagatacttntggagcgaggagtggcaagctgccggtanttcaagtccggtgtcccaagtgggtgcaactaactcgagtatacctgggacctcgaagttatcccttgtggtgacagaatgcgggatcagaatgcaggtgggggtgcaccacctctttaaggagagtgtctggactgaaatgcccgcatgagaggtcccggtatagccctggcgattaccgaagggggggggcacaatcccctggagggaaaagtggggaatggagcgacgaaagaacgaacctgaacaagggcgcatcctcgatcctgttccttctgaccaaaggaattcgccttgtgaggaagagttctccga

SEQ ID NO: 543869 - DNA, 1037 bp, Homo sapiens
gcgcgcgtcgctgctagtgacccgggcatggctggagctgggctgggatcccgatgctcgtgcagcagctgcagctggtgccggcccacctgctggtgccctgggaggctctgagccccggttggcgcccgggcccacgcggaaggacggggtcggagatgcagatgccactcccgtcgtggactgctcctgcgggttccctgtccaggaagaatgcggttggagttggatgatgaactttatgataccgagcgtcccgtccagaaacgagctcgaagtgggccccagcccagactggcgcctcgcatgacctgttgcccctgtagccgcgagcctagctgcttccagatcgtgcaactgcatgtggccacgtgcctcccgtcttggtgccctatgtcctcctggagcccgaggagtggcgggcgggcctaccgaggccctgcactgccctacagggcacgtgagtatacctgcaatgtgtaccccgtccagggaagccctggccgtgctggagccctatgcgcggttgcccccggacaagcagtgtggctcggccactgaggtcctggctggtacccatggtcctctatcgcctttttcactcgtgacccatggggactatggcacagcctggtgctgaagccgccagcgtatcccttgagcctgaggctgccgtgctcttccagcagatggccacgcgcctggccgcactgtcaccagcaccggtctggtcctgcgtgatctcgagctgtgtcgcgttgtcttcgctgaccggtgacaggaagaagcttggtgcttggagaagcttggaggactcctgcgtgtgactggggccagattgattcctgtggggacaagcacggcgtggaccagcctaagttgtgacttgagatactcacgtcaaggggcctcttactcgggcaaggcaccgagacttggagctgagattgcgcccttacatgctggcgggatatccttcaggacggagctgtctgtctacaggaaaggcgggggcacgttgctgggcctggcctgcg

SEQ ID NO: 543870 - DNA, 1020 bp, Homo sapiens
gagttggttaatatcgtggtaagaggaattagcttggtaaattaagaggtaatttacgggtgcaagttaagcagatatggtcctgtggaacggaaaatttcgcccgtcacggattcagggcatttgtcaaacgtgctgatgctggtggaacaaggaagggggaggaacggaataggttcgagacctttgaaggagcattcgtgtagcgctgttaacactgagggtccgtcattggttatagctgggtgctcctacgttactaggctagtgatttttggggaaatggggccatccaccttatgtagatcccagagtccgtggactctgagcatcgctccactttcctcatctggacatgctcgcagtgtctgccttgggaatggtcaagatcagagatggtatcgtgcagccatctggtcatccacacagtgagagtccagggcatcagggcatgctcaagaccaaggcttcccagttgatgctgtcacttcgggtgatcagacatgggggacctgttaatctttagtacgccggcaaaggcaagtcgtagaaacagtgttgatctgtaactctcaggattcgtcacatgctaaggaacaccttaagtcgcacaacattgctctgctctcctctttgcagaggggacagggagctccagcccagagagcgctacttattagcagtgaggagcagaagcagctgatgctgtactatcacagaagatcaagaggagctcaaggtagcaggggacacgatgggctttatgcagtgcgtggcgcccacacattagccgtgatgtgcagttacctggggctgactggggagcagagagctcgtgcagaactgccggggaggggtctttctagagcgtctgtctgcaggtctgtgcaggggtcctgacacaggtcgtcacctggtgttagacatgggcagtatcatgctctaagagggcagggagagggggaggtacagtcatggactctttcttcagtctcttaatacgccaaagattttctgatt

SEQ ID NO: 543871 - DNA, 186 bp, Homo sapiens
gcaatttctaacattttgtgcacatgttgaactactactgtatgtattcttaatagttagctagctatatccttgatataactagttttattattttatttttggttttggagacggacttacttcagtcgcccaggctgagtccagtggtcattctgaatactagcagttggaggccacgaggag

SEQ ID NO: 543872 - DNA, 1096 bp, Homo sapiens
gtgtaaatgatggcggcggaggaaccttcagggagctataagcaggagccgctgggcagcgactgcgaaggtgttaactgtctggcctatgatgaagccatcatggctcagccaggaccgagattcagcaagagattgctgtgcagaaccctctgtgtgtcatagcgtgttggaagctctcgcgtcctatacaatggaggtatgctgaagcatgacaagcagtcgtatcgaacagaaagatcaagggacctcgcacaaaaatgtactcgtactatcctcaagatcaggcctgacggcaactgtttctatcgggcttccggattctcccacttggaggcactgctgtatgacagcaacggagttgcagcgagttcacaggctgtgtctcgcctaagagcgagaggcaagacctggtgtcccagggcttctctgaattcgacaattgagcgattctccacaaagaggttcatggacctgatcgcagcaggtgcgcatgcaagcacgacctctgtcgtcgacctgttggcctccttcaatgaccagagcacctccgactaccttgtggtctacctgcggctgctcacctcgggctacctgtcagtcgctgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgttcacatgaccccccccccatgtttttattaaagggggtgctg

SEQ ID NO: 543873 - DNA, 766 bp, Homo sapiens
cgccctgttggtgccggccactcccttggttgccccccacccctactttggcaatgcgtggtaggctcccggggcagtctcttcggttcgttaccccctggtggggccccggggtgtttccccccgaagtgccctcgtgttgtcgcccgcgtcgcgacctttctactccccctgtggggacacagccgacgagggtgccgcccgctgtgctccacacatgagtaagaccaccacataagcagaggcgactaagtcaatataaatgttagtgtgaggtgcgacatacacacacgagttataaatagataaagtatatgtacactgttcactctcacgacatgttataaagatatagtgcaccgtgagctgcttcctcactgtgaaaatcacctctcatagtagattgcgagcaccctctctaatagaacatcttatataattgtgacaaatatatccacacatatatgttagggatatatatatctcttaaaaatgtatcagtgacttatatagccctccctgactcgacaccgccctcctccatctgtcctctctgttaaccgacttggtattcacacaggatgtgttctcttgtgaaaatatcagtaatgtggcgcacacgcggctctgtggtgaggagcttgtgggattctaaggtttgtgggtcacgcaggaagttcacgcggagagccacagcccgggttgcccgcacttttaaataaaaggtggtaacgcacgggcccacagccatcaataaacaagaaat

SEQ ID NO: 543874 - DNA, 187 bp, Homo sapiens
ccgaccgtccaatctgatctgaatccctggctacccacatggccatggcatgttctgaatgttcctgagcccactgcatcttcattacaagtgacactgacagggctgttgacaacactacatggagtgaacgcagcacacaactaccccctgccctcacccctgctcctgatcttcttagccctag

SEQ ID NO: 543875 - DNA, 1103 bp, Homo sapiens
  misc_feature (2)..(2): n is a, c, g, or t
angagcagagagtatgactgtcagattcttcaggagagaatggagctcttacagcaagcccatcagagaattcgtgacttagaagataaaacagacatccagaaaagacaaataaaagacttagaagaaaagtttctgtttctattcttgttcttctctcttgcctttattctatggccttgatgtcaaggtgcctcttaaagagtaaccgaaaacatggataagatcccaggaagacaagtgcttctaaaccttcaaagatggcaaaattgtttacaccagtgagagggagatcaaaagctaagaactaccctgtagccaggactacaactgtgtattttaaagccattattcaaggtttcttacttgacagttcctacacaaccctgttgaaaatctacaatatatgctgcatttaatgaaacatgtatatgtcaaatcagaagagaagaactataaacatatattgtgtaaagaaaaagttcagcaatggaactagtttctgcagatcaagcaaagatgtgtcttgggcatggaaccaaagttacaatgaaatattcaacccctgctgtgcaggggggtcattttaatgtaacaccacaccccatggaaacactagtcctgataataaacatcattttaaaagatcaaaacaaacaaacaaaaaaaacaagggtgggtggggagtgaagcacgaggaatacctatgaagagctatttacaataaaatgtttcatttgaaaaaaaaaaaaaaaaaaaaaaaaaaaaaaaaaaaaaagaaaaacaaaaaaacaacaaaaagaaacaaaaacacacaaaacagcaacacaaacaaagaataaaaacacactgaggggcggcgccccacacacggcaaaccccccgaagcaggaacaaaaacgggcacaaaacggcaagatccaagagagcacagagcgacacacacaaaaagagagagatagaaaaaagaagcgcaagggcgcaggcccgacacaaaaacagcaaggagacgacaccaacagcaccgaaagcagagagcgcctagagaaacacaacacaaaccaccaggaccgcagaggacacggaggagcaacaacagaccg

SEQ ID NO: 543876 - DNA, 951 bp, Homo sapiens
cacgcttcttctttgttattgatttatcagccggtcgtgcgttctgtgttcccccccgctttttctcccgcgtgtgtgggtcatcattgggaaccccctcgtggggtacccccccgcccctcacgtgtgttgtagtgctctctcccccccggggttgttttccctcttccgcgacgtattttgctgcgctctggtattggttgctcctcctcctctcgttggattctgttccgccgtcgtggttggtcccaaccacttgtgttcgtgctcgtcgtcctctgtttggtgagcggggattttaccaccacgggtggtggttgttggtccccccccctttttctttgttgttgttgacccaaccctgttggtggtgcgtcaggacatctaattatgttcccctgctgggcggccatagactttttctgctgccgtttcttccccccgggacgatttctgttcccccccgcggcgtgtgtgtggctttctctttttgtgagaacaaccagctcgatgcttttcttgctctcgcgccgtagtaaaaagacagcctggttgtttttttcgccccccaccacccgctgtgtgtggtgtggtttcccccccctccttttctgtggtggtggtgttccccctccgtggggcccctcctctttctcccccccattttgtctggctgaggtcgagatcctcctcccctcccccgtcctcttctttttttttgggggggccccccccctacatgatattgttgtggctgatcatttatgatgatggctgaggaacgacatccttcttctgtgggctggtgttttttctcatcactctctttcttcttctgtctgccgcccccccccgcacgtcttcactttttttttttgtcccccccccccctttttaaataatttttttttttccccattttttttttcccccaaaaaaccccccccccca

SEQ ID NO: 543877 - DNA, 487 bp, Homo sapiens
  misc_feature (431)..(432): n is a, c, g, or t
  misc_feature (483)..(483): n is a, c, g, or t
aagaaccattaattgttttatatgcattgtgttgcaacaacctttgacatagagacttctattttctcccttaaaattaaagtaactaagcttagagatgtaacttgcataagatcatacacatcaaagcagtggtaaagaataaaaaatttgtgtctttttttaaagtttgttttttatgattcagctattaacaaaattgatacataaataatttttttcctctgttttacagagtaaccgaaaacatggataagatcccaggaagacaagtgcttctaaaccttcaaagatggcaaaattgtttacaccagtgagagggagatcaaaagctaagaactaccctgtagccaggactacaactgtgtattttaaagccattattcaaggtttcttacttgacagttcctacacaaccctgttggaaaatnntaccatttttggctgccttttaatggaacctggtatttggttccaaattcngggt

SEQ ID NO: 543878 - DNA, 140 bp, Homo sapiens
atcagctcggtaccttttattttattttattttatttttttgagacagagtctctgtcaccaactgcagtgcagtggtgcgatctcagctcactgcaacctccacctcctggactaaatcattcctcccgcctcagcctt

SEQ ID NO: 543879 - DNA, 739 bp, Homo sapiens
gccccagaacccagatccacacggaactacacagacaaccttagccaaaccatgtgacccaaataaagtataggcgatagaaattgaaacctggcgcaatagacatagtaccgcaagggaaagcactgaaaaattatgaaccaagcataaatatagcaaggactaacccctataccgtccgcataaggaaagcaatctagaaaagaactctgcaaggagaaccaagagctaagacccccggaaaccagacgaagcatacgtaagaacagctaaaaagagcacacccgtctagtgtagcaaaatagtgggaagatttataggtagaggcgacaaacgggtaccgagcctggtgatagctggttgtcgcaagactagcaatcttagttcaactttataatttgcgccacagaactcctggaaatccccttgtaaatttaactggtagtccaatagaggaacagctctcttggagcagctaggaaagaaccttgtagagagagtaaacaatgtaacacccatagtaggccataaaagcagccaccaattaagaaagcagttcaagctcgaacacccactacctgaaccaatcccagacatataacgtgaactcttcacacccgaattggaccaatgtatcaccctatagaagaactcaatgtgagtataagtaacatgaaaacattctcctacgcataaggcgtgcgtcagaataaacacggaaacctgacaactaacagcc

SEQ ID NO: 543880 - DNA, 741 bp, Homo sapiens
  misc_feature (2)..(2): n is a, c, g, or t
angagcagagagtatgactgtcagattcttcaggagagaatggagctcttacagcaagcccatcagagaattcgtgacttagaagataaaacagacatccagaaaagacaaataaaagacttagaagaaaagtttctgtttctattcttgttcttctctcttgcctttattctatggccttgatgtcaaggtgcctcttaaagagtaaccgaaaacatggataagatcccaggaagacaagtgcttctaaaccttcaaagatggcaaaattgtttacaccagtgagagggagatcaaaagctaagaactaccctgtagccaggactacaactgtgtattttaaagccattattcaaggtttcttacttgacagttcctacacaaccctgttgaaaatctacaatatatgctgcatttaatgaaacatgtatatgtcaaatcagaagagaagaactataaacatatattgtgtaaagaaaaagttcagcaatggaactagtttctgcagatcaagcaaagatgtgtcttgggcatggaaccaaagttacaatgaaatattcaacccctgctgtgcaggggggtcattttaatgtaacaccacaccccatggaaacactagtcctgataataaacatcattttaaaagatcaaaacaaacaaacaaaaaaaacaagggtgggtggggagtgaagcacgaggaatacctatgaagagctatttacaataaaatgtttcatttga

SEQ ID NO: 543881 - DNA, 666 bp, Homo sapiens
ggcatataccattagactagaaatacaagaaaaaaaaaacggaaacaaaacttagttgtcagctatctattcttgttcttctctcttgcctttattctatggccttgatgtcaaggtgcctcttaaagagtaaccgaaaacatggataagatcccaggaagacaagtgcttctaaaccttcaaagatggcaaaattgtttacaccagtgagagggagatcaaaagctaagaactaccctgtagccaggactacaactgtgtattttaaagccattattcaaggtttcttacttgacagttcctacacaaccctgttgaaaatctacaatatatgctgcatttaatgaaacatgtatatgtcaaatcagaagagaagaactataaacatatattgtgtaaagaaaaagttcagcaatggaactagtttctgcagatcaagcaaagatgtgtcttgggcatggaaccaaagttacaatgaaatattcaacccctgctgtgcaggggggtcattttaatgtaacaccacaccccatggaaacactagtcctgataataaacatcattttaaaagatcaaaacaaacaaacaaaaaaaacaagggtgggtggggagtgaagcacgaggaatacctatgaagagctatttacaataaaatgtttcatttga

SEQ ID NO: 543882 - DNA, 620 bp, Homo sapiens
tatggccgggtagcaacattattaataaagtattttaattataactatattggagtaaatgaccatgaatgtggtctctcaaaatatcttgaactgtacttaacccttgtgatggtatgagatgatccactgcctatgtgatgagatgaagtaaggtgaatgatagtggccatacttctgtagttttgagttgcgacagcgtgttctttacttttctgagacagagtcttgctctgttgcccaggctggagcacagtgccacaatgtcagttcagtgcagcctccacctgggttcaagtgattcttgtgccctagcctcccaagtagctgagattacaggtgtgtgccactgcactcatctaatttctatatttttagtagagatggagtttcatcatgttggccagcctggccttgaacttgtggccttaagtgaactgtccacctgggccttccaaagtgctgggattacaggtgttagccacaaccctggtgagaagaattatttttaacatagatcttagaattcttagcatacctttcttttcctttattaagtggagaccttttaaccttttcaacttaagggaagcacttttattggcttctttttgggattc

SEQ ID NO: 543883 - DNA, 773 bp, Homo sapiens
aagaaccattaattgttttatatgcattgtgttgcaacaacctttgacatagagacttctattttctcccttaaaattaaagtaactaagcttagagatgtaacttgcataagatcatacacatcaaagcagtggtaaagaataaaaaatttgtgtctttttttaaagtttgttttttatgattcagctattaacaaaattgatacataaataatttttttcctctgttttacagagtaaccgaaaacatggataagatcccaggaagacaagtgcttctaaaccttcaaagatggcaaaattgtttacaccagtgagagggagatcaaaagctaagaactaccctgtagccaggactacaactgtgtattttaaagccattattcaaggtttcttacttgacagttcctacacaaccctgttgaaaatctacaatatatgctgcatttaatgaaacatgtatatgtcaaatcagaagagaagaactataaacatatattgtgtaaagaaaaagttcagcaatggaactagtttctgcagatcaagcaaagatgtgtcttgggcatggaaccaaagttacaatgaaatattcaacccctgctgtgcaggggggtcattttaatgtaacaccacaccccatggaaacactagtcctgataataaacatcattttaaaagatcaaaacaaacaaacaaaaaaaacaagggtgggtggggagtgaagcacgaggaatacctatgaagagctatttacaataaaatgtttcatttga

SEQ ID NO: 543884 - DNA, 775 bp, Homo sapiens
aatggcaatgaagacctgtggaacgacattgcatgccctgcctcaacatcccagtcagccaggtgaaccccagggcatgccaaggcctgcgtagtacacggcagctgcatctacaaggacatgaccgtccgaagcagcatggatgacattttgacagtaccacactgagatagtgtttgccaggacctcccctcagccagaagctcatcattgtggaaggctgccaaagacagggtgctatctgtggctgtgactggtgacgtgctgtgacatgactctccacgcttcgacccccactgctcgaccatatggggcttcgcctatgcgcggcatggcctggcctcaccaatctgtgctccaaagcacagcctggcctgaacccttgactttcattcctgggcacttgaccaacacttaacggcccatcaaatcggtgacctgggcaagctaaacacgcgacacacgcggatcggcgcctggaactccttctcggacctaacctttcgcacaccacgcccttccccaaattagggcattcacttagcccgtaacaccccatgtgtcaacccacttattcacccggacgaagaatacaactaccgcagtatctcccccctgtcacttatcttactaaacatacacatatgggcaaacaaatcacactttgacccccagagtataaaccaccaaccatgagcagtgagaacccaagagcatacaaccccaacattcccaatacattcgggccaactttacgggaacagccctagggtgg

SEQ ID NO: 543885 - DNA, 136 bp, Homo sapiens
ccttgctatgctacattgggacggccgaggagagaacgagcacacacggtacactgacaccacgtgtgtgttacgctacgctttctctatgattctttgaagcctggtgtctgctattgaaacttctaaacctagg

SEQ ID NO: 543886 - DNA, 1287 bp, Homo sapiens
tgggctctaaagggggtaaagggggtgctatagggataaattaggggccctatattttcaaaaatttttatgggggaatttaatttcttaggacgagtgggcattgaaacgtggtggttgtgcgtccacagtattttcagaagacatttgacgcgtagttataccccgcggttcggtgtacggcgggtagaaagtgtggttatgtggtttataaagcgctcccgggaaattgtgcattctgtggtttgaataagcctatagatgtggtgtggagacaggcctcagtgaagtgtgacagaaaaggttctatgtggtgaacgtgttaatattagtatactagcaaaatgtgcgcgggacttctccaaatctgcggggagaattatacctatacatctgcgaatgtgtgtctccaacgcggtctccaagagggacgtctcgcccaagtgtctcgccgcgttggggtctcttaaggagaaatagagtggggggaacaggctcttgttcaggccagttgtgcacacaaatttagtctccgcgcagaaaagactgcggggtgtttcacctcgattaggggtttcccagagatacccactttgtggggtgctgccacatctgtggctccttgtcgacgtgggctacacgggagaagggagaatctcggtgtgcaaccctctcggtcggtggtaaagtgtctaaacaggggaagtcgcagtttagggcgaagtggggagatgggggcagatatagagaggactttacgagaactgatgtgcggcgggggacaggagatataagcttcaacgaaaccgggtatcatcatatattactcacattgaaggcgggttctttgaaacattgtttctagataacttagaagtatacagttcttattaggtgtggtggagacagctgtcttcggggaaaacacgaggtggctcttatctaacagaggaggcctcttcaatggtcagacgcccacgaatattaagcggcgacaacacgtctgagctaattctatagaggagcggcgagtgataactaccgtatgaccaggggcgttggcctagagcgcgccagtctgtgttaaatctaattaagcgggggaacagagatacgacgcagtgctactggtggatcaacccacctggtcttgttatggtggcgagcaccaaccataaaaatttaacaccacccccaactattatcctcccgtgattcaagcatatatgtttgccttcaatcataccaagctctagctaacgtttttaacacaccagatatcacaca

SEQ ID NO: 543887 - DNA, 143 bp, Homo sapiens
cacgagggcgatccccatcctcagtccatcatccttttctctatcactgaatgagagcgttgctctggagaccgctgctgagctggttcagggccacgccatcgggaacggaatcgattctgagctcgtgcatgcagtggatg

SEQ ID NO: 543888 - DNA, 655 bp, Homo sapiens
tacgtcttaacaattacagaagaaccatgagatgtgccaagataatcactagggagaaagatgccacaccacagacagacgaaagcagatctgtactggaggggaactcaagggccactttggaggggaatgggtaatagaggatggttagaatcatcacctaacacaatgtagaactatggaagagaaaataccataaggctaaactgtctccaacaaaaagaaaactagctcctcaatagataaacaacaaatgaaaaatactaaagaccacaagtctaatctacaagctatccactgccttgctcatagaccttgggacggactcttccttcctacatcacaatatctacactgcaaaaatagaagtataacatcgctattccttacagggaagtaacacacattactaaaagtgactataagctatacttcaaattgcaccagagaactaaactattatacaaatattacatcctcaaagggtaaacttacagctaactgtctcccttaaagaattttatcataaagaagacttacctgtaaaaaatgtaccatcttaaggaaaattgctaagccagtactaccaataatgtcgggcataagatacacaagaggatcacccctccagttatctggtatatcacatacccat

SEQ ID NO: 543889 - DNA, 141 bp, Homo sapiens
tttgtagttcttgtgcttgggagcgatcttcttaccccaatgacaccttcgacagattgttgccctggttggtagcttgacaaaaccacgagactaatcacccagctaaaccactctcagatttcttgaggctcagaaact

SEQ ID NO: 543890 - DNA, 148 bp, Homo sapiens
ttaaaaagaaatatgataattttcttaatgcatggaaatgtagtaagaacaaaaattcttaaaaacgactaaaatttatacttctatagcaattaacataaacattttttaaaccattcatcagtttattttcacatacccccaaaag

SEQ ID NO: 543891 - DNA, 462 bp, Homo sapiens
acccataataatacaacatggaaaataagctttttcttaggacctctgtacacacgtctgacttctgggtaaataggatcaggctaatgatgagacagcctaaatagagatgtcatgacagagaattctgtcatcagccaacaattccagtgtgagaagttgaagatacttcgtatttgtttagattatgagattgctttaatgtgtggatttcaaactactatgttttgtttgtaagataaaatgtgtgttgaagagaagttttgtttgtaagataaaatgtgtatctacagagaagtgcatggagttttagccaggtgaacacaccacataagcagcactcagatcgagtaacaggctttgcgagtcctgatatttctaaggctccctaccactaagttgtaagctccctaagagcagggactgagtaccattctggtttaaaatatagtacattaatgg

SEQ ID NO: 543892 - DNA, 835 bp, Homo sapiens
  misc_feature (169)..(169): n is a, c, g, or t
  misc_feature (219)..(219): n is a, c, g, or t
gcccctgaattccagcctggtgcgagaagatgatgggcttcgtccgggagtaatagagtttcgctacgctgtctaccagctgtgcttggcaacaaacttgacagaatggacgaggagcaattgacctagtgcggtacctgcggtgactccttgacttagagggccattngtatcatcgtacttgcacatggatcatgacgagctatcacttacgtggtngagaccacgcgtcatgaatgtactatagggacgcgaccaaacgagcatcggacttctaatggtaaataccttgtacctaattgatgaagccgtagagagagatgagtatatcgtagggcatcgcattaaacttaaaccccacgagcatagtctggcctaccgggtttcagttgtttacatgtagtttataaccaatatcctttcaattccattgggacaccgaggaccctacaaatacccttcccaaattgggcgaaatcgccgatgaggatggccccccgaagaaaaacgtttctagctcaggattggtccttccgaatcggtattccttttgtgtggcttccaatttaggtgcttctcaacttggacatgcaggagcgcaagtgaacaactcacggggaatcgtcggaagtaatcggtccttcttaggagtttaatgaccttccaaatttcacacgggctctttcctcttaacctttgtgtcagtctggttttccgcggaaaaaaaggggacaccttaggagttggatcgcgcccatagggcgtgttcgctctaggccatatgtcaaccacccctatgggaaaggcgcgaaaaccggatatacctttatttcac

SEQ ID NO: 543893 - DNA, 1692 bp, Homo sapiens
gggagatctggggggagttggtacagctctgttcttcccttgatcctataccgggttccctggaggaggacacacgaacacaaacgaacctcaaaaaaaaaaatgacaagaaaacacgcacaacacacaccacacacacaacagagctcaccgctcaccaaccccctcgcaccatcacacacaaaaaaaaatataaactataaacgaacacacacaacacgcaaaaacaacacaccatatattaaaaacaaaccaagacgctatacgctgacaatgagaaacacttagagagaaacacaaaaaccggcagatcagcgtcaagtaaacagatatgtacgtgagagacgctcgtacactgaaggacagccacgcaagacaggtcaaggcggacaactgttaatcgtcaacacgaatgacggaagcacactgagaacaaaggaaagcgtagaggaagagaggcaggacagcgggacaggagggggcggagaaggagacagcggacagagacagaaggaaggcgaggaaggagagggggggagcaggggagggggaagagagaagagaagggaagcaggggacgagagggaggaaaaagcaggagacggacgagaggagagagcgaggggagaaggagaaaggaagagaggagacgacgacgaccaagaagaggggagagaacaagagagcgagaggaaagaggaagagaagaaaaagggagaaagaacatggacgggaaagagccggcagagagcgggtgaaggagcaagagagaggacaagagggaaggcaaaagagacgagagaggagggaagagaagagacggggaagaaaaggggaaggaacgagagagaggagagcgacggagaggcaagggcagggaggggaggaagagagagagggaacagaaaaagaggaaagagagagcgagaggagaagacggagaagaggggagaggaggggagggacaaggagagagaggaggaggaaggaaaggagaaggacgagggagaagaagagaagaaggggcaacacaaaaggaaaagaggaaaaaaacagagcaagagggggaggagcaaaagaacacaggtaggagcgaaagcgaacgacgaagcgcaagcaggaagaagcagaacgacggcgaaagaggcaggagcaaggaaaacagagggaaggagagctagaaggagagagagaagagagggagagagcggacgaagggatgaagaggagaagagaagtggagcggaaacacgtggaagaagagacagagaaggcgagagagcagaaaggaagaaggaagggcaggaccagaaaggaagaacagagagaaggagaagagatgagagagagaagagagagaagagacgaaggacaggagcgagagaaggggagagaaaagacaagaaagagagtccaccagataaggatgcagagaggagggagaagagagagaagagaagagaaaggagagaggaaaagcagagagaccaaacgcgacgagagaagacgagagagaagaggaaggatgagagacagagaagaggagagcgaggagaggagagatagagaagaggcggcaaagagcagaggatgacagagagaggcacaaggtaagacagggacgtgaggagcacagaagcggagagtagaagaagagacagaggaaaagagaggagggagacggaaagaaga

SEQ ID NO: 543894 - DNA, 934 bp, Homo sapiens
cacagcgtcgcggacgcgtggatgaccactccgtactggacgtgaatgcccgataagctaccatggtgggcccgcccggggaccatgacggtagtatgccatctaacatcatcgatcatatcggggctggccaaggagtacatcagagcccgagaccaagaagcacatcccgtagccgcgagcacaatgagcctgacgggcacggtgcgctacagtgaggcactcaacacgcacctgggccaaaggagcagagccgccgcgacgacctgagaggcgctgggccacgtgtacatgtacttcctgcgcggatgcctcccctggcatggggctcaggggcgacacgctcagggagcggtaccagaagatcgtgggacaccaaagcgccacgcccatcgaggtgctttgcgagagcttcccagaggagatggccacgtacctgcgctatgtgcggcgcctggacttcttcgagaagcccgattatgactaccgtgcggaatgcttcttcaacgactcttcgacgcagtggcttcgtgttcgactatgagtacgactgggccgggaagcccctgccgacccccatcggaacgtccacaccgactgccctcccagctcagtccgggacaaaaccagcgacagaaaaacaaggcgtgaactcaccaacgggagctgatgcggacaccccacggcggcgagccaacgcccgatacaagcgctgcagaggtgagtggcgtgaacaatgcgtggctcaaagggaaagaaatcgtgcgcgacaagtgcctggcgcgggcctgaatttcagggaccttgggggcctgagaggatggcccaaggacggcttgtgacaagaatggcgaggaaggccccgcggaccaagagaacggggcgcacacaaggagaacgcaccgaaaacaacaaaacaacacacagagcacca

SEQ ID NO: 543895 - DNA, 145 bp, Homo sapiens
  misc_feature (15)..(15): n is a, c, g, or t
  misc_feature (101)..(101): n is a, c, g, or t
  misc_feature (115)..(115): n is a, c, g, or t
  misc_feature (143)..(143): n is a, c, g, or t
ctcctgtaccctctntctcggaatctgaagagccagatttaggccgggcaaaggggctcacccctataatcccaggactttgggaggccaaggcaggaggntcacttgagtccanaaattcaagacccgcctgggcatcatantg

SEQ ID NO: 543896 - DNA, 327 bp, Homo sapiens
cacgctgctgctgtgtgtcactctagatgatccccatcaggcgacttacttgggtggatatttaataacggagggcgtggagtaattgactcctggaatgaggaagggagcttacttgcttgggaggagaggagatcttgtagattatgagaactgtggacggtggtattctggctgaaagtaagtttcctgctttctagagctaagctggctaccacttctagtgctttaaagcagtgtggccaccctttgattgtgttatctcagtcgtatagacgaggtaatgctaggtgggtgcaaatggaatgtgatgtgcaggtgtctttc

SEQ ID NO: 543897 - DNA, 870 bp, Homo sapiens
gcttgatgtactttggaagcgaacaggccgcccgccttctgggcagcccctgcttacgggcctctaccatgcctggctggcagcagtggtcatcttgggccgctttctgcagttccatgtcaaccctcggactatcttctccagtcacggcaacttcttcaacatagaattgtgaattcagcctggtggcttggacatgcactttctttagggggcttggtgttgctggtggtgtgcctggctactcggcgcgtggtagtaactggcagacacctgtagccgacgtggtagtaggggcagccgtgtggcggggacgccgtcgtgccttcctgctcatcgaggacctgaactggctcctgaattcgcagcccctgcccaggttctgtgctccacgaggtgctgagcgctcgtatgtgctctggttggcgtgctaccagtggggaggtttactccggtcctcccgatacgttcctgctcaccttttgtgctgctcatggcggggaaccgcgctgtgttgcgcaagtacctggccatggggttctggcggggcccactgcgctggtttcctggtgaacgtctgatgttgcgcctctggaagtcttggtggtctgaccggcactatttgccacaggtcacttcacaggtgttggcccgaagtggaccgttgctggtaactcactatggacgtggagtctaccctgttcaggagccggcaggggtctccccgccaatcagcgggctactgaaataaccttgggcggaaaaataaacaaaaaacaacaaacaaaaaaagcaaacgagatcaaagaacacaagaaaacacaagaacaaatcactcccatcgagaacaaacaaggaacaaaacaacac

SEQ ID NO: 543898 - DNA, 368 bp, Homo sapiens
  misc_feature (216)..(216): n is a, c, g, or t
  misc_feature (219)..(219): n is a, c, g, or t
  misc_feature (223)..(223): n is a, c, g, or t
  misc_feature (303)..(303): n is a, c, g, or t
  misc_feature (310)..(310): n is a, c, g, or t
  misc_feature (313)..(313): n is a, c, g, or t
tgatgagttgcatttgcaaacgctcacacaattcaaacagcgtggcgatagaacgagcatccagtcgcgctgcttcatcgaggaacagcaggcggcaaggagagatatctttaccgcgcaggcgtcgagattcatcttcccagctttgtaccaccatcaccagaatcgacataccggtaccaatcgcctcaccggtcgacaatgcaccagactctncgngcancagccatcggaaccacggttaacctcaacttccatttccagatagttgcggtaatccagcagttcttcaccgatggtctncggcgtncgntgccccattatcaatctgcgggtttaagacgtttgatacagtttttgccagtgct

SEQ ID NO: 543899 - DNA, 403 bp, Homo sapiens
gagtagaacttcagcgataatcccgctctcaaggagcttatggcacagctgggaagaagagaccactttcagcttaaatccttctttcctcacactttgtagttaagtaccagagcactgaagagactacagacccccaacttccagcaacactgtcctatcacactactcagatcactcagccttcagtacccctctgtgtacatttcacagatcaactcctttctcgtctcctcctagtgttataagctttttcttttgtctttgaagaagtgggaattattttcatctctctatttccctccatcaccagggagtatgtcaagagggttaacttaaggagctaacaaaaaaacgtacaagaggataacttctctattgctgttaatgttgggaaagagcc

SEQ ID NO: 543900 - DNA, 178 bp, Homo sapiens
tgcgctggtcttactttctaatactattttgtaaaaggaatgtgagacttggccatagaacagacacacagaccctaaggaaagaatagaaaatctcagcaaataagctacactaccacactaacatctcatttttgacatggctgacgaaagctatacgtgataagaacttcctttt

SEQ ID NO: 543901 - DNA, 88 bp, Homo sapiens
cccccccaaaaaggggggggcaaagggggggttttttttcccctttccaggaaaagggcccttttttttaaaaggtttttttttttta

SEQ ID NO: 543902 - DNA, 209 bp, Homo sapiens
  misc_feature (203)..(203): n is a, c, g, or t
ctttaaactaaaaaaacctttttttggggggaaattttaggcctttaaaaacctgggttttttttttttaaaaaggttaaatattccggaatttggaaaaaggttcgttgaaaggagggcaaaaccggttgaaggggtttcctttgaaaaaatgaaggattttgggccctaaaattttggttttttaaaaaaaaaggtttggnttttga

SEQ ID NO: 543903 - DNA, 268 bp, Homo sapiens
gacccccctgcgacagaacacttgaaaaagggcgactactgttcctggagccgccttttcagcaatcgttctgcttccagatgtaacaggcactcttggtacattatcatagacatccaagatagttattaagactttcgctctgtctcgaagacctggcccatcccgggcttcaacacccagctcataaaaactcgagtcctcatagtctagatttgcagaagttgaaatttctccagtcaaaacattcaaacagaaaatttgtgag

SEQ ID NO: 543904 - DNA, 108 bp, Homo sapiens
taaaaaatgaagtctctacttaggtcagtcaactaagaaaaaaacgcagaacgcatcccaaaacacaggttcaagaaatgttttcagacagattaccgtattcgcata

SEQ ID NO: 543905 - DNA, 112 bp, Homo sapiens
gagcacaagatgtaaacacgactctgccagtttatttcactgaacggcgagggcttgatttatgagcggggcagcggcgaacaaacttcatatagcatacatatacgaagta

SEQ ID NO: 543906 - DNA, 597 bp, Homo sapiens
agatgatagctgacgaacccccagtgcctcgatgcagagaaggtgctttttttgtttataaattttccaacgcagataaggctagaaccttagtcagtgtctttactctgtaatatgcattgtgagccattcgggtagagtctcagtggcacccaggtctgggtcacagaatgtgtctgtctagggaatgtgggttcagtgaaggaccgttggctcaggtggttcggcgaggtgtattgctgtaccagtttcaaaccaggtgactacgtgttaggacgtagcaatctgaagcccttctgaaaggaacatgttttattaaaagtgccttgtaagccaccatgtcaaatctagccaagatgctggtggacaacccattagtcactttattcagagatcagattctaactgcccatagggctgaaatcttgggccagattttcccaggaggagccctcagagaacagtggcccaggtgcccaacaggaccctacacagtcggtttcttcccttgttcggggacagacagagcgatcggcgatagctgttaccatctcacttaaaaatacttgagcaagttatttccctcctcgggagctc

SEQ ID NO: 543907 - DNA, 109 bp, Homo sapiens
acgtctatgagagactaggatgcaccattggctcctggtatgaaatgatgcaggcactcctggtgagcgaaagcccactgacgctccaccgaaacgagtcactggaagt

SEQ ID NO: 543908 - DNA, 367 bp, Homo sapiens
cggaaaaagcatcgaagaaatgtgtaatcaaaaggaaatatgcacgaaatgcaaaccataaaaaggcatgatagaacctgaactcagccagcaagcacatccagacagacctgattagacctaggacgaataactaataccgaccccaatggagcaaacacaggaaaagcgacacgcaacgccaagctccacacatcggaccacagcatgtacacactaaaaacagagccgaacagacaacacaccagaggaattcggacagaagaacgaaaccaacataatcatcaaacaaaaaccataagcgacaacataagggcaaggaacacgaccaaacacacccacaaacaaactcagaaaaaaataagcg

SEQ ID NO: 543909 - DNA, 105 bp, Homo sapiens
agtcttgtctgactgtaaggcgtagaatctgtccgtcgtgccctcctgcacgaagccagctgggcccacctaggcacttgagttgcagctgctttctctcacaca

SEQ ID NO: 543910 - DNA, 251 bp, Homo sapiens
  misc_feature (212)..(212): n is a, c, g, or t
ctaccacacctggctgattttttttgttttagtagagacagggtttcaaccatgttgcccaggttggtctcaaactcctgagctcaggcaatccacccgccttggctcccaaagtgctaggattacaggtgtgagccaccacacccagctattttgtctttcggtttttaattttaaagttggggggggtctcaaatttttaccccgcttgnctcgaactcccgatttaagcgatcccttggtcaaagcaa

SEQ ID NO: 543911 - DNA, 108 bp, Homo sapiens
gtagctatggaccatatgcatagtaccgcgcaaactagctgcgaagtagatgatcaggctaagctgttagatttccgggtattgtgcatccatgtaaagttactgtat

SEQ ID NO: 543912 - DNA, 263 bp, Homo sapiens
atcactctcgcggcgctaatcgcaatgcccccggccgtccctcattcatccatggcccccagttcctgcacacacaccaacacacacatcagcacaccgcggtcctcattcccattcttcctagctgcagtctcccggcggctcgggcctgctttgcaccactctacattttttcaaagtacacgcttcgggccccgcgagcacatcagctcaagcagccatcgcagggggcgccgagaggccaaggggcggggccgggcggt

SEQ ID NO: 543913 - DNA, 569 bp, Homo sapiens
  misc_feature (1)..(1): n is a, c, g, or t
ntatactttttgtcccgagcgcgcctgtgtgtacccggaatcggcttatggcggggggcatggggacccgcggggcgtttgtgaggggccacccgctttgggaaacccccaaaaaatttttttttttgaagaggggaggataccccccccctaaaaaaaatgggcaggggggccaaaaaattttgcggcgcgggtttttccccccttttttttccccgggggtttaaaaaaaaaaataacccctctaaaaccggggggggagaaaaaaaaaaaatttttttacacacccggggggggggggggaaaatttttttgtggggggaaaatttttttttataaaaaaaaggggggggggggggggcccccccccccccaaaaataaaaaaaaagaggggggggggttgtttatataaaaaggaggggggcgcccccccccccccctatttttttattggggggggggggggaggaaaaaaaaaaagagggggggttttgtataaaaaaaaaaaaaaaagagggaggggatatattttccccctcccccccccgcgggggggggggggggggga

SEQ ID NO: 543914 - DNA, 220 bp, Homo sapiens
tcttaacgcccaaactcactctgtgaatgtattctctatgaacagccataacacactccagtgaagggtctctctgaacagatttaacacactccagtgaagggttctctctgaacatgcctaacacactccattgaagggtactctctgaacatgcctaacacactccagtgaaagtgttctctcataatcatgtcctaacacactccagtgaagcgta

SEQ ID NO: 543915 - DNA, 745 bp, Homo sapiens
ggagacctggagcaggcacgcgcgtaattcatggtgtcagtaattaacactgtggtagtacctcctcatgatggacatgattcacgacagcccagatggactactatgggcacccgcctgggaatctgctcatcagatcaggtccgtcgaaacatctttgactgtgtcgcaatggagtggcagatccttatcgccagaccatcaggggtcatgacgggtcctgtgtggcataggtggcctgggcatcaccccatgtgcggctacatcctggcattgtgctcctatgagcggaaagtcattatctggagagaggtaaaactggcaccctgggagaagagccatcgagcatgcggatagactgaattctctcatgtgaactcgtgtgtgcctgggcctcccatgtactgactggcctgatcctggcctgtgtgagctcggatggggccatctccctgttgacttacaccggggaaggccaatgggaagtaaagaagatcagcaatgctcacaccagttgggtgcaatgccgtcagtctggtgaccctgctgttggtacgcgtggaagcctcatagaccacccatcggggcagaaacccaattacatcaagaggtttgcatcaggtgggctgtgacaacctcatcaagctgtggaaggaggagaaggacggcccagtggaaggaggaagcaagaagctaaaaagcgcaccaagtgactgggttcgcgaatgttggcctgggcccctcg

SEQ ID NO: 543916 - DNA, 252 bp, Homo sapiens
tggacaaaactggacacttcctaaacacaaaactttttgacaatactgtggatgctgaccggagcttgtgaagaaatgacatcaagtcactcaccttcccaagaggaggttaaaaaatgaaccttggggagccaggtgtgttggttcacacctgttgtaatcccatgcactttgggagggtgaggcaggagcactgctcgtgcacaggatgggcaacatagcgagcccttgtctatatttacaaaaaaaaaa

SEQ ID NO: 543917 - DNA, 1178 bp, Homo sapiens
  misc_feature (228)..(228): n is a, c, g, or t
  misc_feature (280)..(280): n is a, c, g, or t
  misc_feature (293)..(293): n is a, c, g, or t
  misc_feature (295)..(295): n is a, c, g, or t
  misc_feature (322)..(322): n is a, c, g, or t
  misc_feature (334)..(334): n is a, c, g, or t
  misc_feature (423)..(423): n is a, c, g, or t
  misc_feature (429)..(429): n is a, c, g, or t
  misc_feature (432)..(432): n is a, c, g, or t
  misc_feature (434)..(435): n is a, c, g, or t
  misc_feature (440)..(441): n is a, c, g, or t
  misc_feature (444)..(444): n is a, c, g, or t
ataaccatgcacactactataaccaccctaaccctgacttccctaattccccccatccttaccaccctcgttaaccctaacaaaaaaaactcatacccccattatgtaaaatccattgtcgcatccacctttattatcagtctcttccccacaacaatattcatgtgcctagaccaagaagttattatctcgaacttgacactgagccacaacccaaacaacccagcntctccctaagcttcaaactagactacttctccataatattcatcccctgtangcaattgttcgantnacatggtccatcatagaattctcactngtgatatataanactcagacccaaacattaatcagttcttcaaatatctactcatcttcctaattaccatactaatcttagatataccgataacaaacctnttccanctntnnatggnntgngcagggcgtacggccatccatatcctaactatgcatcatccagtatgatgataacgcccagaggcagatgccaaacacagcagaccatatcaagcaatcctatacaagccgtatcggcgatatcggcttcatcctcgccttagcatgatagatcctacactaccaactcatgaggacccagaacacaatagccacttctacaagctaatccaaaggctcagcccactactaggactcctcctagcagcagcaggcatatcaggccaataaggtcatcgacaactgactcaccatcaggacatagaagagacacatcacagtcatcagccctacttccacgtaaggcactatcagacgcaggagaggcgcgacttaccgcatgcgatacagcccgtagcacgaacaatcgcccttactgcgacacccgcaacaagcacaagagcatgacactagtacggaaagcggacccctgacacaggactgacacacacggcgaacgcgtgctagacacgatagaagaagacgcaccggatagcacacgcagcaaggacgggaaaacgacacaggcacataaagaccagaacggagacggggagccagaacagcgacgagcacaactacaaaggcgagccagcacagcacactcaacacggcacaggacacaccggacagcaagagagcacaacaaggaaacgacgcgcagcagcgagcgcgtaatcggaagagcgcgcaaa

SEQ ID NO: 543918 - DNA, 716 bp, Homo sapiens
cccgggggaaccatttctgcgtcccatcgcgcgggggagttttctgtggcccccttgggcagaaaattctcggggacgattccttccaactgttgggcgtgcatctatcgctccgcacgtccccccacgggcacgtttgcccgcagttggaccaccagcccccccagggggcttttcctcatattccccggcagccccgcctgcggcggatgtttctcccccgtggaactagtgaccgacccaatgttctctcgccacaggcacttcaaaaagacccgccggatcgtgggtgtctcctcctgcgggaaccacacgccgtcctcgcccgaagctggggcgagcaggccaccaaacgagtgagagagtaaagagagagtcctcacacacgaattcgagggacgaatacggagcaccacctcccgcgcttcttcccacaactacgcgcgcggcgcgccacccgccacaatcgacgtgttgcccgcaccgggctaccccgcgccccactccccggtcacttcggatgagtagcgccgcgcagagggcagcgcagactgccactggggggcagcaatgtggaggccgccccgcaccacgcggacacatacatgtgtgcagagccacgctggaggtgtcaccacgctgctaacatcgcgtcacgcgcactcactaaacaatgtcgcggtgggagcgaggcccgcccacaacaaatgaacaaa

SEQ ID NO: 543919 - DNA, 800 bp, Homo sapiens
gataaataaaagcttcccaaacgtagatctgggtgaggttatgcagctgtttttggtaccattttaatttttgcaacttacttgtaagttggtagctgtttccaaataaaaagtttacaaaaaggaaggaataaatttgtcatatttttctgtttaaatcataaacctttaacttctagaaaagaagcttttttttaacttttattcagtaattatacttcttctagaaatttgtattggaataatcagtgatagtcacaaacacacactatatacatgaatatatgaatagtcatcactgtcttatcacaataaaaaatttaaacaacctaaatattaagcaaaagcagaattgttaaataaacatattcatatgtctgatattttttaacatttacataatatataccaaacatagattcacccacagcataagaatatggttatcactgggtgataatgagtggtttcagttctctttaccatgtattttaaatatactgtaagttatctctgattcacccacaacataagatggttatcactgggcattaatgagtggtttcagttctctttaccatatgttttaaatataagttatctgtagtggtaaatatttatttcataattgggtacaaagaaataataaggaatacttagaagataagtttaagtttacttttctgaaatttactaattaaccatctcccaggtaaaatttgacttgataatttagtgagagtgtctcatgaaataattttagagagtgattagtacaaaacttatttgaaagaaaaaaa

SEQ ID NO: 543920 - DNA, 346 bp, Homo sapiens
tggaaacagagtctcgctcggtcacccaggagggggtgcaaggacacaacctgggtttacggcaacatcggcctccggggttcaagtgattctccggcctcagcctcccaagtagcggggataacgggtacccgccaccacaccaagctaatttgggtattttaagtagagagggggtttggccaggtgggccaggcgggtctcaaactcttgacctcaggtgatcggccggcctgggccacccaaggggctggggatcacgggcatgagccaccaggcccagctagggcataacctttggatggtactcatggaccaaggttcggaggggaagcccttggggggg

SEQ ID NO: 543921 - DNA, 1291 bp, Homo sapiens
atcctctgttgtttgcccatagtttggggacaattttatactgtaggggcggacacatttacctttcacgccccttggttgatatctcgggctttctccccacagttagtatttttctttgttctcacaccttttaatatttgttccccccccctggaccccccttgtttaatccccccttgggtgaatttgtagaccttggtttggttcccacaagggggggtacaacgccttctttgggcacaacgacatggggtaaacaaccccttgttaagagagatgaatgtttaaacaatggtttaacaaaccgcccgtgtggttgtgccccgttatatagcctcgccctccccccttgtttagtgatatgcgctgttcaaaaagcgttttaacaacaatgtctacgttccccctttgtataattttcccccccatccctcgttattgttccttgggaaacgttcccctgcaaacaagaccccaccaaattgtgggggacaccacatttgttgttcacccccccctctttatgagaaggagattctaatattgtttatggtaaataataagtatagacccttgtgaaacaactgtgtcttcctcccgcgactttaaagacccttgcgttccacgatgtttaaaacaccttgagaattcgaccccacttttttaacacggccccaacatatgtttaccacatatccacacctcacacaaaatgtcactttatgtttagacctctcccacacgtgtgtcacacacccccaaacaccacgggcacacgttctctcaataagggagaacggggttttatataaaatattattaaaaaggggacatttcggcgccataatttcttatacccccgccccgtcgtgtgttatacccacaagaacactccacacctctctcaggacactttcaccccacgctattatagaggggccccccgccctggcgcccagtgagcaaacatagagtttaaccggccccccggtgacaccctaacccgggccaaagagtgtagcgataaataccacctgtgtgcccctaaatatagggcacaccgtgatagaataggcgtccccggagggtgtctaacatgttttttacacttttaacccaatggaattgacacctgccccgtgaaagaggccgggccactgacccacgccagaccgaaggagacccctattggagggctttaaatttatattaaagccaacacccggaccctcacccaaccccccggtccttaactacccaacccgccatttaaaatttcgggttggga

SEQ ID NO: 543922 - DNA, 916 bp, Homo sapiens
  misc_feature (12)..(12): n is a, c, g, or t
  misc_feature (80)..(80): n is a, c, g, or t
  misc_feature (107)..(107): n is a, c, g, or t
  misc_feature (116)..(116): n is a, c, g, or t
  misc_feature (122)..(125): n is a, c, g, or t
  misc_feature (127)..(127): n is a, c, g, or t
  misc_feature (134)..(134): n is a, c, g, or t
  misc_feature (172)..(172): n is a, c, g, or t
  misc_feature (176)..(176): n is a, c, g, or t
  misc_feature (211)..(211): n is a, c, g, or t
  misc_feature (229)..(230): n is a, c, g, or t
  misc_feature (261)..(261): n is a, c, g, or t
  misc_feature (277)..(277): n is a, c, g, or t
  misc_feature (282)..(282): n is a, c, g, or t
  misc_feature (285)..(285): n is a, c, g, or t
  misc_feature (287)..(288): n is a, c, g, or t
  misc_feature (296)..(296): n is a, c, g, or t
  misc_feature (305)..(305): n is a, c, g, or t
  misc_feature (307)..(307): n is a, c, g, or t
  misc_feature (311)..(311): n is a, c, g, or t
  misc_feature (323)..(323): n is a, c, g, or t
  misc_feature (335)..(335): n is a, c, g, or t
  misc_feature (366)..(366): n is a, c, g, or t
  misc_feature (370)..(370): n is a, c, g, or t
  misc_feature (383)..(383): n is a, c, g, or t
  misc_feature (385)..(386): n is a, c, g, or t
  misc_feature (402)..(404): n is a, c, g, or t
  misc_feature (406)..(406): n is a, c, g, or t
  misc_feature (427)..(427): n is a, c, g, or t
  misc_feature (431)..(431): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (473)..(474): n is a, c, g, or t
  misc_feature (479)..(479): n is a, c, g, or t
  misc_feature (517)..(517): n is a, c, g, or t
  misc_feature (530)..(530): n is a, c, g, or t
  misc_feature (876)..(876): n is a, c, g, or t
tggaagaatatntagaaataaaatttaaaataaattttgctttcacagacagaaatatgtcatgctactatctgaaaacngtaagttaacttactctaaggcaaaancatggagtnattttnnnntnattttanaagcaccattaacacagacttttacatagaaatttgtntgancctatctgacaaacctaaacaaattacaataaaanatatcagcttagtaaagnnccatcattttatacatcagtcatgttaaagngcagagaggcatttgncttanggntnntgccaganatatttttntnatgngatccattagantcatcataattnatagtgtgttagagagggaagcatcaggggntaancacaacagaattngnngttaagtgtccaaatnnngntcagtgaatacatgagttganacanaacggtacagagaccnattatnccaccaagngcatcattttnngtgtnctttgtagctgactacaagagtgaggagtaccattttnttcaatagaagtngggggagctgagcgagcaagggactagctagtagctgtactgggcgagatcacatggttgacttgcacggtaagatcacaaccaccccactgcacattaagccctgcataagccaaggaaagaaaagaaaaaggaggctgcttcaggtgttcattagccaatgacttcagtccctgaatcaaggttactggttatgtaaatccaatatgacacaagtctttccctgaaccccttcattctgtgacgtaccatcaacaccatctgcggtttcgctttcttcttcttcttcttctagcatttcaaaaggagtcattatatcatagagaaatgagagggaacataaaancaatctgacctttctctgctaaaaaattaaggattcctca

SEQ ID NO: 543923 - DNA, 337 bp, Homo sapiens
  misc_feature (13)..(13): n is a, c, g, or t
  misc_feature (51)..(51): n is a, c, g, or t
  misc_feature (80)..(80): n is a, c, g, or t
  misc_feature (152)..(152): n is a, c, g, or t
  misc_feature (193)..(193): n is a, c, g, or t
aaattgcattcanatgtattttacactttaggcagttcttaaaaaaggganaatgcagtttcttgaccttaacatttaanggttttattgggccacattaatcttcctcacaaaagttttaagttatctataagttcttaaaaatgtcaaanaaaaaaaaaaaaaactgactaaggggcggtggaaacaacancaacttggcaataattctgcaaccgactttgcgtgttcaggcatcctttttctccagtaaaattttgtgcaactcgtctgcatcctcgctggttttacccgaaatcaacatggtgactgggcatggtgggcattcttctcgtca

SEQ ID NO: 543924 - DNA, 456 bp, Homo sapiens
  misc_feature (39)..(39): n is a, c, g, or t
  misc_feature (77)..(77): n is a, c, g, or t
cggccacgcttataggtgttggatcttaaactgctgagnacaacggatctccaaatgtgggaaactttttgacatgntctagaaacagattcactgctgaatagggattttagagctgtgagcaaagtgtataccgtttaatacacatccccttcttttatatttgagagaactgtggccagagaggtaagttgccttgttcagcctcgttaagcttaagcttaacgaggcctatggcacagcaacgtgggctctgatccaagacctaccccacagctcacagcaacaccagatcattaacccactgagcagagctgggaatcgaacccctgtcgtcttgtatactagttgggtttgttactgctgagccataacgggaactcttaacattaaaaatgtttttctatctagaatttatttttatttatgacaggcgcaatctaagtcttttttttt

SEQ ID NO: 543925 - DNA, 581 bp, Homo sapiens
gaggatccctgcgggtctcttcgacctcaagtgatctgcccacctcggctcccaaagtgctgggattaaatgtgtgagccaccatgcctgtctcagtagattcttatatggtcttttcttctttaacctcttagattaaacatgaatttaagttggagcccaagacaaaagagaaagggaaaaaaaatgttgggatgtgggtggctaaagaagggaggtgaacatctttttcgaaggtgtacttaccttcaggtgtcacagaaacaaacataaatggcattagttaagccattaaatatgaatatttattaagctaggccctattccaagcacggtaatataacagcaaacaaaatagctcttatgaaactcttattttagtggggaagaaggtgacaataaacaagatagataagtagaatatatgatatattagaaatgagtgcttgggaaaaaaataacggagaaaggggggtggggaaagtagttgaatttcagataatatactaaggaaatcctcactaagaaaacatttgagtgaagacctgaaagacatgttgtgtgtgagtcatgcacttatc

SEQ ID NO: 543926 - DNA, 298 bp, Homo sapiens
  misc_feature (288)..(288): n is a, c, g, or t
attattattgtaaaacctaacatgggtgtttgaggtatttttcagaccctgccttctgatggatcagctggcaccacccagaccagtaaactggctcatctggtcttctggcccccaccccaggaaccaactcagtgcaagaggatagcttcaactccttatgatttcatccccgacccaaccaatcagcattcccgcttcccgagccccctgcccgccaaactacctttaaaaaaccctagcctccaaattttcagggaggctgatttgagtaataataaaaccccngtctcctgtt

SEQ ID NO: 543927 - DNA, 133 bp, Homo sapiens
tcttataattatagcagagatgatatcagagcagacgcacattttggttcttggtgtagctgcacttaggagtcatgactagaaatataagcaatatgatacgctcacagctctggaatgtaagggtgtatag

SEQ ID NO: 543928 - DNA, 894 bp, Homo sapiens
  misc_feature (210)..(210): n is a, c, g, or t
aacattttaatttttgaataggcaatgccttcatatgatacaaaacccaaaacctaaataagtttgcagtgaaatctctctcctatccctgtctactgctagatggatagaatcttgagttggaagtaggaggcaggcaaaggtaaggtaaggctgtaagtcaccccagctcatttacgaggatctcaggaccctgtatgcatagaaatngtggttcaggtaagaggctccgcccgcagtactgggtatctggttacaggcgtagtctctgagaactcccccgaatctagtctctccactctctggcccccgtacctttccgtctcaaactcttggtcaggacctcgagctccatgtgtaattttcctccaggaggccgagccggcgtcgttgcagggtcaagagctggtcaatgttgtgcaagtgactacgcagagcgtgggcatactgctcctcagcttcagtcaagtccttagccagagactgggcagggggaagagaatgactgtgccggccacgtagcatccgtgagaggctggggagatggggcagccaggtcctcagcaccaccctgtactctcaggtttgagggaagtggagatgggaggggtgctaggtctagctgactagcacgtcagttgatccccagttggtgaactgaaacctccgggctccaaaaatctcagggggcaggcagggaggaggacaccccccgggccaacaacgcacacagagcggatccacccgagagaagaagatggggttgggcaccaaatatccaaggggtggaaaccgccccctaggtgaaacagagaaaggcggaggtgtcaaaagaagagcccggaagcaactcccatgctataaaaaagggggggacaaaaggtcaaggtcaac

SEQ ID NO: 543929 - DNA, 475 bp, Homo sapiens
taagcagtggccttgtttttctgtgctgtagcgtggcacccctgtgtgtgtacaccacagagaaggggtcccaatctccacttttatgcccggaagcttcccagcctcaggagttggaaaggagctggaagtgtaactgagtaggaactgagcaccaactcatatatcccccgcaatcccctcctcactatccaggctgggcccaaatgccttcctgtgctgcacagggactctccatacctactactcttagaaaataaggtaagagtaaagggacgactggacagaactgggaatgtggccacagaaaagtccccttgcacttttagactgtaaggtaaaaagcaggggtcagagagtaaccgtcactgagggaaaggaccttaacagagctggatcgatgacatgagtactcaagcagggtcaggaagtataaacgtataggtgtttagaagtaaggaacttcagcgaaaag

SEQ ID NO: 543930 - DNA, 796 bp, Homo sapiens
gcaaaagcccacagggcaatgacccattgctttcttacgtgttttccctgagcaaatgagcgctccaggctgtcgtgaatccacgttccctgtcccatcctctgacggagggtcgtggctgtggccctcatgggtccccggcccgacccagccacagcgccctcctgtattcccgcaccggcaggtcatcgggagagtttgaatccagagccatattccctagtacctccgactgtctcccaccaggaatgcagaaatcaggtgtgttgtctattgtatttctctatgtacgtatttgtatttctcgcggcgtgcatagattttcctcgtgtatgctagttggcatgccgcgcgttttgccccatccgcgtgacaaggtgtgtgtgagcgtgtatcgtgtgtggctgcgtgtgtggcgatttatgtcctcgtggttgcctttgtaacctgctctgttctcagcccagcttgggttaccaactgggggcacctgggactgacaggaggcatctcggggcatgcgggcagatggccacgggatgggtcaggtgcggacccttgactgtgcaaccctctgactctcttggggggacgaccgtgtaacgatgaaacgtcgcgtcaagtttatttgctttcagtgcatctcctaggaaaagcaagtgtatcggagcatgggggtggtgatgagtgggcccgtgggcgaaaggattcaacgagtgcaaatcccagaccagggcagtgtgacaacagccgttgagcatctcacctgtgtcaaaacaagacaaagacggaacag

SEQ ID NO: 543931 - DNA, 176 bp, Homo sapiens
ggtatttctggcaagccatcacttccacctataccttaaaattagggtcaattggcccaagattaggtactaattctagggtagggatcatcatccccataccagcaataccccccccgccagataaatgccatgcagctacttcatattcaatccacagtccttccaatatcaaa

SEQ ID NO: 543932 - DNA, 344 bp, Homo sapiens
ccaatccttgccattgtccatgccatagcaggctccctcaatctgggctcattgtgccttctactggaaggattgtgtcattacaccactagcgttggtagtcattattgattgattctctgggttattgagtcaagccttttcaagtagaagtttctacctgaatgcatgaatggtgttccactgggtaatcaaagaggttgtccaagagcagtggatgcctgtcatgattataaagtggatatagctttctacaacagcctctggatacttaccttatttcctaccatgtggatgaagagactccgcgtcgacgcggccgcgaatttagtagtagtaggcgg

SEQ ID NO: 543933 - DNA, 134 bp, Homo sapiens
tctgatgtggttaggacttcccagcattatttttttaagatctggtccctcggggccagggcctcagggtatgggtcgggctggaccgggtctccgggtacatcttcccagtttggggtgactcccttcagttt

SEQ ID NO: 543934 - DNA, 682 bp, Homo sapiens
acaggcaccctggatcccccatgagagtagattggtgtgctcagtgcctgcttggctgactcagagtgtagtggcagtgggctctgcagtgccacctggctggggttggtgggggtcctctctcctgccccagctttccacatcagccaccacatgttgccacaccatggtggtggatgactgtggtgtcaccactgggcttgtggatgcaatgctgccttcttgcagcacagtgaagccgaagctgtgggtcagtgtgatgtgtctgctaccccttgaacgtgttcctccggtgatctacaaccgcatggaccctcgggcccataacccctagtgcctggcaaggtgcccctttggccgatgaggaacttcttgatgtgcgcaaatctcatccacgatggctgcctgctctggaaagacatgctgactggggcgcttcaacatgttgtgcttagtgcttgcctgattgacacgatgtactggtgtttctccaggaaataggacctgtaagtacatcttttcctacccttgtgatcaatgcctttcagtggtatcgcttgcagaaatctaatcgtacgatgacattgccaaccaggagaaacgggatgtctctgatcagcgcagtcccagctgagatgtcgaagtgccacagtatcccgggatgacctggagccctggatcg

SEQ ID NO: 543935 - DNA, 457 bp, Homo sapiens
ggagaaaatatttgcaaactacccatctgacaagggattaacaaccagaatattaggaaaaggtgtagtaatcaaaattaaaaatgggcaaaagatttgaacagacatttctcgaaaggcaacatacagatggcaaacaggcatatcaaaaagtgttcatcaatgatcatcagagaaatgcaaatcaaaactacagtgagatattacctcactgcagttataatcgcttatatctaaaaggcagtaacaaacgctggcaaggatgtggagaaaagggaacccttgaacactgttggtgagaatgtatattagtacaaccactatggagaacagtttggcagttcctcaaaaataaaaattgagctaccacatgatccagcaatcccactgctggtatctacccaaaagaagggcactcaggatcttgaagagatattgcaatcctgtgttgttgcag

SEQ ID NO: 543936 - DNA, 332 bp, Homo sapiens
  misc_feature (3)..(3): n is a, c, g, or t
canagtgaagaaccgcttccagacagtgcatttctttcgagatgtcctggggatgcaggttctccgccatgaggaatttgaagaaggctgcaaactgcatgcaatgggccttatgatgggaagtggagtaaaacaatggtgggatttgggcccgaggatgatcattttgttgcagaattgacatacaattatggcatcggagactacaagcttggcaatgacttcatgggaatcacgcttgcttctagccaagctgtcagcaatgccagggaagctggaagtggccactgagttaaagttgcagaaggggattttttgaaactggaagcccc

SEQ ID NO: 543937 - DNA, 106 bp, Homo sapiens
ccttgcagtcgacaagacaggcaggattcttgcttgccatggaactgactctgtgctagaattgtttagtatcctttccaaaaaggaaattcagaagaaaatggat

SEQ ID NO: 543938 - DNA, 735 bp, Homo sapiens
  misc_feature (76)..(76): n is a, c, g, or t
  misc_feature (127)..(127): n is a, c, g, or t
  misc_feature (266)..(266): n is a, c, g, or t
ggacactagcagcattcttgagagacagagaaaaatgggctcttagctagtgcactccacagagatatagatagtngtctacacgtacaaagaataaacagagcatcaaaactgcaataagcttatngaatgtgtacgttcaaagtaagcatagtaagtgagtctagacataggaagataatgcttaacaaggtagaaggtttcattaacatattgacttttacaatagcttacagggcagtaatgcctgtgtatagagacatgtnatttaaactaaattctgaattttaagatgatacgtgtgacacctgagtctgcagaatatagccatatagatgcatgtgtactttctaaaatcacgaaagatgtacgctatgcataagaaacactttctagaggtatcatagggtagccgtaatgtcgtttcaccatgacatgtagtggctactctaagccacagatatataagtaaaaatagagagaactttctcccaaatggtaagagagtataacttgtttcctagcaactggtgttgtaaagataaactacacgatacacagccacactattcacacatacacacgcaatcaacccagtctgcacactgggcgagcgtcctaacaaaatggttgcaaagccacccgtagtcctatagtgttcaccgaaaccctaaaggactcatgagaatacctacccccaaggggaatgtagaccccatgcccacaggcacctgg

SEQ ID NO: 543939 - DNA, 494 bp, Homo sapiens
gtgcctactccagaatgactacgtccacagagactatcaattcacatgaagcagcagctgcaactctaactatacatctccaagagggactgggcacaaagcacaagcctaactatgctcaagcaaaatcatcccgcaacaccacatgaccctaaagtatcactagtgggcatagccaaataatttctcgtgaatgtgcctcaacaaagcacaacccttaacttatggcgggaagagacaaccacaatgtgtaaagactccattaccttcggtggcaaatgtgctggaaagtaaagtgcttcatttctcttatggctcaatgtggtggccatgcgggcggtctgagggtctgcatgtcctgaaagtaatgaaagcactcctccctgatgtacagtggggaaaatatgtccatatctaaccagtgatccgagctatattgaagtattcaggacagccagtcttaacatttctaactctgatgtaaatgacgtaac

SEQ ID NO: 543940 - DNA, 438 bp, Homo sapiens
  misc_feature (66)..(66): n is a, c, g, or t
  misc_feature (132)..(132): n is a, c, g, or t
atcaaacacccctgtttcccttcgagccaataccttcatggagggttagctacaaccaaggtattncctggctaaggggaacatccctgccgaaagcttacaccttcttcattgacatcctgctggataccnatccagggatgaaatcgcaggatgcattgagaaggcctatgagaaaatcctttttgctgaggctacccggatcctcttcttcagcacacccaaaaagatgacagactatgccaagaagcgaggttgggtgctgggccctaacaactactacagctttgccagccagcagcagaagccagaagacagcaccatcccctctactgaactggccaaacaagtcatcgagtatgcccggcagctggagatgattgtctgaggcttgaccagggcggtggatatggctagtccaacaaacccagtataggc

SEQ ID NO: 543941 - DNA, 292 bp, Homo sapiens
ccccccccccccctgggcccccggggggcccggggggggttgggggccccctgcccaaaaaccttgtgggggggggctataaaaagcgggggcccaaaaaaaaacgggccaaaaagggggcgccccgggggggggggggggtttttttcccccttccccggggccccccccttttcggtccccccccccccaaattttgttttaaggttttttaaattagggggggggggggggggggcccggggggcccggggcccgggttttttttttttaaataaggtggggaacccca

SEQ ID NO: 543942 - DNA, 951 bp, Homo sapiens
gccgtgattcgcggcttctggtacatgcatgggctgactgaacaatgccgcgctcgatcttctactccattggttggcatgattgcatttggatgattgtgcaagcagcggattactcgattcctggtgtgacacagatagtgtacaataccacttgaagttgccgtgatcatagagtttcaggaccggtgtatggtagttggatcccagtgactctagtggattctcgtacctttcgctatcatgtagatgtcaggattattctgaagcttatgggttcagtatggtgcggaatggttgcaacaattcttgcttgtgcatctctcctagtcgattagagtactactgagcctattgttgggcagtgtctcgtaatgctgtgtctggttgaacttcgtattgagactagactgatccatgagtcacattcgggtgccacgttaatgtcgctagtgactactaagccaccacatattgacgggagtcctattccaagactaaggatcgtgtccagtgcagatagccttgtgggtagctcttgaactccggttccctttctcagaaaagtgtacctcacttacttttgcaacatgtcccctacactgttgacgtcgttggggaagcagacatggtatgtcactcaattgttctaattagcctccaaggatttcacagcacttctaaaaatggtgcatcacgcgctactaccactgcaacttcttacaaacatgattttaaccctactggacatgttgttgaaccgagagctctgatgaaccctgtggccactcgccttccaaggaacctgcacaccattccgtctgcatctgcatgcatctaaatgactggactgggctaagtggattgcacagctctcgtatgatccggacccttgtccggctcctcgggtcccatgcaaaaggatctcataacacctcgggtgcaaacagg

SEQ ID NO: 543943 - DNA, 302 bp, Homo sapiens
acagactataaaacatcagatatcatggatgaatatttaaaggtatcttactagatacactagatagacaggttcgctataaagtaatagaagattaatagtggtgcctagctgccctctgaatacaggaatcacaaacctactacacacgtccctgcaccgaagagcctcgaatacagctgcaaaaaggggaatacattatagccacaagaggtatacgatactggttatatggagacaaaattcttgatgataccttaatagaaggtgtgtcaagaatccggggttggttccctagaaaa

SEQ ID NO: 543944 - DNA, 261 bp, Homo sapiens
tgcatctctcattcccctatggacacctcagcttgggattaatgcaggacctccagcagaaggttgtctaccatgagatacatggcggtggagtacaatgtgtccttcccccacgcagcaaagaggacatactcggctcagaatgcatcccttcgagatctccaagcacccatggggcagagcattcagtagcagaaaatcgagcatcattcattaaccagcggtccacctcgacctgctctccctgaggctccaggctgc

SEQ ID NO: 543945 - DNA, 487 bp, Homo sapiens
gggatgccggctgtggacgctgtgaatcgtgtgactggcccggttctaccggcttgctccccatccccctactttcctccctccctccctttccctccctcgtcgatgtgcttgctgtggtcagcagaactcacatgactcaccttcgaacgtcttccgcaatgcgcctagtgctcgggggaccagcggaaattgcaccctggacgtttttctctgattgagtgcaagtcccacgtcttatgtgtcaggggagggcgagcacatgagaagcaagagcgcggatttgcggtgtagcatgtatacgagagaaaatgagcacagatatgaagctcttcattctcgcccatgatttcggatctgaatggggtttagaaagaacgcccattggtggatagaaacactaggaagtctgggggtttagtggtggcttcttgggtaattattgcggaaaacagatgggattgatgcggggcctgtgatactgata

SEQ ID NO: 543946 - DNA, 170 bp, Homo sapiens
acgatattctggcagatggaaaggctggggagatggaaactactctgggaacaataacaacaacagcaacaacgattttcaaaaaagaaacctgggaagaggagtgggacccagagtacacacccacaaatgcaagaagtattacttgcatgattgaccgaatatctgtg

SEQ ID NO: 543947 - DNA, 633 bp, Homo sapiens
  misc_feature (79)..(79): n is a, c, g, or t
  misc_feature (198)..(198): n is a, c, g, or t
  misc_feature (228)..(228): n is a, c, g, or t
gccgccctgacccacccttcccgatgcagtccctgatgcaggctcccctcctgatcgccctgggcttgcttctcgcggnccctgcgcaagcccacctgaaaaagccatcccagctcagtagcttttcctgggataactgtgatgaagggaaggaccctgcggtgatcagaagcctgactctggagcctgaccccatcntcgttcctggaaatgtgaccctcagtgtcntgggcatgcaccagtgtccccctgatttctcctctgaaggtggatttagttttgggagaaggaggtggctggcctctggatcagaggatcccatgcgcagactacattgcgtcagctagtacctttgagcacttctgtagatgtgctctgacgatgttacttcctactgtgaggatgccctgaccagatgccctcgtgcgtacctagtgcggcttcctttgtccactgattcctttcaaatgaaggaaccgtactcactgaccaaggagcgaattcgttgtgcctgacctggacgctgcccagttgtgctcacaccgggaactaccgcatagagagacgtcctgagcatgcagtgggaagcgtctgggctgcatcaagatctctgcctctctatagggccatata

SEQ ID NO: 543948 - DNA, 430 bp, Homo sapiens
gctgggccggcgcctgggcggggaacgggttcgcgaccgcagccgagagacccctgggcgaccggcacctccgagactcgcagggccacctgcctcgaccttccccggagctgcccccgcctccgagtcagatacttgccggggccgggcacgggccgggccgtgaatgctgccggagaggaccccatgtcctggccacatggccagccagactgactgccgcacgatgagacccacagaagacccccaccagtgaacgccagcaagccacaatggaagaagccggaccccagtgcagagacgcatggggggcaggcgcgcaaagacgccaagcagtgtggatcgagcaaggaagcagagcgcaaaaagacgaagacacttacgccagaaagggtgaacacgtatcagggaaagaagaagacaacaaaaa

SEQ ID NO: 543949 - DNA, 447 bp, Homo sapiens
tctaagagaaagaaagaacagggagctccagagatcgctgtaggaacaagactctatctgtttgggcattatatacagttaagtgcgttcagtgtctgatccagtgtctgatgtaagcccacgttctcttctttggcctgggcaagtttctcttccaggtcatcaatggtcttttccagtttagcaaccgtcctctctgcaaattcagcacgggtctcagcctctttcagtttgtcagacagaagtttaatttcttcttcatatttgtcctcctttacagaatacttttcagatgcagcctccagagatttcagattgttagtaacattcttgagttcttcttccaggtcaccacattttagttcagacacctccgaacgctcctctgccctctccagctcaccctccaggatgaccagcttacgagctacctcctcgtatttgcgg

SEQ ID NO: 543950 - DNA, 131 bp, Homo sapiens
agccgtaagcctcactccaatgtgctgagaaagtgcagcgtgccaaagcggccagcctcagcctctgtcttgtgttctctcgttctttccagagacaaggcagacagaacgcagaccggccatgtgctggg

SEQ ID NO: 543951 - DNA, 249 bp, Homo sapiens
gattgccttaacgaatgctgttggatcgtgtgtaaatccaaagtcaagccccatgacgtgtcgtccttgtatcttgcgataatcaaagtcttccatctcgaacagtccttaaaataccagaccttcagctactccccactcgccgtctacgaaactcttgcacgtgtagggttacgcactttcatttctagtagcgcttcaatataaccagcgtccaagtagtcattgtcctcatatgtcgttgtacgt

SEQ ID NO: 543952 - DNA, 310 bp, Homo sapiens
gagactatgcatataatgctttctccattgggcacagatttgaaatgtatgcttttatttattattatagaatgtagacataatgcagcagccacactcggggcaggggaaggttggtaggtaagctgtaacagattgctccagttgccttaaactatgcacatcgctaagtaacctaacttcttgttttgatttgaaaaaagtgcattgttttcttgtccctccctttcatgaaacgttaccctttgacgggccttttgatgtgaacagatattttctaggacatactataaggactaatttttaactt

SEQ ID NO: 543953 - DNA, 191 bp, Homo sapiens
gagggggtaatgggcaggtcccccacagagggtcccacaagacaacactgacatcaacaatgaaaagttgcaaatcaggcagaaatggggacgtcattccaaggtccttatatacagacactgcatgaccagcagggaatgggggcccagatgggactaggcgtgggcatgtggctgtcgggcagtcgggg

SEQ ID NO: 543954 - DNA, 141 bp, Homo sapiens
cgcagataaggccgcaagaatctggctgaccaggctgaggccgcagggtctaagaccaaggaagcacgcaaggcgccggtgaagagcgcctccaggccaagaaggagtgagattcatcaaggaactttatccaagggagga

SEQ ID NO: 543955 - DNA, 168 bp, Homo sapiens
tgggtgtaggattgggagaggatggggcatatctccgtaagagagaagtggggtggcttttaggatggcaagggacttcctgtaacaatgcatctcatattatggaatgactattaaaaaaacaagaatgtgcaatcaaagtactcggccacattgtgaagtttgggg

SEQ ID NO: 543956 - DNA, 626 bp, Homo sapiens
  misc_feature (265)..(265): n is a, c, g, or t
  misc_feature (540)..(540): n is a, c, g, or t
tgtattttacgagtttaggggttcatcggttagccaggatggctcgatctctgacctcggatctgcccgctcggcctccaaaggctgagattacaggggtgagccaccggccttctattagcttttataatggagaggtaactgtcctagaaagtccatgtaattccgttcagataatgaacaatacttattctatgaagacattatatttcctggactgacctttcacatctttccctatgtgaatgggtccctgagaactttntctgctgctggcacttattggaggtaagtctaacaatgagatgataccaaacttatactagactactgacgatattctattttcctaatggatccaatgcttattcagaatatatctatagtttaaatttcatgtttaaaagtattgcattagctgtgaatttctgctgcaagaccttgcatatgaccacgacagatcacagctaggcttttaaatttgattaatctgtattcacacacattataatactgtgtgatccagaccgattagacatnggaattttttagataaaaaatggcttgttttatccattaatttagccagactttttccttgaattcctattaattggtcactcttt

SEQ ID NO: 543957 - DNA, 409 bp, Homo sapiens
  misc_feature (107)..(107): n is a, c, g, or t
  misc_feature (126)..(128): n is a, c, g, or t
  misc_feature (130)..(130): n is a, c, g, or t
  misc_feature (177)..(177): n is a, c, g, or t
  misc_feature (183)..(183): n is a, c, g, or t
  misc_feature (324)..(324): n is a, c, g, or t
gattggagataaagaaaaagtggggaggaaactttcccttctgagataaggagacatggggaaaagcggtagagaaaagattgaatggctggaaagccacccaaagnagctgacatggaagcttcnnnanagtaagagaaggaactgaaagaaattgttcaaccaaatttacagcanactctnaatgaaggcaggccctccccccaactggttgagaggatacagcaagaaaaagatgagttgtagacactggattctgctagtctgtaatattgtaaatactggactcaggaacttttgtaggaaaaaattgaaagaacttanagttcgaatgtaattggaatcttcacctccaagtggagttgaaactgcctaagcctaagcggctgtttactgcttttcattagca

SEQ ID NO: 543958 - DNA, 2148 bp, Homo sapiens
cccggaacattccagctggatcgaggcccgtggggttttatactcgcgcccgacggacgacgacgacgacgacgacgacgacgacgacgacgacgacgacgacgacgacgacgcacgacgacgacgacgacgactgacgacgacgacgacgacgacgacgacgacgacgacgacgacgacgacgacgacgacgacgacggaccgagacgagacagacgacgagagtgaggacgacgaccgaggaggagcaggagggagtgagggaggcaggagacaggcaggcagccaggagcggccgggcgtgctcgggccagagagcgagacaggagcgaggagctgcgcgcgacgtcgtcccgcacgcccgcccggcgccccacgccctggacgaccactgcatgccgagccggcacagctgacgtgactgaagtgcgtcacgtgtgctgacgtaacgtaacgtaccccaccaccactccctttcaccaagccgcaggtatttgaatctgattgtatactgactcgaccgataccgtacctctattctcttcctccccatgccctagcaacgacacgctgcgccatcactgcgattcctatgccctgcagctgccctatctgccgcgccgttgccacgcgccgcgacgcccgtgtgccccatctacacgaacaaaccagcccatcaccattacatctacgttctcgatccgtctccccctccgctcaactccccatccaatcgcattgccctcctctcggcaattcgtcaccgcacaaacgcaacaggcaactcgtatatgttttgttactcagacttgtacatgaaccttcaaacttataatttagttatctattgagccttagcactgagcacagaacccgaactgagattcataacttaatatcctaactctcccacctcccttctccgtctaccctctagcggtcgggttccggttcggtacgatctcagctctggttcggtttgcgactggctcggtcgggacagtacgcgttccggttcggttcggttcggttccgatcggatcggaagcggatctggatagcgtatgcttgctttcgctatctatctcatgtgccagtctctaccctacccattccgttcccttcacgttccgttccgtttctttgtattcctttcgcactcgagtcggattcgcggtcggctcggcctccgcgcttgatgtcttatgctgtcgtctgtcgggagcaggcccgtcgcatgagtgggcatggcaaaggcagaggaaagagatgcgtaagacttggattagttagcgcgcgacttaagatactcgtggggtctgcggtagcgcgcatgttcgctcctccccgctgccgcgactgttatttgttttctcggttttgcctcttccgcgacgcgcagcgccgtgccatggctagtggctcgggcgattcaattggccgatgcccttatctatgcacacgctgctgcatccgactctcatacacatcccatcactccctccctctcgtcgtcctcccccgttgccctcaccctccctgactcttaccatcactactcatttcattatactactacccatctacttccctgccgtatactaccattgcccagaccatgcaacaccactaacttaacctctcctccaagctcattgatcacacatacactctatcttacactcctctatcttcgatacagtatagatacattacactccatacgctacattatcccctctattcgcttccattttctccccaacaaccatcatcactccatcacaccttcctattctcatacttatctccgctactagaccgagaagagaatataaattcactgacacccttcccatacccatcatgtatatctacatacctctctatcgatcacatacttacactcactcctcctcttccatctgcaccctactctcactacccaatcaatatttaatatattctacaaagagatcaaaacctcgcagcgcaatccacctcattcactcaccactctcttgatactatataactacacttacctactataccatagatctccatccctattaccgcctccgcttgcccctgccatccgtctaccgctcaaccactcatcaatcgcgatagacgccacgagttaat

SEQ ID NO: 543959 - DNA, 589 bp, Homo sapiens
tgctgctttctcctctcgacgccctccctcctcctcctccagccgaggctccgcccgcagcccccagccagccaactcagctcgtcataactcagaggaccgtgtccagggttgccaggaatgccactgaggctggcagagtcctaaaagggagtggcaggtgctgctccacaaggacggttgtccaccctcaatgagggctgcagggcaactgctgactgtctggcagccagaggacagggacaggcagccaccctcttgccatgaccacacctgggtctccctcaatgtggctcccgaggggccgttgaacacagtgttgagaactgctgagaaaatcacaccaaagacgaactacccacagatgccagtcaccactccagggtgacgagaaagagaacacacaggcggcagcgtgacaaaatgagtcccagcatgctacatctggtttcgggttttatttcagaatttataaaattccagtgtcatccatattcattgagcctttacacatgtttgcatataatctccaaattccaaagttaaggccaagggatggattgtagctatggaaagggtacgagctcga

SEQ ID NO: 543960 - DNA, 102 bp, Homo sapiens
ggggggcccctagggccccggttgggggggggaaggtgagggcttcggggggtgctataatgtgcccctggttcttgggtaataaatttcctgtggtttgta

SEQ ID NO: 543961 - DNA, 113 bp, Homo sapiens
gttgactctggtgaccttcaagagcacacaggcagcacgaacttcacactcagcaactctgctcttcctatttccccctttcagagaggagacttatttttctctgtaataaa

SEQ ID NO: 543962 - DNA, 980 bp, Homo sapiens
ctgttgtatgtccgcgtggagcgtgtcggggatgtcttctgccgttcgtgtcgtttcgcgtgtgcgctctttggggtcccgctctcttatccggtgggcccgcccctgggattggtgcgccccgtggtggcagtgttgcgcgctgggctgggcaccacttgtgcggcgcgctttaataattgcgcggcgctagtgtttttaggttgtcgtgcaagggggtttccaaaggcgggtggccgctgcaaccggggccggggctctcgctgcgttgacgtccccggagaagccccgggggctgcgtttttccccaagcgagtgtcccccccggcatgttctttgcacccactcggggggccctgctctgcataccctgggggttcccacgtattggggttagaagtggttcctgcacacacaggtgtgacccgctgtgttggcgtcctggccgaagacctcccccccttacccctactgggtggcccggtacccccacgctggtgccccccttatagagggagctgccctcgccgcatttttttcgataataccccacaccgggtcgcttactcacttgtgtatatatgatggtgctgtggtcattcttctcgggggtttttgttgttgtttattacaacgccaggggttaggggagctgctcctagtttgcaccactaataccactatgaccactgaaatattttgcactgcttcgacagacgtttcattgctccttgaccactccgcttttgaacacgatgaaaaagttgccgcccctctaaccttcaagcattattactcttttaagagaggtgataccaatgtctttgaattattttttctaacccaatgtattcaggttacaaaaatttgtcttttttggcaaagaaacgatttactcacttttttgttctattatatatactttttcaatttttaacccgatttcagggcaaaacctttttttctggcgcgacataaca

SEQ ID NO: 543963 - DNA, 1000 bp, Homo sapiens
  misc_feature (329)..(329): n is a, c, g, or t
  misc_feature (428)..(428): n is a, c, g, or t
  misc_feature (520)..(520): n is a, c, g, or t
acatttctttttctcccgggcgggggcgaccaccctgttctcgctcatcatgggtggtgctgtgggaacacaccggactgtggtcccctatctctggagcgcccccctcgcgcccccccctttcccacggagagtgccgtctgctctcgtctgtgcccccgcagagctcctcgtgtggagacccccgtggttgttttacgacgcccgcaggcgcgcctctataaagggggagagagatatgtcccccgcctctcgttcaggcgggcaccctcttgtaggagccctcgccggcaaacgatcttgggcgtgatagacgcgttgcttttgtntctaggcaccgaccgtcttgttgtctgacacacacgtctcgcggagaaagtgtgctccttcccggcaccaccccgcgcgccccgcaaatggacgtcccncagttattctcccctcgttctcgatagggcgaccgcgagtagacatccgtcggcaggccccgccgcgagtgctcttttctggacgctctcgngagagtacaataatattccgccgccccccgcgggggagtgtacgaacacatcactctcgctgggtggcctgcgcgagaggaaactcttcgcggggggaggccccccctcggaggagacaccgctgttttctagcggtcccagggtcgttcccacccctctgtgtggggccgacaaatctgcagtgagccctggcgtcttccccccctggccgccagaggaccctcttttgtcgagggcgaccctctcaccacgcactggggccccgctgggacctcttctcgcgagttacccaccaccggggagctgagagtacctcgggggacccgctgtgtgaagcccccccccgcgtggtattccctcccccggggcgcccttccccagggccccccaccgggcgccccccgggtttttttgaaaaaatttttgggaaaaagtgggggtttttacgcggaaattaaaaatttttgtttttttcccca

SEQ ID NO: 543964 - DNA, 1767 bp, Homo sapiens
  misc_feature (318)..(318): n is a, c, g, or t
  misc_feature (1088)..(1088): n is a, c, g, or t
atgtggtagttgtgtgttaatcgtatagctgtgtgtgtttgtgagtgtgctgcgtgattgctatgctcggtgtgttcgtggtgtcgtgtgttcagtgtgcatggtgatagtgattgcgtgatcttagttgtattaggtgtggtagttggattatgttgttctcgttagctctatgctgtgtaagattcgtgctgagagtccgtggattacgatggtgttagtagtgcttgcttggtgtgtgtattcgtgtgtgtagtttgttgtgccgtctgtggggtcagctgccgtcgacctacgctgtagtgattgactctctcngggacccactttgataatagatccatatcccgccctgttacggggtatgtcagatagccacacgaacgaatccgaatttttaatggggtgaacaccgctgaatttatgggatgtcttccgtaatgatggtgtacccacaccacaggtggttgtggtgaccacaaatgaaagcccatggcccttgggttttaaaaatcgtgcccggcctccacgggggagacgctaagtgagcggggtgtcccgataaaagtggttatccccgaggggcccctgtgggggtcgccccaaatatttccgcggcacaccggaagggggaaatgcccaaattgggccaacaatacctttctatccagggggagccacaaaattggggctaacacacaatgcgcgcctccgctcgcaataataatcccccgccggggggggccccaacaaggaaaggaagataaggcgctcgcttgtatgtcgcgcatccacagaagtatctccgcgcaaagagttatatgtgacactttttatggggggaccgcgcctccacaacaaagctgggtccccaacaatacaacgccacaacaagaaatgttgggggccccccgccccgccctcgcgccaaatgtcagcagcacaacacccacagctgtccccgctggttgtcccgcgcgggtaatgcgttataactcaccacagggaatatacccccctgggcccccctctgagaggtgtttggacaacactctgggggggaaatatatgtgctccccctctgaggngcttcacacagaaattgtttgtgtgaaacttcggtgataaaaccacacagggatttcactctcagagtatgtgttgtgtcctgacacacactatggcactatcctctaaaatatacacgagagtttctggtgttcgtggaccccacacagagaccccctctggtggaaagagattttggcactgtctggtcgttcacttcggacacacgcacacacacctgtgaacccgacacacatgtggtgacacgagaggtccccacactattgtgggccctctgtcacccttcggggcccgccacaagaaaaggggaaagacacaaagtctgaatctctcctcgagggaaagaaagaagagattgttataacccacaaaatactgatatttataaaaaaatttcacgagaagaaaatatatgaatgaaaaggagaaaaagaaaggcccaaaatcaccacgtctcctggaaggagccaagttccacgcacagggcaaagctttttgcgtgcactcgcttcaaaggccgggacccagtgtggccgaagcacagaatggctaatgtgctaagaagggccaaaagagttggaattctatcttaggaaaatcaaggccccccaaggccaaataaatcccttgttttgtcttcaccccagtgaataaaggtgtttaatgttttggtcccca

SEQ ID NO: 543965 - DNA, 115 bp, Homo sapiens
gggcgcgaaagacctaggtgcgcgacgacgggtcggccgtcatctgggtgacttttaaacatgacggctccactcgatcgtccccgtgcgagacagggatgcgtgagtaccgagc

SEQ ID NO: 543966 - DNA, 769 bp, Homo sapiens
  misc_feature (319)..(319): n is a, c, g, or t
  misc_feature (388)..(388): n is a, c, g, or t
  misc_feature (620)..(620): n is a, c, g, or t
catgggctgggactgggagcgggggaccgtggggatgggcgaaagggggatgggttggggatgtgtttagaaaggagattcgatgtgaagggtgaatctgggttgaacttctggggtgggtgatggggcatttactgggatgggggaggctggaagaaggacagaaagaggggtcgggggtggagggagaaatactaaacttagcttggagaccttttggcactaaggagagctatatctagaagtggcttatgtgaactcaactaagggccacctccaacaagtttggtggcgagaacatgggattcagaactgcganagcaaaacaggccaagctggggatttggaaccccatggtagtcccaactcccaaggggctctgtgcccnttaacccaatggtggccataaccaactctcccaataatccaaccagagcaacaattcatagggtcctaaccaatggttttggtaggacaacccctcccatttatggtgcatggggtttgggattctggattaaaccccatccataaggttgggaacaatatggatcccataaggttggcaaaatatgtatccttaagtgccaaacatggatcttcatcattaacttaaactnaaccaaacatccatcagcttaaacctaagcctggcctttaaacatgggcccggaacactttacctttaaccttaacggggggcattaacccagaccacctctcttgggctccaggtcctacacacattgggctccacctccccttttgg

SEQ ID NO: 543967 - DNA, 269 bp, Homo sapiens
ccgcccggtgttgcgctcctgaagtgctgggattacaggggtgagccatcatgcctggacctgatcacttgatttttaatttttaaaaataaataaaaccttattttctgtaaaagccctgtcctgttggcacctgtgggtctaaacaaccacatactatccatggataggtctagacataacactttaaacagaatgtcaaagcatgagggaggcaagccgcctcttctcggccatcaactgccgatgatgaaagagcgcaacaccgg

SEQ ID NO: 543968 - DNA, 1405 bp, Homo sapiens
gccaactgggacgacatggcgagagatctgggtcaccacactcttctacaacgagctgcgctgtggccaccggaggagcacccagttgcttgctgatcccggaggctcacctcctgaacccctaatggccaagcagagtagaagattgactctagagttactgtgttgatgacgctttcaacacacccggggcactgtactgatggccaatcacaggaccgtgcatggtctcctctatctgcctcatgggcgctagccagcattggctacttgatctattggagctcttggagacaggggtcgaccctactaacgggtgcccatcttacgagggctacgctcgcgtcctcccaaggtccactccttgtcgttcttggaactcttggctaggctcgggggcacctgtacccagatatgacctgtccatggaagcatccatccactgaaggcagatggactcaaagacttttaccaactctaacggatcgggcaagcgggaccactcaggtagccgcgggacgattcaaaggcaggcaagtctggtagcattactgttccagacctcttggggacctttccggaagctaagggcaggatggggcgcgagctcgtccatgagatcccctcccatcttctccatcttgggaatgaaaggaagacttagcgatgctgggcccgcaatgggccctagtggtcaattcacacacatagcgtcaaatgatggcgggattacccgagatgttacgcggcggagggcacgccgtggtctcccaaggcgctgtcgcctgtcccgtggagtcatgggacgatcctttgctggagaatttcccaaccgtcagtaacccaacccctgtacaaaccttcgcagatccaatgcaacaggtggtggacgcgttggggaacccaatccccggggaacaggcaactcctggttactggaccaaagcaaacggggtgtggcctgtgacacgcgggccggggacaacccaaccaaatggataaatcaccgggggacaatggcctgtgaccaaggtgaatgacaagaacagggacgcaatcagccggcccctgggcccgcccaagggacaccccactggacaagaattcccaccgcaacgcattccggcagcccccccagtaggcgccaaaggtaactccgcgagggtgggcaacgggggggggcaccaactcccagggggccctaacggtgccaacacatttcaagagcaacgaatggtgggaatttgacaagcgcaagggaacatacacgacgaaacggggggcccacccatcggagcccaaccgggaacaggcgtccataacaggggccctcgacgaaatgcgccaacacaccggcggacaggacgtacagcgcgcactagaacgaacagcccccgcgcagaat

SEQ ID NO: 543969 - DNA, 372 bp, Homo sapiens
  misc_feature (37)..(38): n is a, c, g, or t
cttggccctgcccctgtccccggggtgggtggggacnngccagacccccctccggggtcttgagcccgaactcccagagctcacccgcgggtgaccgggggccagcccaggagggcgggtggtttgtgcaagttcccttgccacgcggggccccggccccatcaagtccttttggggaggtcccggtcggaaccggaaaaaaccggtccagttaattgtgttaaagggggtctgtctcaagccttcggggcttccacgaagcccctccagcctctccaagtcgctgtgaattgaccccttctttcctttctctgttgtaaatacccctcacggaggaaatagttttgctaagaaataaaagtgactatttta

SEQ ID NO: 543970 - DNA, 324 bp, Homo sapiens
cgttggcgctgacgctggagggggcctgcctcggtcgccacagcttctccatgtaggtcaggctggtctcaaactacccaaaatacaggtcatactagaccgcctcggcctacccaaagtgctagggataacaggagtgagccaccgagcccggacgagcttactaatccaaaacttatgggaaactctgtgtaaaatatggtcaaacatgcccattttttcccaagggtcccacaagtcagacccttgaatgtgaggctcccaggaaggatctgatgaagcatcttattggaatagaggcaaagaatgtggtggtgaatacca

SEQ ID NO: 543971 - DNA, 312 bp, Homo sapiens
accgcggccagttgtcccagacactgcccggaatcgcatatcagcgtcatagcctggtcacagccctatccgaccatccccatcacagcataaatttgcatgaatcatggagtgtacaagcccaacaaaatctacggtctgactacccaaaacctcgtcagagacaacagcttatgtagcagagctgaagggttaggatccagctcgagtcaacgtccctgtcattggtggacatgctgggaagaccatcatccccctgatctctcagtgcacccccaaggtggactatccccaggaacagctgacagcact

SEQ ID NO: 543972 - DNA, 288 bp, Homo sapiens
gaggcgggtggatcgcataagctttggagtttgagaccagcctgagcaacatggtggatccctgtctctacaaaacataacaaaaaattagctgggactataggcacgtgccaccacctcaacgcccagctaattttttgtgtttttaatagagatgcagtttcaccatgttggccaggctggtgtcgaactcctgacctcaagtgatctgccttgcctgcctcggcctcccaaagtgctgggattacaggcatgagccactgcgcccagccaagactctgtctaaaa

SEQ ID NO: 543973 - DNA, 330 bp, Homo sapiens
tgctgggattacaggcatgagccaccacgccaggcaaatcatgggaaattagagtttgataaactgatgttatctggtaatactgtttggcccaagtgttttttgaaatctgaagtttgctgttgagtgggacattggaatggaacccatgtatccaggctttgatgctgttgtcctaagcagggctgggcctgattagtatgtgacgtcttctgtggtgctgtttggcccactattctttagagtctggggagtttggctttaaaatcaactgcatgaactgttacacaatttgttgtacctctggtccaccggcacagctgggcctat

SEQ ID NO: 543974 - DNA, 416 bp, Homo sapiens
  misc_feature (62)..(62): n is a, c, g, or t
tgaaagtgtacaaagaaggaagaagcagaatctgccatatgagtaatagaagtgagcaggcncaggactccttaagtcaagaaaccaagaggcgtcattacggaaaagagtaactcaccctgtgtgctccttggtagtttttcctaagtcatgcccccatgttataaatggggaatatttcgttgaagagttcatagtgaagtttctttttggatgacttcagctggtgggttttggataccttcaagggatcagcaaataatacccccagtcccctttggtaatgtcctcattactctagacataaggattatgctggccacaatagttaaatgtaggtggtgggtatttgcgttatattgtacatgattcctgttttgtaagcatgttcgcctttataataaagtcaataaata

SEQ ID NO: 543975 - DNA, 436 bp, Homo sapiens
  misc_feature (313)..(313): n is a, c, g, or t
  misc_feature (329)..(329): n is a, c, g, or t
ataaggcgttgctggcccatttttacgccgtagcgaactgggatatccccgacggttttctctgcccaccagtaccgggccgggcggattatattcatcaccttgccgatttactggcagaagcaagcggaacaattccagcgaatgccagcattctggatatcggcgttggtgcgaactgtatttatccgctgattggcgtacatgaatatggctggcgttttaccggtagtgaaaccagcagccaggcgttaagcagtgcgcaggcgattatcagttctaatccggggcttaaccgcgccattcgtctgcntcggcaaaagagagtngggcgatttttacggcatcatccataaaacgagcaatacgacgcgaccttgtgtacccgccattccacgattccgccgctgcgcacgggcaggtagtgagcgtaaac

SEQ ID NO: 543976 - DNA, 150 bp, Homo sapiens
aacattaccaataagtataggcgatagaaattgaaacctggcgcaatagatatagtaccgcaaggaaagatgaaaaattataaccaagcatattatagcagggcctaccccctatacctctgcatatgattactagaatactttgcaggg

SEQ ID NO: 543977 - DNA, 391 bp, Homo sapiens
cccgcttccgtgagactggcagtgcagctgaggtctggactgaatagaaaacatactgactgtctcacctgaggcactgttgcactggccaaggggacctgtggggagcagtgtttgttctgtctctcaaaatggcttgtgcatagtttctttgccataccctctctcccatttccggctttgttggtgtccttgtcagggcctggcttgaggttgggtgcctggttgggggtggcagagtggcaggcagaggtctagacacagcacccactcagcacacgcttcctcatccttcagcaggaatgctagacttttcatgcccacacctaaggcccccccatggaggaagctcctcccgagagctctggtccaagctcccagtcacggagag

SEQ ID NO: 543978 - DNA, 198 bp, Homo sapiens
  misc_feature (70)..(70): n is a, c, g, or t
  misc_feature (76)..(78): n is a, c, g, or t
  misc_feature (84)..(84): n is a, c, g, or t
  misc_feature (88)..(88): n is a, c, g, or t
  misc_feature (91)..(91): n is a, c, g, or t
  misc_feature (134)..(134): n is a, c, g, or t
gcgtgccatgtctgacgtcagtctgcgcctatcgttggtctgatccaggtgctgcttgtctggcttccanatcatnnncatttncctnggnctgcgtctctacatagcgctccagggtggccaggttctcaggnttgtacctgtcgatacccttgagcaacttgaccacgttggctctcatctccgacgagggcgaat

SEQ ID NO: 543979 - DNA, 119 bp, Homo sapiens
agtgcaagatttctcatgaggctgagacaggtgcattgcttgagcccaagaattgagaccagccgggccaagacggtgacacctcatctttagaaaaaaatacaaaaagtggtctccac

SEQ ID NO: 543980 - DNA, 197 bp, Homo sapiens
  misc_feature (69)..(69): n is a, c, g, or t
  misc_feature (75)..(77): n is a, c, g, or t
  misc_feature (83)..(83): n is a, c, g, or t
  misc_feature (87)..(87): n is a, c, g, or t
  misc_feature (90)..(90): n is a, c, g, or t
  misc_feature (133)..(133): n is a, c, g, or t
taaccacagctatgatcagagcgatggctatgaccgggacatctccaggacacccagattgccttccanatcatnnncatttncctnggnctgcgtctctacatagcgctccagggtggccaggttctcaggnttgtacctgtcgatacccttgagcaacttgaccacgttggctctcatctccgacgagggcgaat

SEQ ID NO: 543981 - DNA, 534 bp, Homo sapiens
taacatctcatttctttgtggtcagaatatttaatacatgtcttctgactatttggtaatatacaataccttagtactaaccagtcaccttactgtgcaatataatatcagatctcatttcccctatcttattgtaactttgtacccactgatcaacctctcaccattctcccttccttgtccccctatccccagtctctggtaaccactgttttctctacctctatgatattaactttttattttagattcaacatgagtgatattatgtggtatttgtctttctgtgtctggcttatttcacttaacattacgtcctccaggttcacccacgttgtcataaatgatagaatttcattctttttcaaggctgagtattattccattgcttatatatgcaacattttctttactcattcattctttgttggacatttaggttgattccatatgttggctattacaaatagtgctgaaataaacatggcagtgtacatagttacaataagataggagaaatgagatgttggcagg

SEQ ID NO: 543982 - DNA, 163 bp, Homo sapiens
gatgaagatactgccatccactaaattatattagaggaagacaacataattttctggaactagtcctgtattgccttcataagttgcctttgaccatcctggttccacatgatgggtacacatttagaaaactattgctccttgtgggaatggaacagctgtg

SEQ ID NO: 543983 - DNA, 277 bp, Homo sapiens
ctgccaattttagtttttatctttgtgctgtatttaattgtatcatcacaggccacattaaatcatttctggaagatcagttttaaataaatagatgaataaaaaaatagcagttaaaaaaagggagagaaaagatttaagaacatttctaaaagtaaccccaaaatttcttcagggggataaaaagtgggatgatttgggaggtcgaggtgagaggattagctgagaccaggagtttgagaccagcttggacaagacggcaagatcctgtctctac

SEQ ID NO: 543984 - DNA, 238 bp, Homo sapiens
atgatcagcatgaacgattaatgagagacacgaggagaaaactgacatgatcaggatggaccgactactacattcacggacgatggcgcatgctgggggcaggactttgctaaggtaattagtgctttctaggaacatatgacctaagtgcactgatccaacatacagagtggagtacgaatatcagcagagagacaaaagcagtcagtgtatgatacaatctatactataatgtcta

SEQ ID NO: 543985 - DNA, 448 bp, Homo sapiens
  misc_feature (166)..(166): n is a, c, g, or t
catatctccatagtaatcctgcatcttatgctattaaaaggtccagaatacagacatctactttgacaatgactgggtagatgagaagtggttttaatatccttgatatattcaaatctggttcattattggtaggtgcagccacctggtataactgaaatgtgtnataggaccagtcagtggaatcagaggctgaacagaccttagggctgggtcaaaagtggtgatctgaatgtacctgctctctgtatgaacctttgactaagttctccaggggcagggtgcaccagaggccccagtaaatatggttcatccaccgtaataaagaagaaaatgaaagtagggccaaaaattcctgatgttaaccaattaaagcgccaagtgaataaaggtccggacctccagggtgactgtggaataaaaaactcctgcagtgacataaaaaaaa

SEQ ID NO: 543986 - DNA, 134 bp, Homo sapiens
ttcggccggggcatccatcaaacttgtcctagagcgagtttttttccaagaatagtaatattttacaaggcttgcaatgtcttatctggaagcttaaaaaaaatcatgttaatatcagcaagtttaattcataa

SEQ ID NO: 543987 - DNA, 464 bp, Homo sapiens
cgaaggccagtttctaatcatcagacggatgtaaattagaaccaggaaagagataccatctcacaccagtcagaacagcttttgttaaaatgtcaaaaaatgagaaacgtgggtgaggctgcagaggaaagcagacacttgtacactgttggtgaaggtgtaaattaatttagcgtaggcacagtcagttgggagatttctcagagaactaagagtggaactaccattagacccagcaatctgatggctggatatacggccaaaggaaaataaatcattctgccaaaagaacatatgtacctgtatgttcatggtggcaccattcacaatagcaaaaacattgaatcaactcatgtgcccatcagtggcggactagaaaagaaaagaaaatatggtacatagccatcatggaatactatgcacccattaaaaataatgaaataatgtctttgcaacaacatgaa

SEQ ID NO: 543988 - DNA, 2764 bp, Homo sapiens
gtcgccgcgcggccgccggtgagccgcatggagccccgggcggcggacggctgcttcctgggcgacgtgggtttctgggtggagcggacccctgtgcacgaggcagcccagcggggtgagagcctgcagctgcaacagctgatcgagagcggcgcctgcgtgaaccaggtcaccgtggactccatcacgcccctgcacgcagccagtctgcagggccaggcgcggtgtgtgcagctgctgctggcggctggggcccaggtggatgctcgcaacatcgacggcagcaccccgctctgcgatgcctgcgcctcgggcagcatcgagtgtgtgaagctctcgctgtcctacggggccaaggtcaaccctcccctgtacacagcgtcccccctgcacgaggcctgcatgagcgggagttccgaatgtgtgaggcttcttattgacgtcggggccaatctggaagcgcacgattgccattttgggacccctctgcacgttgcctgtgcccgggagcatctggactgtgtcaaagtgctgctcaatgcaggggccaacgtgaatgcggcaaagcttcatgagactgcccttcaccacgcggccaaggtcaagaatgttgacctcatcgagatgcttatcgagtttggcggcaacatctacgcccgggacaaccgcgggaagaagccgtctgactacacgtggagcagcagcgctcccgccaagtgcttcgagtactacgaaaagacacctctgactctgtcacagctctgcagggtgaacttgaggaaggccactggcgtccgagggctggagaagattgccaagttaaacatcccgccccggctcattgattacctctcctacaactgaattgcaggtggggtccggaccgtgactgcccccgttgtgcccagcattgcccgggtgagggctctgcctgttcctctgaagcagcgtgattgctgtagatagaacaacgctccttcgagtcccttcctgcgatcctgtttaggcttctctcctggatcctggataatgtttccagggtgttgggaaggcctgcgtctcaggtcacagttgtgggtgtggccctgcgctgttctacagaacctaccctctcaatgggcatgggcccaaccatccagttttcctcttttacggaccatcctcaaaggcactctcaggacagacggcgtggggagcacagaggaggctggcagagctggggactgagggcattgttgctgattctcactcaccggggcagcctgccgcagatgcacaggccccaggtgcaggccaccacctccgggtcggcaccaggactgccctcggtgctcatagggaatggctgggcccacggaaggtcggcctgggatgtggcctgggactgctgctctgctggctgctgtgtggatgcttttcctggagcactttccaaggcatcccccagccccaagcctgcacgcatctgtcactcagggactttctatgggtctttgtgggggaaggccctggctttgtattccccacaagtagcactgagtttcttaggaaatttgtcttcagtattaggtctccaactcttgtaaaaagtttatatgtaggataaaaaccttttagaggacacgtaggcggtaccactaaggttttggtaatgagccattcaaaccgacagcagtgtgaaggtgtgtcaaggtgtatattctcgtggctcggcattctcagtgcaaaggcctgtttggagactctgtgggaattgtttttcatctgtttctatggttgtcaaatgaattcttcacccaccctacagtttgctaactccttgaagctatcaaattagtaagagaggctgcccgcacccagggggcaccatcgcccacttattatttagttttgcggatactcatggaccatctatcacatccagcattgtcccagtgctttgagttggacgggaatgggactctgcagccaaggcaggataagaaaatcttgcaatcccgtcctgcagtgatagaaacaggtcgttctgcattataagccataggtggagcattcggtagcgtattcagactgcatgggccggcctaggagtctttgccttcataaattttaagaaccccgcccacaacagggagttaaactggaggactttgcatgattagttcagggatgagtggtttctggggcatctgaggtcaggagttcgaaaccagcctggccaacttgatgaaaccccatctctacccgttctggagaacaggtcacgcctgtcctggagacagtgtgccgggaaaagggaacgtggtactcactggatgcacccaggccggcccgagcctcccaccgcagacagtgtggaacagagtgagcctgagctgcccaaggcgatgccctttgtgctgtatgactggaggcctctccgcgtgggtacttgggggtggggccacaaatctggcgaaaaactacatgctggccgccgtgaggttttactccagcgttcccgccattgtcatggcgggtcttcgtcctaaactgagaagaaaagcattcctgtttgatcaccgccttagttaccagttctggatcagtcagtgtttctgcatggaataacaaccattaaaaaaagcactgggttctgccctttcatctttgtaagagattcttgcctctagcaatgacaacctgtgatgtctcacagtagagcacttagtgcagaatcaggtccccacggctgttgctcaataaaagtggcggaataaagtgc

SEQ ID NO: 543989 - DNA, 403 bp, Homo sapiens
ttgattcttcagctgtggcctctggtactcccttagaggctttcctagctggtcaggatgccccgtgctgccagggaccctcaagcccctcaagcctcactgatctggtgacactttgaagcacctcatcttcccccagacaacatcttaggactcttctagccagacacatgctatcctgcaagtgagcctagcagtggcagatgacgtcagctctgggccagcccctgaaggaggcagatcaaattgtccagaccccagaggtagccgtcctcacggttgccctctgtccaaggcagcctgtgactgagcatctggtggtcaggcagggccactgtcttgccgaagtcaatcatccagaccttggccaggcagtgtggtcatcacaaagagaagggaactg

SEQ ID NO: 543990 - DNA, 2845 bp, Homo sapiens
gtcgccgcgcggccgccggtgagccgcatggagccccgggcggcggacggctgcttcctgggcgacgtgggtttctgggtggagcggacccctgtgcacgaggcagcccagcggggtgagagcctgcagctgcaacagctgatcgagagcggcgcctgcgtgaaccaggtcaccgtggactccatcacgcccctgcacgcagccagtctgcagggccaggcgcggtgtgtgcagctgctgctggcggctggggcccaggtggatgctcgcaacatcgacggcagcaccccgctctgcgatgcctgcgcctcgggcagcatcgagtgtgtgaagctctcgctgtcctacggggccaaggtcaaccctcccctgtacacagcgtcccccctgcacgaggcctgcatgagcgggagttccgaatgtgtgaggcttcttattgacgtcggggccaatctggaagcgcacgattgccattttgggacccctctgcacgttgcctgtgcccgggagcatctggactgtgtcaaagtgctgctcaatgcagcttgatgaatgtctgctcttatcgtgagaaagttgaggagtgcagagcttactctcttctctgaattgcctactgttttgggggccaacgtgaatgcggcaaagcttcatgagactgcccttcaccacgcggccaaggtcaagaatgttgacctcatcgagatgcttatcgagtttggcggcaacatctacgcccgggacaaccgcgggaagaagccgtctgactacacgtggagcagcagcgctcccgccaagtgcttcgagtactacgaaaagacacctctgactctgtcacagctctgcagggtgaacttgaggaaggccactggcgtccgagggctggagaagattgccaagttaaacatcccgccccggctcattgattacctctcctacaactgaattgcaggtggggtccggaccgtgactgcccccgttgtgcccagcattgcccgggtgagggctctgcctgttcctctgaagcagcgtgattgctgtagatagaacaacgctccttcgagtcccttcctgcgatcctgtttaggcttctctcctggatcctggataatgtttccagggtgttgggaaggcctgcgtctcaggtcacagttgtgggtgtggccctgcgctgttctacagaacctaccctctcaatgggcatgggcccaaccatccagttttcctcttttacggaccatcctcaaaggcactctcaggacagacggcgtggggagcacagaggaggctggcagagctggggactgagggcattgttgctgattctcactcaccggggcagcctgccgcagatgcacaggccccaggtgcaggccaccacctccgggtcggcaccaggactgccctcggtgctcatagggaatggctgggcccacggaaggtcggcctgggatgtggcctgggactgctgctctgctggctgctgtgtggatgcttttcctggagcactttccaaggcatcccccagccccaagcctgcacgcatctgtcactcagggactttctatgggtctttgtgggggaaggccctggctttgtattccccacaagtagcactgagtttcttaggaaatttgtcttcagtattaggtctccaactcttgtaaaaagtttatatgtaggataaaaaccttttagaggacacgtaggcggtaccactaaggttttggtaatgagccattcaaaccgacagcagtgtgaaggtgtgtcaaggtgtatattctcgtggctcggcattctcagtgcaaaggcctgtttggagactctgtgggaattgtttttcatctgtttctatggttgtcaaatgaattcttcacccaccctacagtttgctaactccttgaagctatcaaattagtaagagaggctgcccgcacccagggggcaccatcgcccacttattatttagttttgcggatactcatggaccatctatcacatccagcattgtcccagtgctttgagttggacgggaatgggactctgcagccaaggcaggataagaaaatcttgcaatcccgtcctgcagtgatagaaacaggtcgttctgcattataagccataggtggagcattcggtagcgtattcagactgcatgggccggcctaggagtctttgccttcataaattttaagaaccccgcccacaacagggagttaaactggaggactttgcatgattagttcagggatgagtggtttctggggcatctgaggtcaggagttcgaaaccagcctggccaacttgatgaaaccccatctctacccgttctggagaacaggtcacgcctgtcctggagacagtgtgccgggaaaagggaacgtggtactcactggatgcacccaggccggcccgagcctcccaccgcagacagtgtggaacagagtgagcctgagctgcccaaggcgatgccctttgtgctgtatgactggaggcctctccgcgtgggtacttgggggtggggccacaaatctggcgaaaaactacatgctggccgccgtgaggttttactccagcgttcccgccattgtcatggcgggtcttcgtcctaaactgagaagaaaagcattcctgtttgatcaccgccttagttaccagttctggatcagtcagtgtttctgcatggaataacaaccattaaaaaaagcactgggttctgccctttcatctttgtaagagattcttgcctctagcaatgacaacctgtgatgtctcacagtagagcacttagtgcagaatcaggtccccacggctgttgctcaataaaagtggcggaataaagtgc

SEQ ID NO: 543991 - DNA, 499 bp, Homo sapiens
  misc_feature (288)..(288): n is a, c, g, or t
  misc_feature (305)..(305): n is a, c, g, or t
  misc_feature (329)..(329): n is a, c, g, or t
  misc_feature (332)..(332): n is a, c, g, or t
  misc_feature (338)..(338): n is a, c, g, or t
  misc_feature (344)..(344): n is a, c, g, or t
  misc_feature (351)..(352): n is a, c, g, or t
tccagagcacaggaaatgtgcaagcattctctacccagtctggcatgaacctcgagtggtcccagaagtgctttaggacaacaactgggactacaccagatctgccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggcgccccgtgactgtgaccgagggagganggctgcctgatcctctnctgctgcctctggagactcagagnttnagctantgggcnaggaagnnaaagcttactttgtagacctgacactaaactacccgaaggacttaggtgctttgtgtacttaaccccaggacctccttactttttaatataaagagtgatgttgtatttcgtgttctgcactttttaatataaagagtgatgttgta

SEQ ID NO: 543992 - DNA, 303 bp, Homo sapiens
agcgggttctctcagcactcagcacagattgctagtgcttttatgtgctgagcctttcccttcaacctggactgaaagaggactggcaagtctcgctgaacgctgtttctttttcttcagcaacatactaggaaacgtgttggccccgtttatttggaggggggccattaaacgaaaaatttggaattgagggacaaatggctccaatatgtggattcagttcatatgtatttacaatccatgtatctgaagaattggtatgagaaagaaaatacagtatataagaattagtgttactttata

SEQ ID NO: 543993 - DNA, 135 bp, Homo sapiens
ttcacgtatctgtgagttgaatgcatcatcacagagaatttcttaggttctgtctagattttatgcgaagatatacccgtttcgaacgaaggccacagagtggtccaaatatccacttgcagatcctacaaaaag

SEQ ID NO: 543994 - DNA, 159 bp, Homo sapiens
ggaagggggggctttgggcccccccttccccctttttttttccccccctttaaagggtttgggggtttttgttttcctggggggggggggggggggccgggggtttcctttttcttttttttgggcccgtttttttaaaggggcccccttttaaattta

SEQ ID NO: 543995 - DNA, 150 bp, Homo sapiens
gaaatgtcaggatgcccaggtgaggatgagcaggagatggtgtcagtgaagcgtccacctagaggagccttaggaagaggatcaaggagaaggcttcttgtcagaaatggataatgaacctcctgtgagcgagggtgatgatggcttcgc

SEQ ID NO: 543996 - DNA, 368 bp, Homo sapiens
tattaagtatgaagtggcatcactaatagcctttcattattatccctgacattctttggcgtataatcatagccttatgtttgtctgtcttaaacaaatgatctaacgcatgaatcatttccttgctctactgaccctctggggagtgctccattctcctgctaggatttggactgcttaccacacagcctgctgtacacctgtcaccttgagtcagagtaattctcattgctttcctgaacctctggttctcgtgaacccaaataaataaacatttctggccaggcgcggtggctcatatctgtaatcccagcactttgggaggccagggcaggtgaatcacttgccttgagagtgtagaaattgaa

SEQ ID NO: 543997 - DNA, 394 bp, Homo sapiens
tgacccactcatctttcatatttgctgtacaatctaatacttgcagccatgcagaaccgttcaatgttattatggtcctttgagctggtgacacactgtagtgcatcagagctgcctctcagctgctccggtcacctacactgaatatgactgactgaatgaaatgacgagttacttcccaggatgaaaatgacactgtggatcaaatgcattgcccaaattgtatctgatcctcctccactaaggtttgaaaagaccctattaaagataccttccatgtgggcacgaggttggacaccaatcaactagcctcttttgcctaatatccttggcaaatataaatttgttaacaacaggtctgaatgacatgacactgggtgggtcagaacataag

SEQ ID NO: 543998 - DNA, 194 bp, Homo sapiens
  misc_feature (57)..(57): n is a, c, g, or t
  misc_feature (117)..(117): n is a, c, g, or t
  misc_feature (127)..(127): n is a, c, g, or t
  misc_feature (162)..(162): n is a, c, g, or t
  misc_feature (172)..(172): n is a, c, g, or t
gaagatgcgcgctctttttccgggctggggtctgcgcggcctggaggctggcggccnttgcagatcgctgtggagaatggcttcgggggtgtgcacagccagaagaaggccaagtgnctggggggtncagtggaggattacttcatgcgcaatgctgacttngagctagatnaggtggaagacttccttggaga

SEQ ID NO: 543999 - DNA, 143 bp, Homo sapiens
gttctagaggccacggacacgaaaagcgtatcgcttgtcaggccacaggagggggcaagtggaggaggagaggtggcggtgctccccactccactgccagtcgtcactggctctcccttcccttcatcctcgttccctatctg

SEQ ID NO: 544000 - DNA, 181 bp, Homo sapiens
cagggcaccaggcaggatcctagggcgcctcatagtatgcgttagcatgtggtttgctgtatgaccttgcacaagtcacttccttctgagcctcaattttatcatcggtacaatgagattcacaagctgtcctgaaagtcaagtgtgaaaataaaatagagattaaacaagataattatga

SEQ ID NO: 544001 - DNA, 1522 bp, Homo sapiens
  misc_feature (610)..(610): n is a, c, g, or t
tcccctcttgttgcctcagttcgccctggttccttggagggctcctctttttcttctatacctccatgggtctcctcaattttatttggggggagaaatatacctttgagcaagaatatacaatggggaaaaagaggtctcataccccttttcgtgttcagagagttctctatttttactcccttctccgtgtgtctgtgaacacaaaaacagctgtgtgtgtgtggacacacctcaacacaccacacgcgagaggacctctgtgtgtgggcaaaaaaaagaggaaaacacacgctgtggctctcccctttctgccgcctctcgtggctgtgagaaacgctgtgagagagcggggtcgctataagcgcgccccctgtgtgtggtctaggtattagcgcgtcgccatataaaaaaatttctctattaaggccttttattttctccctctctctttctctctctgtggagtataatatgttgtgggcgctctcacaaaaagaagtatcaacacacctgtcgtggtgtcctctctctatatgtggtgtgcaaaatattatttttggcgggaaccaccccagtgggttttacaccctatttttttaccccaaanctatgtgtgtattctcgtgtgtctataacattttctctctctgcttgtggtgttttattacaaaacacacaaagagaaaaaaaacaaacaactcttttataaacacagagtgggggcggtattatcagagaagaggggtctctagcccaagagcgcgtgggggggttttgtgagagacagtgtctttggggggggtgggggttacacagtgtggggggcctttttgttgtgcgacgccacacccagtgtggggctcttatctcatcaccttttttggtggcggcccagtcgttgtcgtctacaaaccaccgtcggggcgcggcaacactcatctttcctgggggacgcccaagaggaaaataattcttccccccttgttttttgcgccacgacgctttctaaacacacgggattggttggcaaccccccctcttttttttctacaacacaatctatacaaaaattttttctctctttacgacgataataatcgtcggcaatattaggacaccttttttttggaaggcgccccccttgttggtcccaccacactcttccccacagtcgtggcgggccgagagaacacactctcctcatgggggaagaaaacacccctgttggtattacgggaaaaccctccttataagcattgtgggggcgcgcaccaactttttgtggaggcactattctcctcctcattaaagtgtggcgggcacacacatttgatgggtggactaccccaccttggtgatatcaataatcaattcctcctgttaccaacacaacatcttctcttactcacccatttattatatagggaggcatgatccccaccacccttgtgtgtgacaccaacggcggcggcagaaccacgaacttcattggtaatcgtgtcgcgctcccacaccaggg

SEQ ID NO: 544002 - DNA, 228 bp, Homo sapiens
tgatgttaaagactttactttgaaatttgatggaaaaatttttccgggccccatggaaaaaacttgatccccaagtgaaaacattttaacccaaaagctttaacgtttgtcagttaacctgaaactgaaattttgggaacatgaaattctttagggccaaaaggaatgggtaattagtattcctttcctttttccttacccttttttttaaaaaaattcacaccaacc

SEQ ID NO: 544003 - DNA, 1173 bp, Homo sapiens
  misc_feature (386)..(386): n is a, c, g, or t
ggtccctgtgtaggatggaggatgtctgcgagcagcatttgaaattctgggagggcgttggttgtctagcaagcaagactaggaggaggcagaagcactagcatcgtcgggaccagactctgtcatcatggccatgttgcatgtccttctacagccgaaaacgccgagccacagggaaaagtcagcctagctatgagaacttgcaggtgactttgcgtggtatgcactcctacgcgcagtcgatccgtggtgccgagtacctatgtataaaggcaggctggaattcttaggaaagtgtgctgaggaataacgcatgtttatatcgaaccgagatatatcgctcaagatgtctagttggacccgaacgagtagggaccttaggaagngcctcgtagaagcgccgaatcgtgccacgaaagccacgcatattcatgcccatagtcgcgccaacaagcaaaagttgcctagtgggtctcggtccttgcaagaggataaacccatattgggaacttttgtgcatacactaacggaaggatccccttttctctaaaagcgtcaaaaggttctactatagccgaagacagggaccccattggtaatctccacccgaagttgtggcattcgcaatttaatgggggtaatgcgcattgggacatacgcaatttgggaattggctatgggaatcgccaacttggttttggagggtaagccaaggtctccaaggtgcaaccatttcctctaacttctggaaaatcctgcggggaaaaaacgggcagtacaattcccgttggtacactggggaacctgggattaggggaactttggaatctcagaaaccttgtacaactgggcaggtttattactttacacaatggcgcaagggatttccctgaggaaatcttggaagaggtttccctttccagagccccaaggttataccggttgggacacttgtaggacacacatttcggatgaggaactttgggaccaatacctgtggcggagttgacgaaccttgggggacactgggatcatttagtcacacaggcgcagaccggcggaggggaaatcaccacccgttaggggtcccacgcgatgaggcgaatataacgccccttggcacacaaagcggtttttctatgtaccaagaaccatataaaccggacgtaaatg

SEQ ID NO: 544004 - DNA, 264 bp, Homo sapiens
gttaaactggggggctgtgtggacacagcgggatcaggaggactacgagtcggctgcggtcactcgtccgacccgcaaacagacgtctttctggatctgcttctctctggtgagcccgggctccttcgagaatgttcgtgccaagaggtacccggaggtgcggcaccactgcccccacacgcccatcctcctggtgggcaccaagctggacctccgcgacgagcacgacgaggaattccggcagacgacgacgaattcaccacg

SEQ ID NO: 544005 - DNA, 184 bp, Homo sapiens
ccaaaaaaaaaaacccccccaaaggggggggtggggttttttttaagggcccccccccccccccccccaaggccccctttttttgaccccctgggggggggcccgggggggggggcccctttccccttttttttttggggctttgggggttttaaaaaaaaaaaagggccccttgggggcccca

SEQ ID NO: 544006 - DNA, 994 bp, Homo sapiens
  misc_feature (193)..(193): n is a, c, g, or t
  misc_feature (210)..(210): n is a, c, g, or t
  misc_feature (218)..(218): n is a, c, g, or t
  misc_feature (251)..(251): n is a, c, g, or t
  misc_feature (253)..(253): n is a, c, g, or t
  misc_feature (256)..(258): n is a, c, g, or t
  misc_feature (261)..(262): n is a, c, g, or t
  misc_feature (268)..(268): n is a, c, g, or t
  misc_feature (282)..(282): n is a, c, g, or t
  misc_feature (311)..(312): n is a, c, g, or t
  misc_feature (330)..(330): n is a, c, g, or t
  misc_feature (381)..(381): n is a, c, g, or t
  misc_feature (399)..(399): n is a, c, g, or t
  misc_feature (403)..(403): n is a, c, g, or t
  misc_feature (411)..(411): n is a, c, g, or t
  misc_feature (486)..(486): n is a, c, g, or t
  misc_feature (562)..(562): n is a, c, g, or t
tgctgatctatatcattggtacgacagaacttagcacaaatgcctgtgctcacaacacggatgggaggatcatcacggctcagggcacacatgcatttccttagaaacaggcagacaaagagagcataaataccacacaacagccaggctcagggggctgcgggccacagagggctgcgcttcaaaggcagtnagaggcattaaatacgngacctacncaatacactccacttcaccatacataatttatntnttnnnagnnaggggnccacagtatctatncgtgcaagcggctgtggtggagaaaatanncgggggggcagccatgcncggagggtgctccctgtataccctcccgacgcctcgtccccacccttcccncagagtcacttgggatgncaanacgcatgngccggccggggcgcactcgggaggtcctgcctggtctcctcggcatggacctctgagctccccgtgagccgggangtgcctggaaccaagaacacttgaaccctgcatgtcaccacatccctgggagttgccctggaagggaccgggccangcgtgaggggaggaatgtcgcgcttcgtcacgtggaggagcggagcgcagcaccgcgccgggcaggtgcaacgcatgccccagcccggggcccgggagagcaggaacgattgcggggcatccactcttgcagcaagcttagacggcgcgaccagccctgtgttctctgcagctgtccccggccgcttcgctaggaactgaattgacctgcaagttgtcgcctttcccaggcggaccacaggaggggttccttgactctcgtgatttcgcggccactgcgccatatgggttatgctccctggagctcgtgtgcctccgggggagcccctgtgtgtcccctcgaccttgtagttctcggttgcctggtgcgagtaactctgtgcttggcgcccttttaacggaagaggctcctcctctgtggatgacgtggtac

SEQ ID NO: 544007 - DNA, 158 bp, Homo sapiens
tgctgatctatatcattggtacgacagaacttagcacaaatgcctgtgctcacaacacggatgggaggatcatcacggctcagggcacacatgcatttgtgtctggtctgtcctccctgttgattggtctggcatttccggtattaaaatgataaaat

SEQ ID NO: 544008 - DNA, 423 bp, Homo sapiens
tgatagcattcagcacataaatacatcaaaaccacatgatgagctgaaactgcccagtgtgcccatcccgtggagtcctatgccaacagcagctcaaacatccactaataggaattcggaaacagtggcacgaagatattaatcaggatcttcgaactcatcttgtacaccaaactacgtacaagccatattacctacgccggatcctgctgctttaaaagacagacggatggaaaacctagtatgcatatgctcggaaagttgacggggacatgtaatgaatctgcaaacaatcgagcggaatactaccaccttctagctgagaaactctctaagatccagaaagaactagaagaaaaacgaaggaccagactacagaagcagaacatgctaccaaatgctgcgggcatggttccagtttcc

SEQ ID NO: 544009 - DNA, 114 bp, Homo sapiens
ctgtctgcgctgtaccggcctgcgctcagtcgaattggtactcttcacgctgtgtgactctctctccactgtgcagatagttcctgtgccgatctctctctagcgcggaccaga

SEQ ID NO: 544010 - DNA, 380 bp, Homo sapiens
  misc_feature (30)..(30): n is a, c, g, or t
cgcctccctacctttggcggtcttctggtnaccaatgtgctgcaggtcatggctccagaatcaaattgggctcaaattgtgtgagctccaacgcagtggaacctggccctactcccacctacacctcgtggatctcggagctgcaggggtgctctgcccacctcaccctaagctggcctcgcttggggctggaattgggggacagcatgttctgggcgtctctgcttctttctgctggtgcctgtacctgtgctggctgcccactcatagatatcaaagccacaggacggccccgcagaacccctgcgcctggctgccgggggatggctttggtgcacatgtgactggtcatcgtggtcccatggggcacctctgctctt

SEQ ID NO: 544011 - DNA, 202 bp, Homo sapiens
ctaccgtacgctccgattcgctcttgatgttggttatggggctgttggggctggtcgacaagagaggtgtcggtgtctacaatgtgtctggctggcctcagcgcaggcgagtggcctctccggttcatgatgatgctgtccacggtgatctgccagtaaccctcgacggtaacaggcacccagttcagacttccagtgtagt

SEQ ID NO: 544012 - DNA, 1265 bp, Homo sapiens
  misc_feature (1252)..(1252): n is a, c, g, or t
gtgccggggggtcccacagtcttgctctccacgcgggttgattacctctttttgtggcttgtattggttctcacccccctcagcgtgtttcaccacaggggggcctgtttgtacacgctcgccccgctttgtatcgctaccgggggtggtcttgtggagttgggcgcccacttaagactgcttctcttctgggtggctgttgggggggccccgacgtttttctttgtcgactaataagttgggggtggctgtatcagacgccccgccggtttatattgtcccccccgcacggtggttgcacagcgggccaccacgcgcttgttgggtcccaccgggaggggtggtccgccacacgtgtgttcgttcgtctgggcgcgggttgttggcaacattgggttgtaatgggtgttagctcccctcgtaatattgaagggggtttgtagctcttcgtggcggtagtacatattatagtggcgccccaccctgttataactcggtaatattggctgtatctcccccacacagagatagatagagagatattaaattttctgatcacgcccccccgggcttctcatagaagatggtgatggtgaatagtttttggtgtggggataaaaaaagtttgggatatttttccctcaaaaatagcgctctgtgacactctccgctcccacacagagagaaagagtggggtaattgggtgtgtttttgtttagacaaaacacagaaaaagtgggtaatatttgtgagaaaaatataaagtccacaaattggaacaaatgtcactgttgtttaaaaaatttccccctgtttattacacactctttttcttgaatataaataaattgcgccacatatttatacccctcttttcgggcgcccacgcgtatttcccacggaaccccctcggagacctgggtctaaagtaaaatatggaaattggtttcaccccctcgagggcacacattaagaccacctcttggaaaagatggccactaacctctttcaccctggacttaagcacttctgggctttaatttcaccacgcgctgtctttttctccctccacctgtatccccggttccctcccccagaggaacccccccgttttcactgggtggccctccgtctctcttttctccccccgactaaacattgttttctgtacccaggtaatttttcccactactaatagaataaaggcccttttttaaaaaaagagaagaaaaactcgagcataaactcgggncgagaagagtata

SEQ ID NO: 544013 - DNA, 622 bp, Homo sapiens
ggcggctgcgtcgggactgcaggagaatgatggacggtctccacaggagttaaagttcctcgataattttcgcttgttggaataacttgaagaaggacagaaaggagtaggactgaagtgtacagttgagctggcgtgccttggaagattgatgaagtatattgacacttacaaggtggagaggcatgattattggggccaccataggtacaaattatgaataacaagaatatatagcctgaaagtagaaggtggattcttatataaccatgaagctccgtccgtcgagttagatttgtaactaaaaattaatatgagagtggaattaagataagttccagtgggatggtggatgcgactggagcatagcagtgttagcaaaatggaaatagattctatatatgcattaaagttgtgacttcgaagagcgtaagacgtctaatgatgtccataagaaagatatgatagcttgcaaagcacatcgagaaggagaaacatacaatcaagtaatttcagtggatctcaaatcttgtcttaaatcagtaaggcttctactcatgtgaatgtcttgagttaaatatcgacagatggaagtatacgacagttactgtacaagagaatt

SEQ ID NO: 544014 - DNA, 943 bp, Homo sapiens
  misc_feature (937)..(938): n is a, c, g, or t
gggagcggcggaggcgcccagcggaggtgaaagtatggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgatgtgatgctgatgtaacagtaataggttctggtcctggaggataatgtggctgctatataaaagctgcccagttaggcttcaaggacagtctggcattgagaacaaattgacacacactttgggggggaaccattgcttggattgtggggtgtgtattcccttctaaaggcttttatgtgaaacaactctcattattaccatatggcccattgacaaacgattttgcaatctagaggaatggaaatgtccgaagttcgcttgaatttagaccaagatgatggcggcagcaagagtacctgcagtaagaagcttaaacaggtggaattggcccacttatttcaaacagaaatacaggtgtgttcatgtcacatgggttatggaagcggatacactggccacaaacatccaagtcactgctacgaaagctgattggcgggacctcagggtattgattacaagacacatttccttataggccagggttccagcagtactcctttcccggactaagatggatgaggtcatagtgtacctacggtgcttaatcttaaagaagtccgaacaggttgctgtattgggggcagaaggggagaatggtccagtgcaaactgggcaattaagggactaagacagggggagaagtgatggatataatacgctcaacaagtaatatgacagtgggccacaagagaagttacgcgtggaaaatatgaggagagcatagatggacttccattttgttttgtctggtattgnnaagga

SEQ ID NO: 544015 - DNA, 270 bp, Homo sapiens
tctacatccagtgaacacataatatacgaaagagaaacatctgtattgctcatataagaaagttctagctactccgagatagataagcacaaactaaccacaacattacccttaatccaaagcctaatccagagaaggaccctaactctcttcaattctgtgaagcctgagagaggtgaggaagctacagaagaaaagctggaagctagcaaaggtaggttcttgaggtacaagggaaagaagccctctccagacataaaagttcaaggt

SEQ ID NO: 544016 - DNA, 811 bp, Homo sapiens
ggatggtctttgttcaacaagagctggcagagtagttacgacaaggagttcaaaaattccatgaatcttggccaggcatggtggctcatgcctgtaatcccaccactttgggagggtgatgcaggaggatcacttgaggccaggagttggagaccagcctggccaacatggtgaaaccctgtctctactaaaaatacaaaaaaaaattagctggacctggtggcgcatgcctgtaatcctagctactcaggaggctgaggcatgagacatcgcttgaactcagcaagtggaggttgctatgagctgagattgtgccagttcattccacccttgggcaaacaggggtgagactctgtctacaaaaaaacaaaaaatacaaagaccacaacaaaagcagaacacacaagagacacactcacagaagcggacaacataagaagaagagcaacactgaagagccgaggacgacaacacacactgagagggcgaaagacgaaaacaccaacaccagggggcgacgaaaaaagatgacacacaccagaaggaacaaagctgatacaaggagaaacaaggcgcgatcacacgggtatacagaacgaacaaaacacgaacgagggccacacacaccgcacacaagccactcatggagccacaacaagagagacaacagcccgaagaaaagagacgcgacacgacacgaacaacaaacgacactacgaccacccgtcgcacgtaggaacagacaaaagggggcacgaacacaaccacacagacaacacagaggaccgaggaacacaaacgggagagcaaa

SEQ ID NO: 544017 - DNA, 626 bp, Homo sapiens
ggtttttctctctatacccctctcctcatactactctcatataaatgtttttgtttgaccaccctcctctcaacctaataggatatgcctataaaacaccccccaccaccatgttattgtgaagaaaaacatatattataactacaaactccactcctctctcctattacacgcgctttgtttctctcacactcgccgcacactcttctaacaacaccacaccctcttttcactttcacgccccaatcactctgttcacacaccacatcttcttggagtaatcaccctctttctgcagtaacacgctcactcacatactctcttctataaaacaagtggctgcaaatacatacaagaaatgaatagataatatacacttctttaacggcagagcctctctgcatcctttaccctctggtgacaccaacacacttttttcccctgacccagttgtccctcctaaatagtctgtatttacacagcgggcaacgctatgaattattactccccctctttatctattctgttatatcaacgattcatcattgaccctctcgaacctttaaaaaaaggaggagatatgaaacaatacaacaaccattataacccagtccacaattaacaaa

SEQ ID NO: 544018 - DNA, 443 bp, Homo sapiens
tttaattctagaaggatcccgaggacgaggaggaagagaaagaattgaccccttgagttaggccccccaaaggttggaagaggcagattggggcctgcagattcaatgtggatgaggaaccttttgtgctgcccctgtgctggggagatggagcaggattgcccaggctccaaacctgcaacgagtttcacaagcggatccaggatattgtgggatttctgcgtgatttgggggctcagcgggaggaagggcggtctcgttctgattacctgaaccggctcaagaaggatctggccatttactactcttatggagacttcctgcttggcaagctcatggacctcttccctctgtctgagctggtggagttcttagaagctattgagttgcctctggcccgtcaccctctgaaccattaccttgaaaacccgacgaattagatt

SEQ ID NO: 544019 - DNA, 753 bp, Homo sapiens
ggcatcacttcctctcaagcttggcgtcgtgtggtggggtcacacgcgggttcaacagtgcgtatcgcaagaagtgttgattgtctagtatcggggccctatctatcctggtacacggctatgatgttcgtccgcaacgattgctgaggttgttcatgattttgcaaatctacatgtcatatcatattttaaagaagaagctgcaagtcctcgcaaagttcaggtggaccaagagcgagttccggaaagacacgctggtagagagctgtacagtggataattcatttgaatttgaaagacgtagaagtgaacctatcaagataccagcgagagctagtggaagtaaatacgtattgagtgcgatgaagagagttgaagagagatcaagacagaagcgccgaagttaaatttataagtgaactagtttgtaatgacaaaataaggagctagcagagagttgaggatatgaaagaagtcaagtcaagaaggtccatcttattcgagcccctcttgcaggcaaggggaaacgagtgggacagagaacatggtgacagcagttacaagaggatgtggacgtggacagatgctccttaaaaatctctgtaaccatttcttgtatgtacattttgaaaatgccctttggatacttggaactgctaaattattttattttttacataaaggtcacttaaatgaaaaggcgattaagagacatcttttccgtgcattgcatctacataatatcagatatta

SEQ ID NO: 544020 - DNA, 608 bp, Homo sapiens
  misc_feature (2)..(2): n is a, c, g, or t
  misc_feature (371)..(371): n is a, c, g, or t
  misc_feature (405)..(405): n is a, c, g, or t
  misc_feature (450)..(450): n is a, c, g, or t
  misc_feature (503)..(503): n is a, c, g, or t
gnaactcacagtgtaccaggtgggggcactgttaaactcaagctatatgaagattctgccatcccccttccagctgagtcacccaagaaaggtcccaagatggtggcctctcgtgtcttgtcacctcctccagctgaccctcctaccagcagtttcagtgttcttggggacgtggggccccccattaggaaacccatgaatagagggacactaatttctcttctcgtcggcggtcctcacatgttcgtctcagactcttgatggcctggcccaggccctcctatcccccctccctcaccattctctactctcctgcgggcctcctccccgccccggccccccctctttcttaccccctcccttctgcctcngcccggtttccctatgtaggtcccgccccctcantgggtttccttcgttctttctcccccccactttgttttctctttnccgatcgtgttgtcctcctttcttttccgcctctctttccctttttcaccacnattctcgacttcccccgtcctctttcgcccctcactcactctccccacccttctactccctcaccttttcttttctccctttcccctcctccctctgtatgttct

SEQ ID NO: 544021 - DNA, 135 bp, Homo sapiens
ccctaaaaatttctgtggttctggtaccctctgagtagggctataattccctactttgactgtgtgcatcatttgtaagctagcagatctatgtgggtgaaatgcacagggagcttggtagattgcgggtgtatg

SEQ ID NO: 544022 - DNA, 352 bp, Homo sapiens
tggtcacccgagatggggatgtacaatgtgcacaatcactagctcactggcagcctacaaagttctggggctcaccgcaatccttccaactctcagcctccacaggtagctggggataacggggctgtgagccactggcgcccaagccttaatggtcttgggccagttgggagcttcttgcaatgtggactcctggagatgactgggtcaagctcctggatagttaacgtagcgatcttggcatatctgggtaggaccaggaggtggcagagcttatcatttaaccagtcccaaccccataagtgtcgcctagcccagagggtcggcctgggggaaccgagctcgaatacgc

SEQ ID NO: 544023 - DNA, 361 bp, Homo sapiens
gccttctcagcagcagcctgctcttcttctatcaatctacttcaggatctctgtagaagtacagatcaggcatagacctcccatgggtagtacacagggaaataggtgccactgcttgcgctgtaacttccctgagccagtatacaccacatcaaacccactgagtgagctccctcgtatgtaagcatgggatggcaatgtccacataagcgcagaggagaatctgtgttacacaagcgcaatggttaggtaggttaacataaagatgcctccgtgaaagggtggtggtcagccctggggtcagtaaaccacaagaagccgtgactccccgaaaaggctagccatgaatctggtatagtga

SEQ ID NO: 544024 - DNA, 238 bp, Homo sapiens
tggcatttgatttttttttaatttttcattcagtttgagatttttctagttctttgtataagtgattttcataatatatataagtgattttcaatttaagcctggacattttcacattatgttctgagatgcttgctctttaaataaaccttctttttcatctgatcttatctgacttttttccagcaggggtgccaactcattactgccaggtgaatgtagaagtctgggttcccta

SEQ ID NO: 544025 - DNA, 749 bp, Homo sapiens
ggcatgtgtgaagcggcgaaggaggtggtggctgcgttggtgctccgggaagccgttcgggctggtggctgtcggccgcggggtggattgcactcgcgcgcggggatgggccactgcgtgatccattggttcagctgttgccatttcctgtgaccatctcattgacaaggacatcggcgtccaagtctgatgccactcgtgcgtccttttacaggatgtgggagggggcagctgggctgagcttggccggagtgaacgggtgcggaactgctcaagccctgagttctaccaagattctagcagcttgagtacggtttgagacagtccagaagctacgctttgtgaatctatgacatagacaacaagacgccagagctgagggctgatgacttcctagggggtgctgagtgttccctaggacagatggtgtccagccaggtactgactctccccgttgatgcttgaagcctggaaaacctgctggtgcgggggaccatcagggtctcaggcttcaggaagttaacaggaccaatcgtgtagtcacccatggaggtcgcaggccagaaagcctagataagaaggctgtcctgggaacattcagatccatttctgcagtacttccgcaggggtgatgggcacgtggcccctggtgtacagcacttggaaggtcatcaagaaacactgaaccttaacatggacgcgtctctacagtcccgggtcacgcattactggggtgggacccgccagaa

SEQ ID NO: 544026 - DNA, 789 bp, Homo sapiens
  misc_feature (383)..(383): n is a, c, g, or t
cgaggtagaagttcataccaggtcccagggtattttctcaagcctgtataaaagccctgtttcccggaccaataaggaacccaccagagccctcctcgagtgggccttacagcaatctagctgctccagactttaagaaaaaccccgttcttgtgcaacacccattttttatttgcaaaacaccacctgtgtcccccacccccacaaaaactggttcaaaacaagcaaagcaagttgtgccccttattcctagaggtaagagtgacaattttctgtggcatcatttgtatactgtgaatctttcctcactcccaactgggcaaagggacttggtgaaggacgggtgtttgtttaggttttgctaaattaaatggtgtcaattntgctactctatttcctaaatgccccagtgcctattaggagccatagcagctaaatggctagtgctttcctatcatgaaagggacaaagtcatttaattctaaaagtctcgtgatggataagaatgtatatctataaggataacaaaaggttgcatatagagcagctcccaaatcctttgtcatttggtggaacttgtttattccaagctattttaattttaagcagaacttcagtcttggaaaacaggaaagtgagaactccttcctgaggccacaggccacggctaggtccagaccctactcatttgggggagctgtttgctcaacacggagctgaagcccacctctgcccagccccaggtggagtctatccttctctaccaggttcctcagaactctgccctca

SEQ ID NO: 544027 - DNA, 747 bp, Homo sapiens
  misc_feature (335)..(335): n is a, c, g, or t
  misc_feature (337)..(337): n is a, c, g, or t
acacattctcactttgtcaccaggctggagtgcagtggagcaatcttggttcgctgcaatctctgcttcctgggttcaagtgattctcctgtctcagcctcctaagtagctgggactccaggcgcataccaccatgactggctaatttttgtatttttagtagagacggggtttcaccatgttggccaggctggtcttgaacttctggccccaagtcatctgcctgcctcagcctcccaaagtgctgggattacaagtgtgagccactgtgtacagcctttgtgttaacttactttgaattagccccttattccaaagctgcctcctgaaaggangnttcctaaaaggtgttgctttggggtaaataagaggtgctggtgaagtgagactagcttgcgcatctctctgccatgaaggaaactagctccgcagacgttttactaaccacagcagaccccctccttgaggaacccagaagggcagagagcatcagatgaaatcaactgctgagagagggaagtgagtgctgtgttgggcaccgctgccagaaactcttgagaatgagcatcgtgtgccacttatccactgcttgccgacttcagtagcaagagcctgcagattgctcatggataaacctcatctttgtgggcccacattggtttatgagctgagtcataagactggctggctccttagaggctgcttggggattctctaggcagcagaaaccaggggagaagattgtag

SEQ ID NO: 544028 - DNA, 438 bp, Homo sapiens
  misc_feature (161)..(161): n is a, c, g, or t
cattcgggctgagggttcacttgcttccgccgccgttggaggagttggccttgaaaaagctggtgacgtttacgtgcttggcaccgggcttcagccccaaggacgtgttggttcgttggttgcaggggtcacaggagctgccccgcgaaaagtaccttttntgggcatcccggcaggagcccagccagggcacccccccttttgttgtgaccagcatactgggggtggcagccaaggattggaaaaagggggacaccttttcctgcatggtgggccaagaggccctgccgttggcctttacacagaagaccattgaccgcttggggggtaaacccacccatgtcaatgtgtttgttgtcatgggggaggtggggggcccctgtttttgagccgcccgcctgtccccccccctgaataaattccatgttcccccaagca

SEQ ID NO: 544029 - DNA, 123 bp, Homo sapiens
cacacaggcgcacttctcaaggctcaatgaactacataatgaatgcagaagccttacggatgctgatgcgatcaactggacagaaagggtatcagtgtatggatatgatgaacatgactgacc

SEQ ID NO: 544030 - DNA, 346 bp, Homo sapiens
gaatccgtctcacgggtggagcgcgccctccgcaagctgtcgtgcccttcctgcagtccagggctctccgatcgcctgtgtgcagcaaaggggcctacctgctcatggagttagccaagagccagggcaagactctcaagatttatgaaggtgcctaccatgttctccacaaggagcttcctgaagtctccaactccgtcttccatgaaataaacatgtgggtctctcaaaggacagccacggcaggaccgcgtccccaccatgcatgcattgctcggtgtccggctcacggtgtgggggaaacaagcagggtaaggacaaaaatggcttttcaaatatggcaaac

SEQ ID NO: 544031 - DNA, 291 bp, Homo sapiens
accaagtacactaccaccgatctggtcattgatcttcagagtaagcgcggccttgacaaccctcctgcaggctgacatctggcagcaggtcgcagacgtcctgcagctggtagctactctgatggtagctgggcagcatgcctgtggagactttttccaggtcgcacctgatatccagaagctaggagtacagtcccttcaaaccatggacctggaaagtgatccgctgggacagagtgcccaccgacgtgtcattaatatctcgtaacaagatgtcaactccaacagggt

SEQ ID NO: 544032 - DNA, 348 bp, Homo sapiens
  misc_feature (204)..(204): n is a, c, g, or t
  misc_feature (297)..(297): n is a, c, g, or t
acaaacagttcccaccatgaagagagagtaggtgaccggaaaggagtgcgtcttaagcgcgttcgctgaatttgcaccactcaatccagcaccgccgcacggcgccgctccttagacctggactccggcaccctcccgccgggaccgcacttagcagtggatagtctgtcctcctgaagaacgttgcgctccgacctccaacgncatctaggtcaaaagttctaactccattctcctgacctggccgccaatctagaaaatcatcttgttgccaatcaaacgtgtgtcgcgccgacntgtgacctcaagccggtacggacccagcgggcgggaagcctgcggggcgtt

SEQ ID NO: 544033 - DNA, 402 bp, Homo sapiens
  misc_feature (1)..(1): n is a, c, g, or t
  misc_feature (86)..(86): n is a, c, g, or t
ntctcaccagtctacaccagtcaccctgtcttagcaaagggaatgccatatcaccacctgatagtaccataaagagctctggatanctcctgtgtgagatgtagaaatcgacctagttttcagcgactttgctaggaggaactgtgatccccccagcccaggcaggtgggttcctggaaaacatgccgtagttgagtttagactttccaggttttcttagcctcgatccgtggagaaacttgcctgttttctttgagttcttgtgttagccagtgtcagtatttattgtttcccactgtgttaacacaggaagagttttgcaagtgtgttaattaatgttaaatgataactagaaatgtttcctttaataaagaatggctgtactcagcatgctcaacatca

SEQ ID NO: 544034 - DNA, 138 bp, Homo sapiens
acgagcaggttacatgtgcacagcagtaggcactcaattttttttttctttttggagatgggtgtctaactctgttgcccaggctggagtgcagctgcacgattctgggctcagtaacaacctaccacctccgcgggt

SEQ ID NO: 544035 - DNA, 798 bp, Homo sapiens
agcggggctaccgcggtccgaacatggcctcggtggctggatctggtgctgccgcggctccgagctcactgctcctcgtgctggcggcagcaacattcgcgagcccgggcggcctcctctcctacgctgctggtaggagcctccagatagagagagcatccggtctagtggatgtctgatcctggctgtctgcaagcgtttgaatgcataacatgcatctaggagagtcttatggtgtctccgaatcacatcttgtctcacccattctctcatgcacttgttgcaaaaaacgtggccaggggaagacgcttgctagcactaacacgtgtaaagcacgaagcctaggagtagcctcttggctccatcgcctgcaaacccattctataatcaaagatcctctgtaatgcaattgagtcgtcgcagggataccctctcgtgtatgggacctttgccttcgtctacatagctgccttggtgtctcggcctcgtggccccttgcccgttgcgtacgcgagcatgacggcgagctcgacgtggcatactagatacaagtgtggtctctctgcgacacatcaggcaatttcgcatccagtgtcccttggaaggaagcacagtgaggatcccgtcggagcatcctggagccattgaacggccctcactctgatgtcagtgccgacaccatacttccaccgattcaccctgttccccaacctctcgagatgaactgtggcatcgactggcaaccacgtctggtattacttgggatctctcaggggggcgctaccggacttccagccg

SEQ ID NO: 544036 - DNA, 393 bp, Homo sapiens
  misc_feature (121)..(121): n is a, c, g, or t
  misc_feature (386)..(386): n is a, c, g, or t
cgaatttggtaatttggttttagccttagtttccttcctggttcgccacctaagcaagattaattttaagacacttaggtcaataactgtgccctataagaatttcctttgggccaggcantgagtgtcacgcctgtaatcccagcactttgggaggccaaggcgggcagatcacctgaggtcacaagttcgagaccagcctggccaacgtggcaaaaccctgtctctactaaaaatacaaaaattagccggggtggtggtacatgcctgtagtcccagctactcaggaagctaaggcacgagaatcatttgaacactggaggcagaagttgcagtgagctgagattgtgccactgcactccagcctgggtgacagagtgagactntgtcttg

SEQ ID NO: 544037 - DNA, 400 bp, Homo sapiens
ccaaagtggcagctccctctgctcttccacaccacccgctcctaggccctggcggctcccgcctcaccagcctccctctgcccctagcaaactgagcggaaatgtgaatggggtggggcagccaccagcccctgggcctggactgctgcgaatcagtgcctccgccccgagctgtagggctgcgggccccacgcccacccccagtgcccttcactgggacgattgcagagcctggtgtacaggccgttcgccagtgggtcggacccttgtgggtgccacattcttaaatgtcctgggcacacaaacaagggaggcaccctcatccaaatcactaacacattcgtgagccaaacacacgcttcccgttagatttgtcgaagctggttgtgagaagctgtgg

SEQ ID NO: 544038 - DNA, 384 bp, Homo sapiens
actcagtacgtagttccattcaatctattgagatggcttttaatctattttgaatcagcgcaattcttatggctactgctgccatgctggtgtcactttgctttctcttgtccctacccctggtcatgttcttgttttattgttgtgtgctttcccagtcccattcctcagcttcttcacaggcacccctggagatatgaaggattactccccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgcgaag

SEQ ID NO: 544039 - DNA, 241 bp, Homo sapiens
ttgacctagaggatcccgttggcgtaggccaacgcccacccccagtgcccttcactgggacgattgcagagcctggtgtacaggccgttcgccagtgggtcggacccttgtgggtgccacattcttaaatgtcctgggcacacaaacaagggaggcaccctcatccaaatcactaacacattcgtgagccaaacacacgcttcccgttagatttgtcgaagctggttgtgagaagctgtgg

SEQ ID NO: 544040 - DNA, 1128 bp, Homo sapiens
cataacatcgctgcatgctgtagcttgtgcaacacagggttgtccgtgatccacaaggcattagcagcatgggtggcatggcagaaatcgttgtccaacacagaccatgtccgtcagtatgttcacaggctcgtggcagctgtacactccagcacactcctccatctcttcacgctccctcctcgtctcctctccaccctccacgcccacctaccgaactcaacctgaccaggctccacactacccatcactccccgcccttccacacaccctcccctactcccccaccacacacccagcacccacaccccctactgcccctcccctccctacccacccactcctccccgctcccccctacccccgcctccccactcccccactactcccccccccctacccaccactccccccccacccccccgcccacacctcccccaccttacccctcccctgcctcgacacccaacccacaacccctcacaacaaccccatccgcgccccacctccccacacttaacaacatcctccccaaccactacccactacccccgccaaaaccacaaccaacaacaccccacaacacaagcacaagaacccaccaccacaccacaccacccacccaccgcacccgcacaccaccacaggcccttgaccaaacaccataccccaccccccccacgcacctcccccacaaaccccctcccccaccttccttcaccaccaatctccacacaacacacctccacaacaccacccacccccctcccaccaactcctcacaaccaattccctcacaaactctgccacctcccccccttattcaccaccctatccaccaccccccacacctataacccaccctacatcactctctctaccgccccctctcaccaccccaacccttcacaacacaaacatatctacccccctaccccccctgcgtccccccgaccgccaccacggaacgccggcaacctaccgccgggggccgcatctcaccacagaacgctctcactcacctcctcctccgggcaccgacccactccgccccgccccagacaagcgcgccctcacgcgcaccaccccccccacctccactagaccgcgagcccctaacacccccga

SEQ ID NO: 544041 - DNA, 478 bp, Homo sapiens
  misc_feature (448)..(448): n is a, c, g, or t
cccccattagttgaaaattcatatatataacttttgactcctccaaaacttaactactaatagcttactgttgacaaaagccgtagtgataacatagtcgattccacacatattgtgtgtgttatatgtattatattctgtgttcttacaataaactagagcaaagaagatgttattaagaaaatcataaggaagaaaacatatatttagtattcattatgtggaagtggatcgtgatcaaaatcttcattctcatcatcttcacattgaataggctgaggaggaggaagagggggtaggtcttgctgtcttaggagtggcagaggcagtagagatgaaggagttcgtagaaggggaggcacgggaggcaggagaggcaggcacacctggtgtaacttttattgaaaaaaatctgggctgagcaccatggctcatgactgtaatcccnagcattttgggagccaaggcaggaggattc

SEQ ID NO: 544042 - DNA, 703 bp, Homo sapiens
  misc_feature (24)..(24): n is a, c, g, or t
  misc_feature (40)..(40): n is a, c, g, or t
  misc_feature (51)..(51): n is a, c, g, or t
  misc_feature (68)..(68): n is a, c, g, or t
  misc_feature (72)..(72): n is a, c, g, or t
  misc_feature (77)..(77): n is a, c, g, or t
  misc_feature (90)..(90): n is a, c, g, or t
  misc_feature (92)..(92): n is a, c, g, or t
  misc_feature (108)..(108): n is a, c, g, or t
  misc_feature (129)..(129): n is a, c, g, or t
  misc_feature (136)..(136): n is a, c, g, or t
  misc_feature (148)..(148): n is a, c, g, or t
  misc_feature (179)..(179): n is a, c, g, or t
  misc_feature (185)..(185): n is a, c, g, or t
  misc_feature (188)..(188): n is a, c, g, or t
  misc_feature (212)..(212): n is a, c, g, or t
  misc_feature (247)..(247): n is a, c, g, or t
  misc_feature (265)..(265): n is a, c, g, or t
  misc_feature (287)..(287): n is a, c, g, or t
  misc_feature (296)..(296): n is a, c, g, or t
  misc_feature (318)..(318): n is a, c, g, or t
  misc_feature (324)..(324): n is a, c, g, or t
  misc_feature (336)..(336): n is a, c, g, or t
  misc_feature (397)..(397): n is a, c, g, or t
  misc_feature (402)..(402): n is a, c, g, or t
  misc_feature (407)..(407): n is a, c, g, or t
  misc_feature (410)..(410): n is a, c, g, or t
  misc_feature (429)..(429): n is a, c, g, or t
  misc_feature (460)..(460): n is a, c, g, or t
  misc_feature (470)..(470): n is a, c, g, or t
  misc_feature (618)..(618): n is a, c, g, or t
  misc_feature (635)..(635): n is a, c, g, or t
  misc_feature (638)..(638): n is a, c, g, or t
  misc_feature (670)..(670): n is a, c, g, or t
tccatgtgcattaatttgtttatngaccctttccccaggngggcagccccnccaggaaagggctttgngggntcttncaccgcggtcccngngtacaggacagagccnggcacacaccaggggccagtnaatattngcggaaggaagncacaaaaagggatcagccaccattactttancaccangancaacaggaaagaccactgtccccncccaaccccccccaaaaggctttgaagcagaggtnaacattaattcactgtcncaggggacagcccccacccggnggccagggngggggggggcggggaagggggngagagnggggccccacgncccaggccccttgaaaccccccaccccacccagccaggaaacaccacgaggcagccaaggntaagnagacnctngcggctttgttataaatanattatgtacatccaaaacatgacattaaaanattaccccgngtaacagaaaagaaattaaggctttctattatttacattaaacaagcgagcacctttaaaaaaaaacaaaacaaaaaagccctactcttccttctctgacatactctggccagaggggataccgtgtcctcttccaaatgaccaagangctctgcaggggctgtnccngtgaagacatcttggtattggaaacatcagcnctggcagggtgggggcagcagaaaagtaggggt

SEQ ID NO: 544043 - DNA, 116 bp, Homo sapiens
caccaggtggatcttcttgtgtctcagtcacacacttccgtgtcccaccggttagcccttgcgctcggtcaccatccggattgtcatccacgtgcaggcgcctatacgccgtcagc

SEQ ID NO: 544044 - DNA, 644 bp, Homo sapiens
agcacgttcggaaacaaatcttaatctatcaaagttcatgttagcaccagaaaggatgggaacataggtgtttttagtgtggtcaatttctggatgtacggtagagatgtatttcttcataccggctactgaaagggcaccagatggttctacaatacttctagtatcttcaaaaatatcctttactgcagcacagatttcgtcagtagttaacaagaacaacttcatcaaccacttgttgggcgactctaaatgtttcttcaccaatcatacgcacagacgtaccatcggcaaaagtacccaccacaggtaaaggagttctctggttgcgttgcaaggaattatgtaaagtggccgcatcgtaagtttcaacaccaatgattttgatatgaggagcaacccttttcaaataagcaccaataccagcaattaaaccaccaccgccgacgggaacaaagacagcaccgatcttattagcggtacgtacttgtcttaggatttccatagctacagtaccttgaccggcaatgacataaggatgatcgaaaggaggaatgttcgtcaagccacgctcttcagccaatttggcacattcagccttagcctcgtcaaaatcgttaccatataggacgacttgagaccct

SEQ ID NO: 544045 - DNA, 403 bp, Homo sapiens
  misc_feature (152)..(152): n is a, c, g, or t
  misc_feature (221)..(221): n is a, c, g, or t
attgctttgggtcacccactgggaggatctggattggttgatgaattaaggcgtcgaggtggaaaatatgccgttggatcagcttgcattggaggtggccaaggtattgctgtcatcattcagagcacagcctgaagagaccagtgagctcnttgtgacccacttttatttaatgggccaggccccagtaaaccaagtgcccttcaaagcagttgccacanctggccatgtcctgccattgaaacagtaattgagtttgttcaacccatggtgatacaaaaatgcattgatcatgaataggagcccatgctaaaagtccggtctctcagatttgtcccagtgaaatatgtatttctgaactaaaactcacctatagaagccattaaaagaaattgtattctta

SEQ ID NO: 544046 - DNA, 155 bp, Homo sapiens
gagctttgtaccggaacattcgtgtcaaggacccctcccgtgaaggtcggaggacagagaaaggtcagcagggtcagagtatgtgaggtcagagggcatgagggtcacaggtcagagtatgtgaggtcagagggcatgagggacacgaatgttca

SEQ ID NO: 544047 - DNA, 270 bp, Homo sapiens
ggctgtgcacggtggctcatgccgtaatctgtttcggaagtagccgttgggagtacgctgggcccacaagttgagaccagcctgggcaacatagtgagaccccgcctttacaaaaatttaaaaatagccaggtacagtggcatgcacctgtggtcccagctattgaggacactgaagagggagggtcacctgagcccaggaggttgaggctgcagtgagccatgattgtaccactacactccagcttgggtgacagtgagaccctgtgtc

SEQ ID NO: 544048 - DNA, 313 bp, Homo sapiens
aagctccaacaagataaactctagagaaagacgggcaggctgcatctttccgttcaggcaacttagtcattccagcctgcggctttggagaatacaaaccgacggagggacagaagagatcccccaggacaggataagttgtttaacaaattcatggccagactgcttctgtaagcaggcctcctgatcccttgttcccacttcaacttggacaggacctcccaaactgggggcctcccagctaacccccaacaagcaattccttttggccaaatggacaatgtgaaaacatgtttcctcgggacaagaggct

SEQ ID NO: 544049 - DNA, 393 bp, Homo sapiens
ggagtatacaaagcacatatgatcatacttgctgaataaagaaataaaaatgaagaggcactccagcctgggcaacagagtgagatggtctcaaaataacaaaaacaaaaacaaaaaacgactggaaaggagatgagggtacttgttgaagccatattatattgacacgctctgtgcatcggacttttatatacacttgtctcagtctacttcatctcactataatccgttacaacgtacctcttttatgtggggaaatccccgatataactagaagacgaaaggcaagttcaagaagttccattgattatgcccctaaggttccctcaatttagcaaagcgtcaggcccaatggatccaaccgcccgtgtatgtattggcacgtgacaggac

SEQ ID NO: 544050 - DNA, 908 bp, Homo sapiens
gccttttcctggggcatcgtggactgagcgtgctggctgctggtcaccatcatctttcatctacgacaagtgccggaatgacccgtaggacgtactggatgatgacagacgccggttctgctaacccctgacagagtccagcgggcagcaccagaatgataaaggcaagaactgtgctcgccagtaggaactcttccctgaggccgcggtgggccgaggacgctccgcgtgctccacgtcatgtcaggctcgttccgccgtgagatccccatccccgagtgcttgctaggattcctagttctcacctcttaaagaaaaccccacctccgttagtattcccgatctatacaatcttcccattctttggattatagaaatagttgggttttctcctattcagggattctgttcccattaggtatagttccattctgaagtgtttctacgagagcccgggagctgctgccctgccggacccgttcttgtgagccttttcagcctctgcgtggtctgatgtcatggccgggtgggcggcactacgtcttctccactggccggattcagtgccaggtccttgcgctttgtggaaagtcacaggtcacagcgaggggccccgtgtcctgcctgtctgaagccaatgctagtctggttgcgccatttttgtgcttttatgtttaattttctatgagggccacgggtctgtgttcggactcagacctcaggggacgactctgacctctttggcacagacggactcacttgcccaacaacgaggcgacccgtacagctcagttaatcccagcccctccttgtccgtgcctcgggggcactctggaaggggttggtgggaacggcgggcacgcggactccaaacgggaacctccaattacccctaggaagcgggccta

SEQ ID NO: 544051 - DNA, 188 bp, Homo sapiens
  misc_feature (35)..(36): n is a, c, g, or t
  misc_feature (182)..(182): n is a, c, g, or t
  misc_feature (185)..(185): n is a, c, g, or t
atgagccggcccggcttctggacttctggcatacnnggacttctggcatacctggaccttctggcatacctggaccttctggcatacctggaccttctggcatacctggaccttctggcatacctggaccttctggcatacctggaccttctggcatacctggaccttctggcatacctganctnctc

SEQ ID NO: 544052 - DNA, 432 bp, Homo sapiens
gtcagaataccctgttacaggttcgccgtagtgtaatatctttaaaagcagcagtcattcctccagcagtaagtggatgcctcatattatatgcgtctcgcagaagaagaacacctcgttgcttcactgatgaaggaggaaggaggcttgctggtatggacctcagatgagaatggtcagaggcttctaagaatggttcttgcaggtgatcaggtatttgtgggtaagatggtgtcaaccatgtattctcttaaattccttggcatttctcctctaatgtcaacaagtactcgagtttcactgggatgaaatcgggtagatgagaactggactcgggttaggtaagataagttgagcatgatttgccttaaaagggggtgcatgctgcataagaaagccgagaaaaggagatgatatagagactttattgga

SEQ ID NO: 544053 - DNA, 229 bp, Homo sapiens
ggtatttggtactatgataaaaatagaggcaatcttagataagcaagcttttagaagcatgaaaatgaattagggatagtaagaaaaataatttacttaacgtgaagattcaaatttctataggtcaaagaaccttgtaaaccaaattagaagggcaaaacacgacttgaaaaaatttttgggttacattaatttacacggaaagcgatagtatcacctcacctgtgtc

SEQ ID NO: 544054 - DNA, 610 bp, Homo sapiens
  misc_feature (17)..(17): n is a, c, g, or t
aacactaggctatagcntacaagtaggtactataagctagcttaacctccaagcatcctgcgtcaaaatagatagaaaactatagggtttaactagtggtccgaaaatactatgaggtataaaagcacaaatagggatagcatataataagcacatctagtacaaaccctggtagtctttatgggatgcatataatagcacgtctgtacaaaccctggaagtctatatagggatgcatataataagcacgtctgtacaaaccctggtagcctctcagaccaggttagtgtactagtaagaaacgtgataggaagagtctctatacataagggtggaaattgtaacaaactcattattatcttcatttcccaattttgagtcttctaaaaactccaagaccatgctggacatttcaagaaaataacgttggaagagccaatgtcttagtgcatatatacatcttcagattcagtgtttatgcaaataggcccacgggcagttggctaaagctccagaagtaaagtctataaagcaaatacccagaggaacctgagaaaacctctcgataaagtaggtaaaatccttttggtgaaccacataaaacaaagta

SEQ ID NO: 544055 - DNA, 169 bp, Homo sapiens
  misc_feature (34)..(34): n is a, c, g, or t
gagtgggcgagtgccgcagcgtgaactgcttctngagactcaggtctgagtgctggtctgagatctggtcttccctcgcctcctgttctacttcccatgccttctgtaaggtcctgccgtggcctgaagtgtagcccttcctggagtacacagcgagcatgctgtgccg

SEQ ID NO: 544056 - DNA, 1917 bp, Homo sapiens
  misc_feature (344)..(344): n is a, c, g, or t
  misc_feature (614)..(614): n is a, c, g, or t
  misc_feature (1917)..(1917): n is a, c, g, or t
ggtacctgattgatgccgtctacggtgggctcacgggcagcgagctctgcggtttacgcattcactagccctgggatgcccgtgattgatgggggtgtcagggactgggaccttcgcatggacgccgtgggagtgccgctctcggtgcgcaccgagtgttcgctctctggggcgtgcgtgccatatgactggctgcatgcgactctgatacatggactccagggccatgactcaacggaccatgcggtcctgactctcccttggtatggggggccaatctctagtcacgatcgcacgtgtagccacatgtgggcttgggggacggacgtatgtgcggggccatntccccggcgtccacgtggacgtgccatcacatctgccttgtcgtgctggcgcttctcgttgctatcacttgcacacttcgggcgcacgcttgcacgttcccaatagagactggaacctagaggagtcagaggtgatgctatcccaagctctgtccaaattactccaggacatgcaaccgaattcgcctagggaaccgagacgcggtggaataggccgtgggggaggcatcgccaccgtgacgagggggggaccccgggagtacgtggatncggggcgcattttccttgggggacgctaccgaagacgaagagtccgtgggctttccccccgcgggtgaagcctgttgggagacgtccgcccagatccggggggtcacgcgaaggggcgacatttggaaagcgaacggactacgcagatggagcgccgattgaggaaacccgaacgccgaaaattcccccagtgggggccccaacacagcactgaaaacgccctttgttcccagttccattttgttcccgttcccgtttgcggcgttccccaaccccttaaaccgaccgccgcgggcggcaccgcccttaccggcagcgggcggggggccttcacccccccgagaatcaccagcgtggtgggccccccaaccgtatatcccctggcttatgggggcgcgttctcttggacagatcctacgaccggaccacggtggggcgccacaggcacgcgcacggggggacacccaccttatgtcggccacgaggggacagtggtggggggtgccacccgacgttgtcaccattttgcccccaccgcttgggtggcgcacacttcgtcctgcgttggggcgtctgcttggcgaccacagctgtgcttttatcccaaggtgctcccaagtgtacacccacggggcggcgggtgggggcgtatttccccccgcagagacgcttctagaaaccactcacgtcttgtgtcgtcattccgtggcagtgtgctcacacacagccccgcacgtggtgttcgctggggagccgcaccccgttaccgtctctctaagacagccacctgcggggagagaccccgccggaggaggaggctgtctaacccccaaccaggccgatacagccgacggacacaaagactgcgggcacccggcgggcggcaaccccctgcacagagcaaacaggtgtacatgtgcaaccccgccctctgctagaacgggcggcacgcagcacagcgtgggagtcgacgagagccacccactcaccacgagcgcccacgcacgcgccaccacagaccactaagcagcacgacgcaccccacccacccgggccgacacaggcgcccgcacgccgcgcacgagctcacacacctacaaacgagaccagacacgcccccgctgacagcaaacgctgaccactcactctctacagcactcagcgcgccgcacgccacggcgccgaccaccagcacgaccacgtacagcagaggcgcccgcgctgacatcatcctcacacgccgaactgcattacacaagcgacgtcgcgaccagagacgatcccgccccgccacagacgatgn

SEQ ID NO: 544057 - DNA, 1590 bp, Homo sapiens
  misc_feature (1396)..(1396): n is a, c, g, or t
gggacggttggcaataacaagcgccttacgaaaggcggcaaaaagggagccaagaagaaagtggttgatccattttctaagacagattggtcatgcatgtgcaaagcacctgctatgttccaatcatcaagcaacatattggcacacagcacgctcgtcaccaaggacccaaggcaacccacaacattgccatctgcatggtctccaagggtccgtgtgtttgcacagtgcagtcattgctagccattatgccagcacatgcatgccacacttgccatcttaagcaaacaatcccacagcctgcattaactgcccagcatgttaccagtaggataacacaacatggccatgcactcaactttccccattgggacactgagactctataacgccgatagacaacaaaatagttgttatcacatagagtcaaaaacacaaatgggaccaagcacgccatgcactttagcacatgactaccacagataagaattgttccaaagaactaacacgcgagtgcgactctaccattggacataatcaggatccatgatatcatgctcgctttagaggcatacagtaacctacgaccaaaaccacgaccaaacaagaagatcacgaaatacgcgggacaagcaacgccgtactatatacatggccttcaagtgaaaacccaaaaacaaggcggatccaccggaccaccaacacacataccccgggaggcacacggaacacggcacttggaacttgcgggaaacacaagtcccaagttgacagaccccagggagaggcaaggagatagcgccaagggaaagcacaaaaatgtagaacaccttcattggacacgcacaggaaaacgggttggaggctacaaaacattgaaacgcaacttgatgaccacttcttcgccaaacagcacacccacggcacccagatgaatgggggcaacacaacacaagggaaacacaatttagtgcacaaacagcacaggacggcactatcgtgaccacgacaatgataccataaacatgataaacgtacgcccatttccattccgaccaaatggaagacttggcttcgctaacaccgagattcacgcaaataccatcactgaattacaacacacaagctggcatcattgtaagacgtacacaacgagccacacacacacgagtgcgtcatctggagaacacaatcgagcgcaggtgacaaaacgacggcccatcacccaaccacgtcgaggagacgcgccagctgcaccacaccatggggccatcgcaccaagcggtgcacaacgggaaacagcgctgctccatcgtgaggaacgaaaacaagggaccaaacaacatggcgagcagccacatcccgcacatgcaaccacacacagggaagtaagacncataacaacagcaaagcccgatggataaccgcacgacaacgcaatctgaaatagagcgacacaccataggacaaaacgccccgaaccaccaaagtgccagacccacagcacaaacacgcctagcagtgagcaacaatacacagagagacaacacagtagacgcgccctacacaacgcaagacaaagcaagatgg

SEQ ID NO: 544058 - DNA, 247 bp, Homo sapiens
aagaaagacttggtccctcttcccggatgttctacccgaaccctcacggaggccctggcccctaggtttcagagagccgagattcatgtttggacatacaccacctacaacccaggacaacgaggacattagaggtgcacccacccccgaccaatacatatcaggacgtcatactagggcactcggaagaactatggccatctatggctttctttacaccgccatgatcaacactctcgagacctca

SEQ ID NO: 544059 - DNA, 356 bp, Homo sapiens
aggatccccggttggacacacttaggccacagatatccaggcttgaggatggggctttgccatggaaactgccctcttctacccagtatttccctggttcctgtcctatcagtgtacaaataccccattttctttatccatttatctgtttgttgttggatacctatgttaatcccatatcttggatattgcgaatagcactgcaacaaacgcatggtgtagatgtctctctaatatactgatttcgtttcctttggatgaatgccaagtagtgtggttgctggattgtatggtagttctatttgtggtttttctacggagttgcatatcggtgttcaattcgtccaacccatatt

SEQ ID NO: 544060 - DNA, 381 bp, Homo sapiens
  misc_feature (33)..(33): n is a, c, g, or t
  misc_feature (76)..(76): n is a, c, g, or t
  misc_feature (155)..(155): n is a, c, g, or t
ggtcgaccgggaaatttatttcaccccgtgcgnctgtttcaggattttcccgacggccgaaagcgtgccgctaagngctggaacggttaggatagccgcctgttttagtcagtcttttttcgggagtagcccatgagcgccgtcaatcgcgcagngtggaagccgttcttcgccaatacaccgacccctacctgaaccaggacccggtcagcgccgggtgcgtacgcgccatcgacgtgcaaggtgacaaggtttcggtccagcttgagctgggctatgccgccgggctgttcaagagcggctgggcgcagatgctgcaaatggccatcgaaggcctggacggcgtcactcggccaaggtcgacatccagtgcgtgatcgc

SEQ ID NO: 544061 - DNA, 369 bp, Homo sapiens
ttgaacagctgcagtctgctcctgtgctgtaggagtaataactggttcgtgagactgtacaaaaagggcaggcatagtgtcataagagcgacacaggcatgtccaaaaagaaccacgacaaggaaaacttgtgaaacagcttgcaaaaatagaggaatctactccagtgcacgattctgctgtaaaagacgacagcgcaccagatttgatggctccccattctgaccagcatgagcacagtgacactgtgcacgtgcctgtgagctacacagactgagctccttcacccgacagttgttcagttgcgacatcagatagcttcaaaacacatgacagctttagaactgcaaatagtacaaagatgaggcg

SEQ ID NO: 544062 - DNA, 103 bp, Homo sapiens
ggatttgctggtgcagtacaactaggcttaatagggacatgcagaaaacagaaactgaaccccttccttacaccttatacaaaaattaactcaagatggaaaa

SEQ ID NO: 544063 - DNA, 349 bp, Homo sapiens
  misc_feature (24)..(24): n is a, c, g, or t
  misc_feature (26)..(26): n is a, c, g, or t
  misc_feature (35)..(36): n is a, c, g, or t
  misc_feature (55)..(55): n is a, c, g, or t
  misc_feature (87)..(87): n is a, c, g, or t
  misc_feature (283)..(283): n is a, c, g, or t
  misc_feature (316)..(316): n is a, c, g, or t
gacggtagagcggtcctgcactgntnttcaacaannttctttctttttttttttnacttttggccttttctagggccgctcccgtgncatatggaggttcccaggctaggggtcaaatgggagctgtagccacgggcctacaccagagccacagcaacgccagatccgagccatgtctgcgacctacaccacagctcgaggcaaagccagatccttaacccactgagtgaggccagggatcgaacccgtatcctcaaagacagatactagtcgggttcattanctgctgaggcatgacaggacctcctcggttttnattcttaaatggctactcagaccgctcttacgg

SEQ ID NO: 544064 - DNA, 493 bp, Homo sapiens
  misc_feature (354)..(354): n is a, c, g, or t
gggaaacacgaccgggccgcaaacttttctaatttttttcagggcggaaaaatgcgcatttttgggcaaaacatcggaagccacacatttagaaagccccgtcctgacggaccaactataatgacggagctgataaaacaagggctagggccgggctggtcccaaactgggccgggaggacactccccctgctgaacataagagacgactccaggggagccgccatcacccggcttaaaaaggagaagaaaaccgcctagacatcaatgatgccgacatctcaagtagtcgactctagaaaaaagtcccctgggaagcaaagcgcgagtaaggcactcagcggacaacatattntgatacccataaattcacaacacactaaaaagcggccgataatagcagcgccatgagggccccagaacgggccgccatatttcggtggtggcccagccgggaccaaccaaaaaaacaaggccaatggacgaatttttag

SEQ ID NO: 544065 - DNA, 148 bp, Homo sapiens
  misc_feature (92)..(92): n is a, c, g, or t
tctgatctacgacggactccccgcaccgacggggtcccacgcaacggaacgaacacttggtgactacccccctcgaccgacggactgacgcnggcctgctggtggactcacctccacggacggggaccctgcactcctcgtcgacggg

SEQ ID NO: 544066 - DNA, 126 bp, Homo sapiens
cgttcgcatgttccaagaatggaatcaggagttcgtggcaacagaattagactcttagtaaggaaaaagaagaattaattcactcaagactaacaactaaaggcctgggtctgagaacgggatccg

SEQ ID NO: 544067 - DNA, 141 bp, Homo sapiens
aaaaagagactgagagggagatcaagtgaaagggtgcaagcgaacttagtgactccttgaggtgtttgtcagttttggctttttcctccttggttgtattcttaatgaattgctctaatgaactaaatattaccctgagtt

SEQ ID NO: 544068 - DNA, 811 bp, Homo sapiens
  misc_feature (38)..(38): n is a, c, g, or t
  misc_feature (68)..(68): n is a, c, g, or t
  misc_feature (74)..(74): n is a, c, g, or t
  misc_feature (77)..(78): n is a, c, g, or t
  misc_feature (83)..(83): n is a, c, g, or t
  misc_feature (86)..(86): n is a, c, g, or t
  misc_feature (88)..(88): n is a, c, g, or t
  misc_feature (116)..(116): n is a, c, g, or t
  misc_feature (188)..(188): n is a, c, g, or t
  misc_feature (677)..(677): n is a, c, g, or t
  misc_feature (777)..(777): n is a, c, g, or t
tctctaattaccaccgctacagctattgtaaaaggggntgagttcttgacttgattctccacttgggngctggnggnntatanaananctactgatttgtgtacattaatcttgtntctggaaacgttgttgaattattttatcagttctcagagctttctggaggagtccttagagttttcaaggtnctgcaggggcagtccacttccttcatagagtctgtggggggggttgggattgctggtttgttcttgcagtcaatctggagctaaaattcaccatgcgagcctccacacactgctctgtgctggagctgcaatctagtcctgcttcccatccgccatgatgatctctaccctcccaagagagaatttaattcagggaactgattatacaagagatggagaagccaaacaggagaattggagaacccaacagttttcaacatgaggaagtcactctcaactctaggctggaaagacaaagagaggagacagtgttattggagcccaggtgttgggttccataggatctcatgtcatggcggggctatttgatggggctagagtcatgaataatatgtagccattgaagggagacccacctgatgcagaaaatggagaaaaactggccgctccatgctcctgggttctaatctcctgtgtttctggctgtgnggggaaccaagatgggcacaaatgggagcttatctaggaatttcgatctcaggggtgcacctgtggttttatgagggcgcacagaggataatgagggatncttctagggaaataattccttccaagcacccttt

SEQ ID NO: 544069 - DNA, 946 bp, Homo sapiens
cttgatatccccggacatgtcgcagcgctgtcagtggcattgtgcccgattgccggcatcacctctccggaacaatgtatgctggggtaccgctcctggctggggaccagttgcatgggtcgctcacgcttccgccggccatatctggttccccgcgcccgtttgttgccccgctcggggccactgatttgtctgcctctttgccccagggcctctgtctttccccgggggcccgcagcggtgtgtgccgactctcgccctggtgccgtggtgtccaccaccccgtgtggtctgggttggccctgccccgtgtctgccataaagggctggttgtggccccccataatgggggctcgcttccccgtggtgtgccccccgtgtcttcgcgggcggcaccccttggtccccacgatttgcgccgccagacccattgttctaacgtggcgatatctccgatggcggcgttgaattgtacttgtctgtgtcgcccccagcacgaacgtgtctgtctggccgctagtctccgcgcgggatgcgccctcagcgcgtgtatctcggggcgacgttccccccgagagccctacgccccctcgtaacttatctctttctctctcgtgaggagtacacaaccatattttcctgaacaccccgtcgaatcttcataatattttcacacgatattaaccaaaccctcttctctgttcggacccgaaacattctctcgatcttgtataagaaccctcccacccacaccctcggggacggacctaacatggagtcacccccccccctcatccacctcactctcttcctgaacaacccctataatcaattaaaattctcggacaccaaaacaagcagagggaccacccccccccaccgggtttctcccccccccctggccccccaagattttttctcaaaacaaaaaccacaaacaaaaaaa

SEQ ID NO: 544070 - DNA, 232 bp, Homo sapiens
  misc_feature (189)..(189): n is a, c, g, or t
ctagaggatccccatcatggggtctggagtgctaacataggtgcttaatgtttaagacgaggtctgccgttattcgtgaaccctcagtgagcaccatcggaccgtgatagcccctgaattcattgactctgccttcttgtgcttgttcttgtccttctctgaacttggttcgcactcatcttcatcccntttcagtgaaggcatgacctgtgcttgtgttacgccccaccat

SEQ ID NO: 544071 - DNA, 1493 bp, Homo sapiens
ggctcatgcctgtaatcccaccactttgggcaggctgcaggcagcagatttgcttgcaggtcaggcagtttggcagcaccagcattggctcaaccatggatgcacaaccccatctcgtcactcaacaaagcaccaaacacaacatcagcggggcatcagtggtgcacagcctgtaagtcctcagctcactccaggcagagcttgaggcccaggcggcacatcgccttgcacactcgagggcaggcagcagggttcaccagctgcagcccacacaaatcaggcacgaattgccctaggagttggaccagacagcggaagcaccccaggtcatccaaacaaaaagaacaaacgacacacacacaacaaacagaacacaacacaacatagcttacggcgcccgacaaccagaggccccacgcaagagacagagcgacgatactccaagccacacacaacacccgccatgagacggccgcccccgagagaaacaacacagaaaaagcgagaacaaaaaagaacaaaagagtgacaacacaacaaagcaagcgagttaacacaaacaagaagacacaaacacccagggtgaaccaagaaccaccaactgcgagcagagagaggcatcaacacagaccaaccaacagagaaaacaaaagacaacacgcccactggaaggaggacaacacacccgaggagagacaagctcctaactagaaccacacaccaagcccgaagacaaatgcagaaagagaacgaacaagagacgacgcacaaccaaagctaagaagggaccacacaaacaccaagaaccaacgagcgcagagtcaacagacaacaagggagacaagagagtcaagaaaaacacaagacaaaataacaaaacagcgacacgcgacgacgggtggtacagaacaacagacacactaacgaaagagaagaagaaaacacccacacaaaaaaagaaagaaaagacaacagacaagcaaaaacaagaaatgaagaagaaagaaaagaaccaccaacagaacagaaaaatagaaaagaaaaaaagagagaaggaaaggaggaaagaacgaaaaacaagaaggaagagagaagaaagaaagaaaaacagataagaaagatcaagagagaaaaagaagaaaaaaagagagaaaaagaacgacagccaagaagagaaaaaagaggaccagaggaaggaagagacgcaaagaaacgataacaagacgagacaactacaaccgagcaacagaaagagcaacgagcaaacaagaaccaaagaaaggaagagccagagaagagaacaggaacacaaaccgaacagacgacacagagaagacagcacgaggcaagaagaaggaccaacagcaccgacgagaagcacggagagcaacgcacgcagagagaacgacagagcaagaagcaaaaacggaacaacaaaagcgagccaagcagagccagaaacagacgaagagacaccacgaacagaagcagtg

SEQ ID NO: 544072 - DNA, 262 bp, Homo sapiens
  misc_feature (9)..(9): n is a, c, g, or t
ccccccccnggggggaaattttgggggggggggggcccctcctttgggacccccccccccctgggaaaattaggggggcctttttaggggttccccccctttcgggggggggggggtttaaaacaccccagaggccccccccccggggggggggttggggccccgggaaaattcccccatttttggggggggcgggccctttttttttttttgggaacccccccccaatttgggaaaaaaaagcccccccctttttttttta

SEQ ID NO: 544073 - DNA, 188 bp, Homo sapiens
ccccatccggcgggtccctcaatttcatcactacatttatcaatatgaaacgccctgctataccctattatcaaatgacccactcttcgtctgatccgtcctaatcacagcagttcctacttctcctatctctcccagtcctagctttttcccttttttaaaaaattaacagaccgcaacctcaacac

SEQ ID NO: 544074 - DNA, 445 bp, Homo sapiens
tcccagtatcctgagcggcgcagggaggctcctggctttccaaatcttaaagtgagtagtgtcccgttccgatgaattctcacacttttcccaagcctctgcttgtgcgcgtcgccatgcccttcctcgtacgtcttcctttggcagcggtgttgttgtttggagaccatgcggagggccgcctctgtgtgagaaagacccccggcgccatggcctgggaggtgcggccagcctgggccccgcgtcctggtgcccgcggctgtgtactcgttgtccgccaggtctgctgctattcgactcttgccggggctctggcgagctgccctcctgcgaggcctggctcctggccttgctgttcgaggccggggtgctccaggccggtgtggtgcaggcaggcgtggtccaggctggcgtgttcgaggtggacgtggtgccggccgagata

SEQ ID NO: 544075 - DNA, 165 bp, Homo sapiens
acggtgtgacccacagagatgggtaatgaatgttggaacagtagcatgtaatgaataagtgggtatgaaggtagaaggctgcagtgaccccagagcctactgaaagaatggtttgcggacagaatgcccttgcacttgagactgctgttcaaaaagggtaccgag

SEQ ID NO: 544076 - DNA, 143 bp, Homo sapiens
  misc_feature (2)..(2): n is a, c, g, or t
gnccaccctagaggatcccccttacgccgcggttcagcgcgccccggtcacacccggtcgcgtcgcaatcgtgttcagcaccgggtctcccacctgtgcggggcgcatgccacactccccgggcttcgcggtcggccaggagg

SEQ ID NO: 544077 - DNA, 189 bp, Homo sapiens
gaggtatcccccaatgatggtcctcagctacttgggaagctgaggcacaagaatccttaagctcaggaggcagaggttgcagtgagccaagatggcatcactgcattccagtctaggcaacaaagcaattctgtctcaaaaataaaaaaacaggggacgggagtggtggctcacgcctgtaatccagca

SEQ ID NO: 544078 - DNA, 899 bp, Homo sapiens
agcggaaggggcagtacccaatgcgagccattttaacatggcgtgaggtatgtttcctcatcggccccgagcccgcgtggctgtgcggatggtagggatgcctaccctactgatgaagccatagtggcacgaaactagacagaatactgacgaggagccgtcgaagtgccaggaactgcttcgagtgccaggtgcaggtgggcggcccccgacgaggaggaggaggaggaggaggacgctgggccgtggttggtccgatggacgaggccgtgagttgccgtgcgtggatgctccatttcctctggctctctcttctgccgagctttgcctgggacggccgcttccgaggacgttcccggatggacccggaatctgcgccgatggctcttattctgtggggctgatccgagtcctaggcagcgttgccaggttcgcagaatcgatataccatgtgatcaggatcttatgagcatatgcataattgcaggacaggagagatgatactccttgtatgtccccagacttgaaatgtgagtgaacggagcttacagccctttgcgaagatcagcgcctgatgacttatggggttcgatttgagaggggaacattgactttaccttcactccaacgaacgtaccagcttttccaattgaatgactgcaggctataggctggttctgtatggtaacctttggccatctttaatggaacgcagaaggaaggtcgtttagaagcggaaatatgtgggtgactccaacagtgctcgataatggcctttccaacgtgccacattgcttgatgcataggtctcttcggacatgatgcatgtgccttccctttttcaacacgtgtcggtacaacaggtgatgggcgaaaattggagttacgtggaattgtgg

SEQ ID NO: 544079 - DNA, 202 bp, Homo sapiens
aaaattttagggattttcccttcaaaagcttaggccccttagaccaaagtttgccccttctacaaatattgacccaataacccccttttaaatctttaccccccctttggtgggttatgtcaaatgtaactcaggataaaaagttgttcaaataagtgattgggaccattggaatttatagattaaaaatttgttccaagga

SEQ ID NO: 544080 - DNA, 191 bp, Homo sapiens
caagaatttgggtgggaaaaaaaaaagtgggttatcaagggtgttttgaaattttctgcagcattaaagcgggggcttaataagaataagtaataataaagaaatttctaccattccatgtcagaaaaactttattgccagtttttgacattcccttacaatttgttttgagataaaattccctttccata

SEQ ID NO: 544081 - DNA, 219 bp, Homo sapiens
acgcgcgccctccttgttggtccagaccgccacttccaagggcttgcgggtctggatcccgaggtcattgagcgtgcgcaccacttccaatccggccagcacaccgtagaccccatcaaagcgcccgccttcgggctgggtgtccaggtggctgcccatcatcaccggggcagcgtccgggtcgctcccggggcgccgggcaaacaggttgccgatggg

SEQ ID NO: 544082 - DNA, 787 bp, Homo sapiens
  misc_feature (29)..(29): n is a, c, g, or t
  misc_feature (88)..(88): n is a, c, g, or t
  misc_feature (95)..(95): n is a, c, g, or t
  misc_feature (110)..(110): n is a, c, g, or t
  misc_feature (115)..(118): n is a, c, g, or t
  misc_feature (142)..(142): n is a, c, g, or t
  misc_feature (154)..(155): n is a, c, g, or t
  misc_feature (157)..(157): n is a, c, g, or t
  misc_feature (168)..(168): n is a, c, g, or t
  misc_feature (186)..(186): n is a, c, g, or t
  misc_feature (198)..(198): n is a, c, g, or t
  misc_feature (228)..(229): n is a, c, g, or t
  misc_feature (254)..(254): n is a, c, g, or t
  misc_feature (259)..(259): n is a, c, g, or t
  misc_feature (272)..(272): n is a, c, g, or t
  misc_feature (276)..(276): n is a, c, g, or t
  misc_feature (345)..(346): n is a, c, g, or t
  misc_feature (349)..(349): n is a, c, g, or t
  misc_feature (664)..(664): n is a, c, g, or t
  misc_feature (685)..(685): n is a, c, g, or t
  misc_feature (723)..(723): n is a, c, g, or t
  misc_feature (747)..(747): n is a, c, g, or t
gctggctctcccctccctcgccaatttcngagtccagtggtggggtgcggtgtgtgcctcggtgcccgggcagacagacccccgagcngcacctnccatgggtgaggggntcttnnnnggggtgtgacccttggggtcagangaggcctcgagnngncaggcctaacngggttggcagctgccctnaagcctggggcngccccctttcccaaagggcactgcccagcnncagccagggcccggcctggccaccntcccnggtcatcggggangggnaaagtgtgctcccaggtaagccgggtcaaaccacccccaagagcctcacttttccctggtggctctgcnntgnaactgactcttagaaaccggaaacggatgagctttctagccagaaaaccggaggagatcttgacaggcacacagcatccaaaccaacagcacttctgcagccggggcccggctggcagaggggtgctgcctgctgcctgcaaatcctgccagagtcaagggtttgctttcctactggtcttcctttggctagaaaagtgacaaaactgagctgggtggggtataagttacaggggcgagagcttcagtggcctgtttatcgggaggagttggagctggagcgctcctgtggcggcggcggccggggacgtgatcncggcgcacggggactgcgctngggagcgggacttctctcaccgtggggagactgcgcanacaggcggtggtgcacattctctnggaggctgatctctggggggtggctaggcagggggcagcc

SEQ ID NO: 544083 - DNA, 585 bp, Homo sapiens
gcgtcaggatcatcatgctcacatgaattccctccctacactcccagattatacatatgaaaatattagatgagactgtgcaaaccgatgccgagtcagatatgggatagctagggctaggggtccaacagggtccgattcatatcggtattgaacacttacgcagtatactccaagaatggcagctactacacagggtgacgagatattcaaaccccagatggaagaagcagagatccgctcctcagatacaagtacctgtgataccttagctctcgattcgaggtgaggaaagcgtgaaggagggactgaagaaggcatcaaaagttgtctgtaaaatgatctcctgctttgtccttggaaatgttgaagcagttttagctcataaattgttcagataacaaatgttcaagaaattttaaatttttcacaaatttttaaacagtcagatatatgaatgaaacaaccttgtggttaaaagtttaggatcctaccatttaagggaatcgtgttcccacccatgattttcccaatgagaaacgaagtatgggccgggtgcgatggctcacacctgtaatcctagca

SEQ ID NO: 544084 - DNA, 652 bp, Homo sapiens
tgatctcgaggtcccgtcagatgcatctgagttgagtgatttagggaaagaccgcacatccaaagcatagttacctgcccacgagttctggaccggtggcttgtggcagtatagacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggacccttctgtttctcacggggtgacacatgtctttagttcctcatgttaacacgaagccagagcccacatgaactgttggatgtcttccttagaaagggtaggcatggaacattccacgaggctcatactcagtatctcattaactcatagagagattccagttgtatttgtcagctggggtgacaagaccagacaggctttccccaggccttgtgtatcccagggaggctctgcagccctggtgaagggcctaactagaagtctagagttctgatc

SEQ ID NO: 544085 - DNA, 116 bp, Homo sapiens
caggctcccgagtggctggtactataggtgtgcacgccatattgcccagctaatttttattttattttttgtaggtagagagtctcactatgttgcccaggctggtgtacaactcc

SEQ ID NO: 544086 - DNA, 394 bp, Homo sapiens
  misc_feature (171)..(171): n is a, c, g, or t
  misc_feature (347)..(347): n is a, c, g, or t
ggctgttttccaaagtggctacaacattttgcatttccaccagcatgtgtttgagggttccattttctcctcattcttgacaacatttattactccctttttaaattttagtcatcatagtgtgggtgaagaagtgtctcactgaggttttgatttgcatttccttaatgnctgatgatgtggagcctctttccatgtgtttattgactttttatatattttggagtaatatctgttcatatcctttgtccattttccatttgtttatgttcatatcctttgtccattttccatttgtttatctttcctgttgagatgtaagagtttttttatatcttttctggatnctaaaccattatatattgatttgcaagtattttattccaaaaaaaaa

SEQ ID NO: 544087 - DNA, 339 bp, Homo sapiens
aggccttggtttaggtctttccaggcctttccttcctggagccacagtgcttaaagacaggcccctggggtcagcatttgagctcagctatgatcagaaaaaagccccgttgaggttgcagtgagccaagatcacgcccctgcactccagcctgggcgacaaaaagagactccatttcaaaacaaaaacaaacaaacaaacagaaagccccgtcgagaaatgggtccagcgctgactaacggccccctcatttccccccttgacccctgggccagttgggtgggtaggttgcctcattttgcatccttttgtatccccaaatttgaaataaaagctgga

SEQ ID NO: 544088 - DNA, 1343 bp, Homo sapiens
  misc_feature (1251)..(1251): n is a, c, g, or t
gccggaagggataaaaccgcagtcgccggcctgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggattttgccgtcggcgagtacaacaaagccagcaacgacatgtaccacagccgcgcgctgcaggtggtgcgcgcccgcaagcagatcgtagctggggtgaactacttcttggacgtggagttgggccgaaccacgtgtaccaagacccagcccaacttggacaactgccccttccatgaccagccacatttgaaaaggaaagcattttgctctttccagatttacgctgtgccttggcagggcacaatgaccttgtcgaaatccacctgtcaggacgcctaggggtttgtaccgggctggcctgtgcctatcaccttttatgcacacctccccccccctgtattcccacccctggattggtggcccctgccttggggaaggtttccccatgtgcctgcaccaggagacagacaaaaaaggcagcaggcggcctttgttgctcagcaagggggtttgccctccctccttcctttttgcttttcatagccccggtgtggggtgcatacccccccccctcctgcaataaaatagtagcatcggcaaaaaaaaaaaaaagaacaaaaaaagaagaaagaaaaaaaacaaaaaacaaacagacaaaacacaattgctgggcgccccccccccccccgaaaaaacgttacaaaccacctcgggggggcgcggcggcgccccgcgagagaaacgcacacacgggccaccacgcgtcccccgaagagacccgcgggtccacaaccacagcggtgcggtggggtccctccccacccaaataaaaagacgcggccgcgggcaaacacagcagcgtgttgttccggacagcaaccaaccagcaggaggttactccggaagaacacatacaggccgggagtctacaaccaacagcggcgtcacccacaagagagcggccggccagaaatacatcaataatcacgccgcccgcccgcgtgtcgtgctagcntgacgaacagagatgcgagtcaaatagaccgacggacgctcagcaaagaacgaccagactacggatcaacaagaacgaatgaagcaacgaca

SEQ ID NO: 544089 - DNA, 252 bp, Homo sapiens
cctgaaaacaagataattgatgaaaatctagataccaggtagagaggccatcaactccttctttacccaggatgctatatccatgatttaggctctcaaggcaggagcataatagatacctatttcaaggaagaggtgtgtatatgggatgagggatatagaattaatttctagatattgacatttgaagcttgttgaaacattcaggctctacccatttattctaagacctgtgaacaagtaaactctact

SEQ ID NO: 544090 - DNA, 183 bp, Homo sapiens
tcccaaaaaaaaaaaaaaaagaaaaaaaaagaaaagaaaaagaaaaatagctttcctgggtccaatagtcttggaggacaattttccttccgctttgccctccctccttcctttttgcttttcatagccccggtgtggggtgcatacccccccccctcctgcaataaaatagtagcatcggca

SEQ ID NO: 544091 - DNA, 135 bp, Homo sapiens
cggtaccgcagtcttctcccatcagtgtgatgctgcagggctacacagtcttccctctttgtcattatctcttccaagaaacagtcatgttcctcctcttgagaaaatcaatgtccctgatgggacgaagatgcg

SEQ ID NO: 544092 - DNA, 835 bp, Homo sapiens
gccggaagggataaaaccgcagtcgccggcctgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggattttgccgtcggcgagtacaacaaagccagcaacgacatgtaccacagccgcgcgctgcaggtggtgcgcgcccgcaagcagatcgtagctggggtgaactacttcttggacgtggagttgggccgaaccacgtgtaccaagacccagcccaacttggacaactgccccttccatgaccagccacatttgaaaaggaaagcattttgctctttccagatttacgctgtgccttggcagggcacaatgaccttgtcgaaatccacctgtcaggacgcctaggggtttgtaccgggctggcctgtgcctatcaccttttatgcacacctccccccccctgtattcccacccctggattggtggcccctgccttggggaaggtttccccatgtgcctgcaccaggagacagacaaaaaaggcagcaggcggcctttgttgctcagcaagggggtttgccctccctccttcctttttgcttttcatagccccggtgtggggtgcatacccccccccctcctgcaataaaatagtagcatcggca

SEQ ID NO: 544093 - DNA, 824 bp, Homo sapiens
ggctggtacgctccgggtacgggatctcggtatcgcagcgggtcctctctatctagctcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggattttgccgtcggcgagtacaacaaagccagcaacgacatgtaccacagccgcgcgctgcaggtggtgcgcgcccgcaagcagatcgtagctggggtgaactacttcttggacgtggagttgggccgaaccacgtgtaccaagacccagcccaacttggacaactgccccttccatgaccagccacatttgaaaaggaaagcattttgctctttccagatttacgctgtgccttggcagggcacaatgaccttgtcgaaatccacctgtcaggacgcctaggggtttgtaccgggctggcctgtgcctatcaccttttatgcacacctccccccccctgtattcccacccctggattggtggcccctgccttggggaaggtttccccatgtgcctgcaccaggagacagacaaaaaaggcagcaggcggcctttgttgctcagcaagggggtttgccctccctccttcctttttgcttttcatagccccggtgtggggtgcatacccccccccctcctgcaataaaatagtagcatcggca

SEQ ID NO: 544094 - DNA, 1069 bp, Homo sapiens
tcttcttaatgcgtcgccaggcacgacgccacactccgctcagacacaatggggaacggtgaaggtcggacgctcaacgcgatttggtcgtactcgggctgccatggtcaccagggaatgctcactaactctggtaaacgtggactattgtcgccatcaatgacccctatcattgacctcaacatacatggtttacactgtaccaatatgattccacccactggcaacattccatggcaccagtcaaggctgagaacagggaagcttgtcatcaatggaaatcccatcaccatcttccaggagcagagatcccctccaaaatcaagtggggcgatgctggcgctgagtacgctcgtgagagtccactggcgctcttcaacaccatgcgagaacgcctggaggctcatatatgcagggagggagccaaaagggtcatcatctctgccccctctgctgatgcccacatgttcgtcatgggtgtgaaccattgaccaacgtatgacaacagcctcaagatcatacagcaatgcctcctgcaccaccaactgcttagcaaccactggaccaatgtcattcatgacaacttagcgaatccgtggaacggaatcatgaccacatgttcatgcctatcactgtcaccaagaacgactgtggatggaccctccgggcacacttgtgcgcgtgcatggccagctggcgatacaccatcaacattattccatgcaatttacatgaacgaatgcaaaagcatgatgaagaaaggtcataccctagatctagaactcgtcaaactcattgacatggacattacatagatacccaactagcaatcggataaatgtatgcataacactgcacgctctaaaactactggtacaaacataaaagacatcatccatcggttgtaaaatcgcgtccgcacgaccatcaagacactcggatacacctatagaacgtgataacagtactataagatcgccaacactccctttacacgtcctaactgaccaacacactgtcatctaatcgttaagaccaatcaacaactccgatgctacagcaacatagt

SEQ ID NO: 544095 - DNA, 1150 bp, Homo sapiens
gccggaagggataaaaccgcagtcgccggcctgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggattttgccgtcggcgagtacaacaaagccagcaacgacatgtaccacagccgcgcgctgcaggtggtgcgcgcccgcaagcagatcgtagctggggtgaactacttcttggacgtggagttgggccgaaccacgtgtaccaagacccagcccaacttggacaactgccccttccatgaccagccacatttgaaaaggaaagcattttgctctttccagatttacgctgtgccttggcagggcacaatgaccttgtcgaaatccacctgtcaggacgcctaggggtttgtaccgggctggcctgtgcctatcaccttttatgcacacctccccccccctgtattcccacccctggattggtggcccctgccttggggaaggtttccccatgtgcctgcaccaggagacagacatgcacacgccgctttgtgctcagaagagctctccttcctcctcttcatattttataacccgggtgcggtcatatcccccacttctgcataaaatagacatccggataaacaaattttaactcgtcctgaaaccctcctacctactatacctttagcaaccctttccacttctacttcaaatctctcctactctgtcaaactccagctatctaattagatcactgtactctcacaccttcactctatcattatttacgattctattaacatcttaatcgaaccccttcgctatcctccttaactagcatcaaatgcttcctaactgacctttatcatcctatactactatctttcccgccagtaatttctaagcccttcgtctccactcactaagactttgactcctttctgacatactcccccgcttagttcgtctttgctttc

SEQ ID NO: 544096 - DNA, 215 bp, Homo sapiens
tagttttagaagtttcaattagcagcacaacacacacgatatcgttcagctcctagcaccacatctgccctggtggaagaacctaccagctactacagcagcccgggctcaatggcagcaacacactttcctgagagctccacaacctcaggccgtagtgaggaatcaacagcatccccaggcagcaaggtgctatggaaacttctaaaagtagg

SEQ ID NO: 544097 - DNA, 847 bp, Homo sapiens
gcaccacaactgaggatcctgtgggtggagaccctgcttgccctcctgatggcgggcctgatgcagcagcctcgggctgccacgagcgaacctgagagatggccaagacgcatcccggacccagggcaactggcactgtgacggagctcccctagcggccgtacacatgtgtccgtgaccgacctcgccaaggcaatcgcggtgtccatatgagcgcctctcgcattattcaattcccctgtgggccagatgtcattcacctgttgatctgtgcgggcatcctcccggagcaccgaagaacaaacgctgccaaaggaagcgtagcgggcactggcaatcaagactccctgacaccgaatgccacatgtgagctcgtagcaaggggcacattgatctgactagctgttggacctctcggaatgcaaacacctggaatgtaacctcgaaaccaatacctaatgtcactgaaagcgtcagctgccacggtactcagcaaggattcatcttgctctagcactctccgagcttgagtccagcgacacagattcaggaaaccagggaggtactcatcttgtaatggtcgagacacgcgcgtcgagcaacaggtaatcgcctcaccttctgtgacagcatgtcgggacaaacctggaagtatcgaggaaagttgcccctggggggcgaacactgttctttttgtgctcaacaagcagggcgaaagactctgaggactctgatgccacatccttcctccgcgcagagtccaagaacccagagcttgcggattcaaaccgaactgtacacggggggaccaaacggcccggaacaagtgccaatccaaccgggaccg

SEQ ID NO: 544098 - DNA, 141 bp, Homo sapiens
atcacaagctggaatcacgcagtcctgttaaaactgcgaccttctagaagcccctaaggtctgattaaacaagttccttggaaataactgttccatgtcaccaagaaaacagaaaacagaaaaatacagcaccttgtggag

SEQ ID NO: 544099 - DNA, 350 bp, Homo sapiens
  misc_feature (350)..(350): n is a, c, g, or t
tttatctcctgatcggctgggactataggcacctgccaccactcctacccaggaacctgtatgtttaaaaagttcctcagtacgctcttgcctctggcaacctagaagaggaatttgaccctgcccacaatccctctttccctttccaaactgttctcagaaaagcagctctacaagaatgatagcaaatccaataatgtatctgggttgatttcccagaaattcatcccagcacagcatggaagttacttatatacctattatactttcagaacccttcagacagtcaacatggatgaaggctaataatttgattaccatatataactaggaatagtgacatctgtttn

SEQ ID NO: 544100 - DNA, 138 bp, Homo sapiens
taagtactctaagatccctcgatcgacgtctcgaacactgtatacggtgtgagattagtgtcatactaaatgtccaatgtccgcgattctctaagttagcaaaagtcatcatttagaggtttataaggacgagtcagc

SEQ ID NO: 544101 - DNA, 369 bp, Homo sapiens
ctcacttcgaggagagtcaggatgtttgcgcaaactatactcaggcgaaggatgacttcctcagcatgtaaagacatgaatatgcaagaaggcatcctgattactgttgcgcgctgctgctcagacttgcctagacatatccaccctagagaaacgctgtgccgctgcaaatcctgatgaatgctataccgaagcgtacgatgaatatgagcagctcggacagagcaaattccagaatgcgctattagtgcgctgcaccaagaacgtaccacaagcgtcaactccaaccgtacaggtctgaagagacctaggtacaaggggcagcacaatgatgtaacatgctgaggcagtgactgccctgtgctgatg

SEQ ID NO: 544102 - DNA, 795 bp, Homo sapiens
gcaggtgttctgggaggagggccatggtgccacagccgcctgtccaggtcctgacggcatggtctgcagtgttcctccctgcacgtgggcagtgacttgctcaagttcatggagccggtgaccatgcaggaatctgggaccttcgcctttctggaccccaaaggtacggctccagggcaggccggctcggctgctggaccccagggccccgggtggggtggggggtcaccttcaggactgtgaggggaggggcagcagggagaccccagggaccagagcccagccaggggctcgccatgccctgtgctgctggggaagccccctctgccctctgcctccctggggacagagtggcacagagcagcgtccatggggttcccgaacttccgacacctgaaggcctcccctgctgcccttggctgggaagggacccggtggccacagggaggctgcccttgtgagccccgacccacgcccctctgtgggggcaggaagtgcagtgtgcccctgcgtgtcccccagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtagcgtaggagcgggggccagagcaggtgcgtgtatgaggccctgtgcaacaacagctccgagtgcccgacgacccgtcatcacaggatccaacctgaacgggaccccggggaggggg

SEQ ID NO: 544103 - DNA, 972 bp, Homo sapiens
cggacgcgtgggtcggagcctctctgcctggctgccagtctggaaagtgaggagcgtctctgcccggcgccatcgtctgagatgtggggtgcgcctctgccccgcgcccattgtctgagatgtggggagcacctctgccctgccgcccgtctgggaggtgaggagcgtctctgcctggcaaccgcccgtctgagaagtgaggagcgtctccgcccggcagccacaccgtctgggagggaggtggggggggatcagcccccgcctggcagccaccccgtctgggaggtgaggggcgcctctgcccggccgcccctactgggaagtgaggagcccctctgccggccgcaccccgtctgggaggtgtactcaacagctcattgagaaggggccatgatgacaatggcggttttgtggaatagaaaggggggaaaggtggggaaaagattgagaactcggatggttgccatgtctgtgtagaaagaggtagacactgggagactttttcattatgttctgtactagaaaacattcttctgccttgggatcctgttgatctgtgaccttaccctcaatccttgtgctctctgaaaaatgtgctgtgttcactcagggttgaatggattagggtggtgcaacgatgtgctttgttaggcagctgctgaaagcaagaggctacgcctaagatattaaccattcgcttatctcagttaccaggaccccaacacctgcgaaggccgcacggactctggtaggataccaacaacttgatcctcatcgtgacttcctcctatgtctgtgaacctgccaatcccttggcaaccacccgattgttctaatacatgcattagagcacacaagggggcgcagaatgccaggcacaccaccccttgccaagtccaacgaactaactctccttaacgcgtcagctgctagactcggcagcaacgagctgacatcgcgactcggcggcca

SEQ ID NO: 544104 - DNA, 814 bp, Homo sapiens
cttgcaggaattaaggatgtgatgtagattcgtggggacagatgatgggtgattggaacttggaagatagtttgagtttactctacatatcttttaaaagtccttacattctccttaattgtgtgtttagtaattagttttcttgacgttttggctataagattttgtgtaatttcttgaatttggtgttttctagaatgttctaaaagccactgttgatttagttggtaaatatgtttacaaaattagcgatgtaaaattatgtatagcagaggagcctgctatagtttatagatcatagctttctaaacctctagacgttgaaatttgggtgacttctttattacagaaactaagatatgttaatgggtcttgaagtctttgtattaagaccttgtaatttagagacatttgtaatgtgtgtttctcacctcatgctgaagggtgactccctgtaacatgccaccgaagattttttttaaacacttggttctttcttgtgtgttaactttgctaagccagaattaagactcggatatgataaagtgatgatctaactttagcgtttgccacagtatgatgcaccaagaagccataagactgacatagagtaaatgggctctagatagcatatatgtgtaattgctgacaaatgtgtgctgtgtgcgcgtgtgtgtgtgtgtacattgtgtacccccaatgtatacgaccagatcttaaaaatgtatgaaatggctagaagtccacagtgtttgacaaatgttacgtaacctgccaaagttctgatggccatacgcttggtgttgaattattt

SEQ ID NO: 544105 - DNA, 174 bp, Homo sapiens
tcatatttatactctcaacgcttaccttcctgtacgcttatactatcctcaacgcttatactctcaacgctttatacttcctcaacgctatatacttctcattctcatattcccggtatagaagtataaagcgtagagaagtatgaagctattgaggaagtataaagcgttgag

SEQ ID NO: 544106 - DNA, 484 bp, Homo sapiens
  misc_feature (223)..(223): n is a, c, g, or t
  misc_feature (232)..(232): n is a, c, g, or t
  misc_feature (243)..(243): n is a, c, g, or t
  misc_feature (251)..(251): n is a, c, g, or t
  misc_feature (256)..(256): n is a, c, g, or t
  misc_feature (272)..(273): n is a, c, g, or t
  misc_feature (279)..(280): n is a, c, g, or t
  misc_feature (294)..(294): n is a, c, g, or t
  misc_feature (367)..(367): n is a, c, g, or t
  misc_feature (393)..(393): n is a, c, g, or t
  misc_feature (410)..(410): n is a, c, g, or t
  misc_feature (446)..(446): n is a, c, g, or t
  misc_feature (473)..(474): n is a, c, g, or t
  misc_feature (476)..(476): n is a, c, g, or t
gaaggtcaaccctctcgttgtattcaggaggtcagaacagagcgaccagtcccttcaaagtgtgggggaaaagtagctccaggtcaccatatgaggaaggtgcaggaaggaaagcaaatgagaataaagtaggtgggatgaatgcccccaaaggccaaattgggaactctaacggtggtgcaggaagcggagggaacatagaccgctggaagagtcagatagnaaagatggnaaaaaggatcnagactccngatcngcgcctgagccaaagnnacctgnngaaaatccagcttntaagttcagttttgcaagcaagtatgctgctctctctgttgatggtgaagatgaaaatgagggagaagattangccgaatagacctttacatcctgggnttttttcctagtttctntcccccctggaacattcgagagcaaatcaaaacctntatccagacaaggcaaaataaaactcnncntttcctga

SEQ ID NO: 544107 - DNA, 1072 bp, Homo sapiens
gatactgtgactagggatgaatataacattcagatgctatgatcgtgttgattgactattgatgatgatacacgtgcgtctggcatgatgcagaatgatggagtcctttaggaaggcttcgagcttatgaggatcaagacacgcggatttcgtaacacaacgcgtaaccaggtagttcagggtcccggtttgagtcttgaagaatggattgcttcttgagcatcctgaagaagttgattaatatgacggaattgtgtcattcaaggaaggtgggagtaaggaacagtgagcaagacaatggtgataggattgtgttagttatggacatgaatttcttggtgtattacagggtgggatccaggtggctcaagtgagatgatccagaagtggactactgtgtggacgaaagaccaggattcgtgaatgattatgagcaaagataaggatggctaggcttgatcgccaaagagctggttaccttgggtagtacctagtcatcagggcattggacaagaggaggcgctatctagtctaatttgcatgcaactggtgctttggaacgtcgtgtggaccagaaaaagcgtctctgaaagaagagcattctgggaacaacccggactttgtttctcaccagtgaagccatcagatcatgggcagactaggtccaatgatgactatttctatcatgattgaaggcttttaattctctcggagcctgttcggtgaatacgaggtacgggctcccttaaataatgtttgcttaccaagggtaatacgggagggtggataacaggtattgggctgtctgggttttggaaacggcttttaagatctataacagccgggtcagaaaattgatccttaaggtagaatttcctgagtgcgggcctgttcggtacacggaagaaccaaattagttcgggttattgaatttggagaacgggtactgaaagcaccgacatttttaactatgtgggcccggtattgcacaaaaagagtgatgcgcaagataaactacaactgtgtgtagtacatgtccagcgggaaattggaagatggtcccctaagtcgg

SEQ ID NO: 544108 - DNA, 154 bp, Homo sapiens
cgagtggcttaacattttatcccaccgagatcgaaggcggccgtgcgctccatgctgcagttcgaggacgtcgccgtcgtcggactgcccgctgagagcggaaacgagtcggtggtggccgctatcctgcccaggcagggccgacccgtcaccg

SEQ ID NO: 544109 - DNA, 200 bp, Homo sapiens
cctccgccgtcgccttctctgcctcttttcatcctttctcggtttggtggtttgcaatggtaagaggtcgaatcctttttccaaccaagccgggcccttttttttttggctggggtggtttaatttttcctcggccgccgccgccaattgtggacacaagtgggggcgggtccgggcctttacccctctgtcgtcttctc

SEQ ID NO: 544110 - DNA, 946 bp, Homo sapiens
  misc_feature (146)..(147): n is a, c, g, or t
gcctggtgttgtgttagtcgggctaacaagcgcagtggcgcgggggctggtgagtgcagggtgggctgggggagccagaggtggcttggatgaggtgaaaccgctgcgccctacaagcagttctggtggcctgatagcttcgatcnncgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgcctgccctacatctctcaatgtggttcgaataattacatcagagctctatcgatcactgggagatgtcctccgtgatgttgattgcccaaggctttggtgcgctctgactttcttcttggtgtatggggatgtcatctcaacacatcaatatcaagcagagcccttgagtgaaccacaggttgagacggaagctagaacaaaaatgtttctgtgatgacgatgatcttcacatgagtcatccccagcaccaaactcgttgcacgaagacaatgtggtagtggctgtggatagtaccacaacaggtaatccaaaagaagagccagggtctcgggttttgaattacctctgagctgtgtaggaggagtgataggtggagcagcactacgaaggatgtccaactcggatctggagccctcgcggccacagtctaggacaccgcataccgacgaaattatgtgcgagccccaagatgcgtgacgcggaccatgctgctgccagcgcaggagcgacacacgagaacgagtgcaacgccgaatgacaagcagcgcacgaagcacgcatacggcggcgagtgccgaacgacaaggcaagagaggatagacggagcgagcgaccgctgctctcc

SEQ ID NO: 544111 - DNA, 341 bp, Homo sapiens
ctggagctggttttctcgccagcaggtttaaaagtcatagttggggcaggcgtggtggctcatacctgtaatcccagcactttgggaggccaaggtgggtatttcacctgaagtcaggagttcgagaccagcctggccaatatggtgaaaccccaactctactaaaaatacaaaattagccgggcatagtggtgcacacctgtaataccagctacttgggaggctgaggcaggagactcgcttgaacccaggagatggaggttgtagtgagccgagatcatgccattgcactccagcctgggtgacaagagagaaaactccaggagaaaaccatgctccag

SEQ ID NO: 544112 - DNA, 180 bp, Homo sapiens
tcacagcttctttcttcagccgaggccgacgccgtctctccttgcgtgcagccatggagtgagtaaccgagttacctcgttcatccaacgtgccgtttcccgcgcctttcgcagactcgatggcgcctcatatagtggagcccatgtgggtggtgtgggatgtctgcgatgctggtggaa

SEQ ID NO: 544113 - DNA, 969 bp, Homo sapiens
  misc_feature (11)..(11): n is a, c, g, or t
  misc_feature (79)..(79): n is a, c, g, or t
  misc_feature (154)..(154): n is a, c, g, or t
  misc_feature (180)..(180): n is a, c, g, or t
  misc_feature (200)..(200): n is a, c, g, or t
  misc_feature (205)..(205): n is a, c, g, or t
  misc_feature (239)..(239): n is a, c, g, or t
  misc_feature (256)..(256): n is a, c, g, or t
  misc_feature (297)..(297): n is a, c, g, or t
  misc_feature (310)..(310): n is a, c, g, or t
  misc_feature (354)..(354): n is a, c, g, or t
  misc_feature (380)..(380): n is a, c, g, or t
  misc_feature (428)..(428): n is a, c, g, or t
  misc_feature (437)..(437): n is a, c, g, or t
  misc_feature (491)..(491): n is a, c, g, or t
  misc_feature (585)..(585): n is a, c, g, or t
  misc_feature (640)..(640): n is a, c, g, or t
  misc_feature (645)..(645): n is a, c, g, or t
  misc_feature (688)..(689): n is a, c, g, or t
  misc_feature (770)..(770): n is a, c, g, or t
  misc_feature (835)..(835): n is a, c, g, or t
  misc_feature (860)..(860): n is a, c, g, or t
  misc_feature (881)..(881): n is a, c, g, or t
  misc_feature (897)..(897): n is a, c, g, or t
  misc_feature (900)..(900): n is a, c, g, or t
  misc_feature (926)..(926): n is a, c, g, or t
actgatagtcnataggctcagagtgcaaataaacagtgtaggaatgcagcgactgacatttctaaagtacaaaacaganaaaattcttagaagatacatgcaaaaagctctactaagcagatggccacagaactagaacattgataatttgacnggcgatgtcaataggactccagatgnttccaaacccaacttgaacnctcancggaggctttgtattttgcttttccagtttcacnaatgacacaaacatgantcaaatcccggaagtattcattaaaggcaagggcatatccnacaacaaacttgnctggaatttcaaatccaacaaagtctggcttatatccaacactncggggggtccttttcaccagccagcntgcgaccttgaccatcgctggattagactgcctgaccaaggaaagcanagtctgcantgttttgccagtgtcaattatatcttccacaatccagacattctttccagtganaggtgagagatcatctccaccaattacttttatgtcccctgttgactggtcattacaatagctcttcagtctgataaaatctacagtcataggnatggatctatcactatttctattcagtgctttgatgttaatccagcaggtcagcnaagantttatagccccccttgagcacacagagggctacaatgtgaaannctcccatctccttcatcacatctcgagcgagacgttcagtcctgtccataattagtccatgaggtataaacaccctttccnaatcctcagcataatgattaggtatgcgaaataaatcaaggtcataacctggttcatcatcactnaatcacgacgcgagggctgcgggtngccataacggagccggccggngcgcgggctgactgcncangaggaggaagccggtggcgaacagangaagaggcggagcgcacaagaggcggcgcgcgcgggaaaccga

SEQ ID NO: 544114 - DNA, 187 bp, Homo sapiens
  misc_feature (187)..(187): n is a, c, g, or t
gctccaccttactaccagacaaccttaggccaaaccatttacccaaataaggtataggcgatagaaattgaaaccaggcgcaataaatatagtaccccagggaaagagtgaaaaattataaccaggctaatatgagcagggctaaacccctataacctgctgcaaaatgaattaacggaaataactn

SEQ ID NO: 544115 - DNA, 343 bp, Homo sapiens
  misc_feature (238)..(238): n is a, c, g, or t
  misc_feature (288)..(288): n is a, c, g, or t
  misc_feature (335)..(335): n is a, c, g, or t
  misc_feature (342)..(342): n is a, c, g, or t
cttgtgaagaagccagcccatgacattttcctgctcctctctcatgagcccttagcagagaatcaaaaccatgcctggccgaaggggtacttccaggtcaggggaaatttcagtcccccatctccatcatgaacatggcagccccaaagtgagcaaggccaaacagggttttccacccccagcctcttatggtgccccaccccttttgtactgtctcccaccccccatctttgatggnattcccatcaactctcagaactgtgtggggtttccctggggccttgtganatccatgatgttgaaaaggcctacctgtcagtttgttagggcagganggatcang

SEQ ID NO: 544116 - DNA, 686 bp, Homo sapiens
acgggcggcggactagtgcacagagctgcgggagcagtgcacagtggatgtgtggagcctggcggcgtggacggcgtggatcctggttggagccggagtcccgccgatgtgtgggtgctggagtgtggagtggtgcccgtgcgagtgcctgcgatgaatgcctgagcggcgatggaccaggctggcgctggcgtgcctggcccctgggagtgagtgcttccagtgctggccgtgcagctggctgctgctgggcagtgacagatcatcatgaaaagcccttactgatgtgaaaaactgtgtctcaacaaaaacatcagctgcagatcttgtgacagaaacagatcaccttgtggcaagattataattatttctgagttgcgagagaggtttccttcacacaggttcatttgcatgaagaggccgcggcttctggggccaagtgtgtgctcacccacagcccgacgtggatcatcgaccccatcgacggcacctgcaattttgtgcacagattcccgactgtggcggttagcattggatttgctgtcgacaagagcttgaattcggaggtgatttaccacttgcacagaaggagcggctgtacacggggccgggcggggtccggggcgccttctgcaagtggacagcggctccgggtctccggggagcacagatctctcaaaggcctt

SEQ ID NO: 544117 - DNA, 482 bp, Homo sapiens
  misc_feature (19)..(19): n is a, c, g, or t
  misc_feature (60)..(60): n is a, c, g, or t
  misc_feature (74)..(74): n is a, c, g, or t
  misc_feature (86)..(86): n is a, c, g, or t
  misc_feature (432)..(432): n is a, c, g, or t
  misc_feature (472)..(472): n is a, c, g, or t
cccatgggtgggtggttancagcagaaaaaacaaaaaattcataaaaaaccctcttcctnagcttttatagttncttccccccaantcccagctggaaaagttgggataagccccaggaggattcttccccatcttacagagagaataactgaggcaacaaaaagcagagagctggctgggtgcaagtgctcatgcctgtaatcccagtgatttgggaggctgaggcaggaggattgcttgatcccgggagttcaggatcaacctgggcaacatggtgagctcccgtctctaccaaaaataaaaatttaggtgggtgtgctggctgtggtcccagctgctcaggagactgaggtgggatgatcatttgagcccaggagattgagctccagtgagccgtgatcacgccactgtactccagcctgagcaacagnaaggctccctcaaaaaagaaaaaagaatgcttttgtgggncctaaattta

SEQ ID NO: 544118 - DNA, 233 bp, Homo sapiens
  misc_feature (171)..(171): n is a, c, g, or t
  misc_feature (204)..(204): n is a, c, g, or t
  misc_feature (219)..(219): n is a, c, g, or t
cctccccccaccctcttcacccttgtttgtttcccccagcactcagaaaccagttctactatttacttcatctgctcaggtcagagacctccagaggtcatgaactcttgctccctcctatatccccccttccctgcccccgccccagggagtacgtaaagttcctcaccnctgttgtctcctgtcctctcttgtttcaagcanaactggattgcaganatgtacgtcgaagc

SEQ ID NO: 544119 - DNA, 147 bp, Homo sapiens
cttgaaaaacttttcctctgtgaaaagtggcccttcagttttgttaggaaacccaggaactgttttatatgatctcaagattttaattcatttctagtgctacactatgtgaatgagtgaattgtaggctttaatcatttttttaaa

SEQ ID NO: 544120 - DNA, 839 bp, Homo sapiens
aacagatgaggcgaaggaggacggagaggaggcagaaggctctgggctcctctgaaaataaattaaacatacttaatttacaatataaaaatcataatatacacatataagaaataaaaagaagtctcagttgcagctatttgtcaaacattaatatccatttctttttatataccggtgaatatggcgcaataatagatctggatttgaaccaccttaatgaagcggcaacacccaggtgtttgaggtgtggcatccttcgctgatttggctgtccccaatgtttcacattatttaatcttgcaaaaatggttctgtgcacctgtggatgtgaaatgctgtccagtatattatataatgtggttatcctgtggatgtacaaaaaattcagaaaatgatctctgtagatatctgtataattggtggtcatcttagaagttatcaggaatgtgtttaacaccaagaagagaacttttttaaggaatgatacatagaaaaagattttatttacaactgagtgtgtaaagcttgggtttcccttgtgctggcaggcaatctggcccaaggtttacttgcaaatgggaccccattttgtattgttcagaaaaaacgaccacagacacagcacagcaaggcccactcggcgaacagcacagaaaacaaggggttgccgttttactaacacccccttgcagctgggtgtggcagcgcccggtaatccccaacataatggcagcacacctcctagtggagggcaaacaggctccagaggggccattttgacggcgacaggtgcgctaccggcccggacccacagaagtgggagtttcgataaaggg

SEQ ID NO: 544121 - DNA, 113 bp, Homo sapiens
cccccccccccccccaaggggttgggggcttttttttaggcccctccccccccctttcctgggggggggggggggggttttttttttccccccccccccccccccttttttta

SEQ ID NO: 544122 - DNA, 102 bp, Homo sapiens
caagtcaaagttggcattcccatcctgggggaccctgatgtgtctaaagcgggagatggtgttgatgtacggtgccatctggtcctccggtaccttcttcat

SEQ ID NO: 544123 - DNA, 205 bp, Homo sapiens
ctagaggctcttctaggcgatcgacgccatccacgtgcgcgtgcggagccacacgagcttgaggaactccattctgcatggcataccatggcagctttacaactatgtggcgaccatgcctgacaattccatagtgcttatggcatgcaagggaagatacgtctccagaggtccatggaccaaaatgccgggaaagccttgagca

SEQ ID NO: 544124 - DNA, 483 bp, Homo sapiens
ttcttattcatttaaaatcctgttctttctgtatgactcatacagaagtcctttattgattgtccttatcctgacaacgaattttttcagggaagataaacttcaccggaaaatatttttctggtcgtccgaataacagatgcgcgtaacgtcgtggcatcctgaccttcattacttaaatgaacgtcgagcgcaccactggggtgttcaatattgatattgccgtatcctacagaagggacgatttgtcgggtgacggtgccttccaatgcacaactactggaaatagcaatagcaccggttatcgccagcgcgcgatggcaagaatgcggcataaaataacgcacattaattgccccgcctttctgcgctggagaaataagcacaggtttagggataaccatattactgacatcacctaagcccattgctttacccgcttgtagacggatagattcaatgcgggctaataatgctttgtcg

SEQ ID NO: 544125 - DNA, 374 bp, Homo sapiens
  misc_feature (313)..(313): n is a, c, g, or t
atacggttagcgtcaacgtttacagctgatgacttaccagttgtagccaatgagctgtcgacaatcttgttgtaaaccccagatgaaacataagcagttacgttttctgttgctaattcaagttgtgttaccttgtcatcagcttcattaaacaatgcttgaacgtcttttccgtctgctgtcaaagctgtaccagcagcaaccaatgcagcaccataagcaacgttagaacgttggataagtgcttgtgcatgtttaaccattcgatcagtaacggcagcttgcaagtcagcgttgacagtgtagcggtcangaccttcatgatagcccaggagagttataggacagttgtgtcagcgtaaatcacttcttgc

SEQ ID NO: 544126 - DNA, 381 bp, Homo sapiens
agaggggcagcaatttgctgaaggtgtaaatgcgcagatgctgcaacacgcggaaagtcgcgtcgtgacttaccagacgttcaaaatagcgcaccactggggtgttcaatattgatattgccgtatcctacagaagggacgatttgtcgggtgacggtgccttccaatgcacaactactggaaatagcaatagcaccggttatcgccagcgcgcgatggcaagaatgcggcataaaataacgcacattaattgccccgcctttctgcgctggagaaataagcacaggtttagggataaccatattactgacatcacctaagcccattgctttacccgcttgtagacggatagattcaatgcgggctaataatgctttgtcg

SEQ ID NO: 544127 - DNA, 360 bp, Homo sapiens
atgcttcatgcttggcctagatgtcagagctgccttcgctatgattatcttgcaagttctgcattattgctagtgggttgtgctacaaattgagtattggtagtcagtcaataaaacctgtgccttaggtagtcatccgacatgctgatggtattcttcaatttgttaaatagcattggatacagagcaggactcaattctagacccaccagatccttaacattggtccgtatttgaagtcccactttctcatggttacacaccattaaggacaacagccgatccataaatttgctgacaggtgtatctgcgtttccctctgaagacatcactgaaatcatagaacccttacgttcactg

SEQ ID NO: 544128 - DNA, 688 bp, Homo sapiens
agcggcttctctgcccagtggacgccggcgagaaagcatcgtgaaagtctctcttcaccctgaccgtcctgtctaagtcagagtctcctaacagagccctgaccacagctgaggaagctcttcgttggagggtctgagccttctgacacactaactgcatgagagcctgaggagccatttggagcaatggggaactgctcactggactgtgtggtaatgagagatccaaagatcatgcgctccagggcttagggtttgtcactatatgccagctgtggaggaggtggattgcaggctagtgaatgcatatgccataatcacaggtgtcatggaagagtcgtggaaggcaattacgagagctgtctccaggagacatgacttctcaaaagacacagtgtgcccaacttaactgtgatacaagatctttgtcggtggcattaacagaagacactgaagaacatcatgcctaagagtattatttagacagcagttactggtaaaattgacagtgcattgacagatcatgactgaccgtaggcagttggctcatgaaaaggggcttggcccgtttgtaacctttgacgaccatgactcccgtggactacagattgaccagtcagaaataccatactggtgaatggcctacgacctgtgaagtttcgaaaaagcctgtcacagcgaagaaatg

SEQ ID NO: 544129 - DNA, 468 bp, Homo sapiens
cgggaggattcatgagaatgaaactggccggcttttttatgggttaaaaggcctttgggaagaaatcaggggatactggatttggtcccggcaatgaaagtttaaaggctgtaccaatcctttaatatgaaatgggggaaagaatggagagcagccgtaaaagaaatatctaggggaaaaacaagaagcggattggagcttggactaaaatttcttcttgggattaaagagacaagtttatcacagaattttttttctgctggcctattgctataccaatggatgtgagtggcattttttttttaggttttcattaaccctcttaacattttttggagatgacatttctgattttcagaaattaaccataaatccagaagcacgatttcgaaagctgagaaccctggacaggtgatcaagtttacctatgggggctctgcctttaactagagggggggaaggcagacc

SEQ ID NO: 544130 - DNA, 220 bp, Homo sapiens
tgatagagtcttaaccagaggaatcaggcagttggcaggaacacttcaaagcagtgtgatcctcagtcgatgcccaactggaacttactttatcccctctttaattctatttctttatcttttctttatatttttttggaaacagggcctcactactgatgcctaggcggacgttgcaggggtgaaatcacagcttcactgcaaccttagaacccctcga

SEQ ID NO: 544131 - DNA, 782 bp, Homo sapiens
accacgcgtccgatcccagcacttaactgggaggccaagggcaggagagttgcttgagcccagaagtttgagaccagcctgggccacatgatgaaaccctgtctctacaaaaaatagaattacctggggcgtggtgacacattcctgtagtcccagctttccagggaggctgagatgggagaatctcttggagcccaggaggcctgagggctagcaagtgagccatgacttgtgccaataggcactccaggctgggtgacagagaagaacaaaaccaaaactttaaacttcatattaccttgaggcatattctcatatttcaaaccacaacgaggtcctcttccggtacctatggacttctagggagtccaagactaggatctccttggatacggaagggaggatgtgcaagaacaaaactggacgaagggccttactggtgaggccagggaaatggtggagaacaatggggatactggtcccttcaatcaagcatggtcctattttcccctttaaagtcccggtaacaatctctggtttacttcctagagggccaggcatagaatagcaacaggttcggagctgtggatcaatacttggtgacttgtcacaggactcttcctacagggactggctgccctgattactctggctctgaactttctcatatattacagtactgaatgatgatgggcatgtcacatgaacttgtccaaatattgggtaccaaggccaggatccgaggcaatactggcatgtcccaatagccacagtacggatgg

SEQ ID NO: 544132 - DNA, 170 bp, Homo sapiens
agaggaagttagtcgctgatggcgatccttcaaagctgaactgaatgagtttctctcactcgtggaggcgtggactgaagatggctactctgtgagtttgaggtgcgagttacatccaaccaggacagtaaatcattatcttacgcgcaccagaacacagaatgttcttg

SEQ ID NO: 544133 - DNA, 117 bp, Homo sapiens
aggctgagaaaagagccaaatgaaaagcaaaaaaaaagaggaagaaacagcagaaacgcagtctcaggtaacccagcaaatatggctcgactaatatcgactggcctaacgcgtcag

SEQ ID NO: 544134 - DNA, 124 bp, Homo sapiens
catttaactgcatatacgaaaacaagtcagacttactggaaattaaattacctatcccatgttttcagtgggaaatgaactacattttgagatgctcacagaaaactgcctcttacagtatgaa

SEQ ID NO: 544135 - DNA, 910 bp, Homo sapiens
gctgagacagggaggtcaccaacgggagaacctgctggactttcatctaaacacaatccagctgccccttgtcattgatgttcaccgagcagagtgtgtctgactatgatcggcaaactgacgtcaacttcaaaacaggagccgagagcttcaaggggcaaagatccttgttcagtctatcatcagacatgcagaccacaccgacaaccagacgcattcctcgaggttctttggcctgaacgaaggaaagagtgcccggccgtgcgcctcatcacccttggaggaggagatgacctaatgtacatatgccctgaatcaggaggagctagactggcatgcatgtggatcacagagttctgccaccggcttcctggagggcaaaatcaagccccagcctgatgagcctagtgagctagccagtgaggactgcggacaaggcagcctgtcaacggctgctctgtgtagggtacagaacttctcgaagtacgtgagcgtatttgatgagaaacaccaacagtctcttgtaggagttctatgccccatggtgatggtcactgcaacacagcctcgtgctcgccattcttgggatacacatctggtgactaggaccgtacaaagggacccactgtactaatcattcgctcactcggccaaagattcggaactcgtactgtggcaagcgaggtctgggagtgcctgtcagaaggtgtcagcatgattcccctagagctcaacgttcttttcgctgccatgtgcccgaccagggacggtcatcgagtaacaacggtggaacgacacgctggactgcgtgctaaggaaattcctgcgacagcaggtgcgccaggattggtggcaggggcatgatggacgaagcatcgagggacacctggaagaaagcacaaggagccaa

SEQ ID NO: 544136 - DNA, 259 bp, Homo sapiens
acggtggctcacgcatgtcatcccagcactttgtaaggcgaggtgggctgactcacccttaggtccggcgagaccggcctagccaacatgctgaaaccccgtctctactaataatacaaaaattagccaagtgtggtggcgcgcaccgtgtaatctcagctactcgggaggctagaggcctgagacttgtttgaacccaggagccagaggttgcagtgagccggagatcgtaccaccgcactccagactgggtgacaga

SEQ ID NO: 544137 - DNA, 1511 bp, Homo sapiens
gtccagcttactaccagacaacctttagccaaccgcatatctatgcgcacagatcatacagtactagcgacgactagatagactttgatagacctagggccgcgaactgagcatactacgtgaccgccagaggtgcatagagcactcgcaaaacatgatatcctaacgacattaatgatcatctaacggactcaagcccgtattaccttctgcgatcaatgatatcgagctagagagataatttctgcaaggagaacggcaagacgcttaaggacctccctgaaaggcacgaacgatgctacactacatgaaacaggtctatagacagaagcgagagccccgttctatggtagcataacataaggtgaggagagatcttactacgcgtaagaagcgcgtagagaaaccatacgcgatgccccatgggtgaagtaggacatggctctgatccccaatgtagtgaggacaatctttgagttgtcacaccatatgtaagagtcgtggccacacatggaaacccttgcttaagattcctcgcggggctaaacattttaaagcataggtataatgtaccaagaaaaaggaagggaaaacaaggagttcattttttggaagacgaacgtaaggagaagaataggaaggcattggggctaaagaaaagaaaggaagttagaaaaaatcttaagaaatcagggacaaattaggttgaaggccattagaaagaggcaacgtgcgatgcaaagtgttaccgtaagaaggcgtgtttgccaaggtcgtcgaataaaacccgcgagtgttaacccttaaaagagaacattcgcgccaaaaagaagttaattgacttggaaagcataccgtccaaagggagtgcgaaacttgggaacccagaatccttaattgcagagcccttcagtgagaacgcaacaacggtgaaggtggtatacacgtaattacaagggttacaccagtggaaggagagcaaatttccttcacgttgccgagattacaaggccctgtcgattcagtagtgtgtaacaacacaagggtcaaggatgcagaatgtaaggcaagggtccacagaatgcataactgaatcaaaggcgaaaagaaggatcatttaatttaaggcttcgaatggtgtaagaccagacaacaaagggacgatgggaccaataacgtgaaccagggtttaaacaaagaaaatacacaccaacgggagcgggacaagaccagagagtaaacacctccgaagtgggaaccacaggacgtaaggcggaataaccagagagtacaaggaacaacaaatgggaccaacaagagagaacagaactcagaaccactaagacactggacgagatgtaacaacggaatgtcatgggcacaacacggcaacaagacaacattggaaaaggacaaagacgggaggggaaaaatagcaacacaatcacgaacgaaagcaacagggagcaaacacagaaggagaaaagaaaagagagaaacaagaagaaaaa

SEQ ID NO: 544138 - DNA, 163 bp, Homo sapiens
  misc_feature (4)..(4): n is a, c, g, or t
  misc_feature (60)..(60): n is a, c, g, or t
  misc_feature (112)..(112): n is a, c, g, or t
tggnttcgaacacggcacccgcacatgccgtcaatggtgcaggcctggtatatggacgangccccgggacaccgcggcaaaccccaccgccccgaccccggccgcccagtgncatggagcagcatgcggcggctcggggtgcatctactggaagcatggatgc

SEQ ID NO: 544139 - DNA, 401 bp, Homo sapiens
  misc_feature (401)..(401): n is a, c, g, or t
ctgtagacgacgtgcacaaatgggacctcgaaaggggaaggagaagagggaggagcaggtcatcagactcggacctcaagtggctgtagggagagaatgtatttggtgtgtgcgcatatctttgcattcttcaatggcacttttgtgcatgtgactgatctttctggcaaggaaaccatttggcgtgtgacatggtgggatgaaggtaaaggcggaccgagatgaatccttaccatatgctggtatggtggctggccacagaagtggcccagaggtgcaaggagctgggtattaacggcctacacattcttcgggccacaggagggaatatgacccagacaccctgtgacctggggcccagacgggccttagagaccttggccgcttgggtatgagcgggn

SEQ ID NO: 544140 - DNA, 293 bp, Homo sapiens
  misc_feature (74)..(74): n is a, c, g, or t
  misc_feature (206)..(206): n is a, c, g, or t
  misc_feature (252)..(252): n is a, c, g, or t
gttgcgtggcgcgagcaccccacaatgctctgtcgttcagaaaaatctgtgaacggactatatccagcagggantactgcttgatccctctaaagtgtgatttgcagccacccaccgcactggaacagccctttgccataacctttgaaaaacggcgcggcaagaatgacggaaaaatccgtgagcacaaggcaaaggcttgccgngtgggcatgccgtgcccgagcgggcacggccggggacgctcagagngtggagaggaaggtgctgttgctggcttgccactcgcggat

SEQ ID NO: 544141 - DNA, 297 bp, Homo sapiens
  misc_feature (2)..(2): n is a, c, g, or t
gntctctagctgactcttgaggatcccctcgcgaacgtattatccatggagatctgagacatcctggataacacggaggaaaccccgtctctactaaaaatacaaaaaaattagccgggcgtgggggcgggcatctgtagtcccaattactcgggaggccgcagcgggagaatggcatgaacccgggaggcggatcttgcattgagccaagatcacgccactgcactccagcctgggcgacagaatgagactccatctcaaaaaaaaagaagaaaccaaggataacccgttcgcgag

SEQ ID NO: 544142 - DNA, 122 bp, Homo sapiens
ttactctgcctcccagattcgagacttggaaggaggtaataatatatagtagtaaaagaattgttagtttatctatactaataccaatatcctgtggaggaaattggcgaaaaacaaaaaaa

SEQ ID NO: 544143 - DNA, 371 bp, Homo sapiens
gatagcatttgaatccctcatgaggattgtcaaagtaagtgtatctgtgaatctacattgagcttcctaatgagaatcacaatcgcggtcaaggactagagtcacttagcattatgctgtgaacctgcgttgtggttccgccttcccccactgtgaatatggcatctcctcctgtccgtatgcacgcttgtcaacatttcatgttgggattgtcggcacaaatgctttcgttcagggtccaggcaggtgacctggtaaggtggtgggtaggtggtctctgacacctctctccaggcgacacagagtacatgatggtggttcaaagcaccaccatcgcagaccgatgatgtgtatggcaagtgacatgacag

SEQ ID NO: 544144 - DNA, 128 bp, Homo sapiens
cgatcttctaatgtgtcatcacaggctgctttatcaaaagggaaactcatgctttctattaaaatgctttttgtattgtcatacgtcactatacatctgagctttataagcgcccggggaggacaatg

SEQ ID NO: 544145 - DNA, 130 bp, Homo sapiens
catcgcctgcagttttccttcaggctgaggtgctgagatgcattgttcaggctgacgcccttttgtgtagattggggttgctgagtgacttccctgtgtgccaaggtggtgtggtaccgcagctcgaatt

SEQ ID NO: 544146 - DNA, 425 bp, Homo sapiens
gcgtcggaccccggagcacactgcaacacctagaaatgttgaataaaacataaaaggcaatcttttaaatgcataaagaaatctcaagaaagcaagaaaatacctaaggcttaggagagatatatatttttaaatgcttagaggaagttgaaattcggagttatatctaccaatgcgcatttcctcaacaaaggtgtgggcccagggagataacaggctatataatgttttcagggagctcctgtccattcactgggtcaacagttaaagctaaaatttcagaccatggtataagaaaaaaaaagtcactgaaatgactttggcaaagttcagagtcaggtcagctaccccaggctgatcttgccatcatcctgacacctgtggaacctgggccctcctctgattttcaatttggattgctctat

SEQ ID NO: 544147 - DNA, 371 bp, Homo sapiens
ttttgcctcccgcgcgtattttgtggggattttggggggaaccctttttcccgggaaccggttgtccagttttcggtttttaacgccccccataggggatttggccccccgggcccaaaatttgggccggggggcaactcatttcccggccccccttttggccctgttttcccaaccccccgggcctggaaacaaaatttttttgggcccaggggcccggggggtgggttttcccccccttgggggtggggtcctttgggaaacctttctaaggggccccccttggttcccccccggttgggttccccccccccccctttgttttttttttatttgggggggtccccaaaaagggggattttgttggggga

SEQ ID NO: 544148 - DNA, 598 bp, Homo sapiens
  misc_feature (586)..(586): n is a, c, g, or t
  misc_feature (591)..(591): n is a, c, g, or t
ggtctggctcttttgcccaggctggagtgcagtggtgcaatcatggctcactacaccctcaaccttccaggcccaggctcaagcaattatcctacctcagcctcccaagtagctaggactacaggtgcacactaccatgcccggctaatttatttgtttattttttgtaaagacggaatatccctatgttgccgaggctggtctcaaactcctggactccagggattctcctgcctcaacttcacaattcatttttaaaatttcagccacagcatagagttttgcaataaacactcacctacccaccacctagattctaacattaacattttactatgcatgctttatctcacatttgtccatctaatcttccctctatccacccataaatctaccttgctttttggatccatttcatagtaagttgcagtcatcagaaaggaaaagtaaaataagtaaatttattggtaaataggcaattgatgggagtcaaaagatatttaaatgatatcaatgaatgtcacttaaagttaaaaaatcgaatagcagaaggaggtaaagaaaaaaggaagtaaagaaaaagacntttanaatgact

SEQ ID NO: 544149 - DNA, 941 bp, Homo sapiens
  misc_feature (416)..(416): n is a, c, g, or t
  misc_feature (435)..(435): n is a, c, g, or t
  misc_feature (941)..(941): n is a, c, g, or t
ctcaactttaatgatttaatgtcatcttgccgttcccatgacacctgaagatccttcatttggggactgtgttttgctgtcacagaagaaattccaatacgaaatggtacaaagtcatgatgagttccctgagataagcaaagggaaatgagaagactgtgttgtgatcgttccgtattgcactggagataaataagagtgctctgtttagttatcaacattttattctcagcgaaaggtttgttataagagaacgagataacttttgcgccaattatggaaaaagggaatggagagttcatggttcaaggaatagctcactgggaatagcagtgtttaccctgtttcttctcctaagagttgcagttcgaacttgatacggaagggaatggcggagatcttaacagtgatagcantgctaagctgtagaacagnaatagaacaatgcatcgatataggcaaaagaggaacacagtttagaagtgcgtatcgttctcaagaggataagctagcgtcttgaaatacctgtggagtagtcctttgtgcagcagcctttgtgctctcggggaaaatggacatccatcattgacgatcatttctcgaatctattttgctagcacatgcagtggggaaaaactgctaacctggatatgttgggtgaacatttgcctgtttttaatcgtgcaagccatactcaactagttctacatcacaattcatgatcgcgtcttgatagaacgaataaaacgtctctttagagatggggctctacgtaacatggggtaccgatcaggggattgcggcatatagagccttcatcttgaggaagggggtccgacggagatgggcaagtagtgcgcgctcaaaggaagggttaacccaatggtgtcccacaacatgattatacatctgggccataagggcgttacgcctaagggaan

SEQ ID NO: 544150 - DNA, 132 bp, Homo sapiens
tctctagagagtatccccctacaaagcttcagctctttattaaacaaggaggaggtagaaaacagatacgggaacagttagggatcccttctttcccctatacattacactgacttacagaacacacgcagc

SEQ ID NO: 544151 - DNA, 223 bp, Homo sapiens
aagcagggactacaggcgcataccgccacgcctggctatattttttgtattgtagtagagacagagtttcaccatgttgcccaggctgctctcgacctcctgacctcaggttatccgcccaccttggcctcccaaagtgctgggattataggtgtgagccactgtgcccagcccagacacattttctcgaaaaattttagatcattactatttattttattat

SEQ ID NO: 544152 - DNA, 210 bp, Homo sapiens
  misc_feature (151)..(151): n is a, c, g, or t
accatgggacccgtctcaaaaaataatataagtaaatggtaaatattggtctaaccaaaataatgatccaatgaccctgggaagatgtgggaagtgtgtgggtcatgagtaggggatggaaggggaaaagagccaaaaccttttgttcttnccttaaatgggaaaacaataaaaaaatttcataaaaacccaaaaaaaattcaaggaagg

SEQ ID NO: 544153 - DNA, 417 bp, Homo sapiens
aattagcttggcacagggaaagatgaatgctaagtggaataaaaagactcctgggaacctaattaaattagaatacaactttaaccaaagaaaactgtaaggccaggcatggtggctcatgcctgtaatcccagcactttgggaggtggaggcgggaggatggcttgcatctaggagtttgagaagagcctaggcaaccttgtctctaggaaaaagaagagagccaagcacagtggtctgtacctgtagtctcaacttagtctcaactccttgggaggatcacttaggcctgggaggtggaggctgcagtgagctgtgattgcaccactgcactcagcctgggagacagagtaagattgtctctaaggaaaaaagaaagaaaaaaaagctgcagtggctaaattcatataagacaat

SEQ ID NO: 544154 - DNA, 128 bp, Homo sapiens
ttacagaacgcgacttccactaacctgtgcattttttatgtacaaccctgaccgtgaccgttggctatattcctttttctatgagataatgtgaatgataagtaaaacagctttgactttccgtatgg

SEQ ID NO: 544155 - DNA, 620 bp, Homo sapiens
  misc_feature (613)..(613): n is a, c, g, or t
ttaacatggaggtctatatcatgagaatacgcgtagaccatcctttacagtatctgcctgctataatcactcctattactgtgaggaacattttgagactccgtcaggaagttgactgctatcacattcatcgtacacaagatggatggtcgtcagcagtaccatgcctcatactatgttagtatccttatttgcaaaacggatatcatcaaaattacggaagcatgtttgttcagggtaaatctatagacgcaagctgccatcctgactacgctatgtcgcgcagaccccagacacatgtatggagaatggctgcactactactaccagatgcattccaggcgaagcatgtaccacatcaagaatggatattgcgactggatttatttctgaatctcagtatacatatgccttgaccgtaaacgcgatctatgaatgcagactaccgatatgaacatgcagacggtgaaacatcaggatcaactacatgtgcgtaagatggatggccagctcagcccacgagcacttaatcgtgggacatccccagtattatgaatgccgggactgtggctatgaaagcattactggcacccactgctacattatgggtggntactggt

SEQ ID NO: 544156 - DNA, 109 bp, Homo sapiens
tcgagacaagcgggataatcatgcccatttctcaggtgagaaagctgaggttgaggggggtcaatgaccagtccacgcctaatacaacgactcaccattctaggcctct

SEQ ID NO: 544157 - DNA, 465 bp, Homo sapiens
aaggatcctaggtgaaggagttagtgtaggtgtggtgatactgtgtgacgaagtgagtgtgaaggttgtggtgatgatggtggtgacgaagtgagtggtgaaggtggtggtgatgatggtggtgagaagatagtggtgaaggtgatggtgatggtggtgatgacagtgagtggtgagggtcatggtgatggtgatactactacgtggggctactggtggtactggtgcctgttgtactagtactggtggtactcgtactggtggtggtactacccgtacgtggtgcgggtcctggtgctggtactagtactactacgtggggctagcttctggtgctggtggtggtgctggtgcttgttgtgctggtgctggttgtgatgacagtgagttggtaagggtcatggtgatggtgatggtgatgatgatgagtggggatgattatggtgatggtggtggtgatggtga

SEQ ID NO: 544158 - DNA, 106 bp, Homo sapiens
tcgatacgactttttttgttcttttactttccttgttttccccttccctcctcccaacacacacacacacacacacacacacacacagcccttctgtcgtcttctc

SEQ ID NO: 544159 - DNA, 231 bp, Homo sapiens
aactctgagatttaaaagacctgcctggctcctatcccgacggctgagaaggaccgaggctgaggctctggtgtggtcacatacacgctgccctgtatctggactggggatggtatgagttccaagtttgtcacatgtcccatctgcaaacattctttcatcacaatcaccagcacactcagccagtcaatgcatgtgcacccggcaaatcactgtttggcagtcatcatg

SEQ ID NO: 544160 - DNA, 227 bp, Homo sapiens
  misc_feature (16)..(16): n is a, c, g, or t
  misc_feature (22)..(22): n is a, c, g, or t
  misc_feature (79)..(79): n is a, c, g, or t
  misc_feature (133)..(133): n is a, c, g, or t
  misc_feature (148)..(148): n is a, c, g, or t
  misc_feature (154)..(154): n is a, c, g, or t
ctagagatccatggtntcatcncccagatgacaggatatttgactctttggggaaggtcgaacagtcaagtcaaaaagntgaggattggagaagcagaggcaagagagatgctgggatccgggaagctaaagncaagcaggaaaaggngtctgntcagtacctgagtgagatcgagatgggcaaggccacaggagaggattaacgaacttggaaggaaggccgcctt

SEQ ID NO: 544161 - DNA, 319 bp, Homo sapiens
  misc_feature (28)..(29): n is a, c, g, or t
attcaccgcgtgtgtcaggaaataggcnnctacgctccccccacggctagcggcgccttccatcaggcttacttgccttcagtcaacgcgttgtagctggtgaacaggttgcggtagtccggaatgtgattggagaacaacgtccccaagccctcgatgtcgttgcgccagtcgcggtgcagctcacaggccaggccaaaccaggtcatcagttgcgcgccgttggccgacatgcgggcccaggcggactgttgggtcagttcgttgaaagtgccggaggcgtcggtgaccacaagcacttcaaagccttcggccaggg

SEQ ID NO: 544162 - DNA, 90 bp, Homo sapiens
ccggaacctggcgcccacgccgcgccgtcgcaaggcatccccgagccggagggcgaggcggctgggaagatgaccaccgaggagcagcag

SEQ ID NO: 544163 - DNA, 248 bp, Homo sapiens
gcagtgaagatcctggtgtcgccatgggcgggcgaccgaggcgtagtaaccggtagtttgtaagaacaagactcggacccaaagtctcgctgtctgcgcgaggtgtgccgtggatgccaatgattcggcggtcatcgactcgtagcgtggctggagagagaagggcgacacacaggtggatgcatgtctccgctttggtggccactatggatgctccgatgactatgagcagcagtctctctgaagcc

SEQ ID NO: 544164 - DNA, 130 bp, Homo sapiens
gacatttatatatgatcacaaaaatagcagagattaaaattatgttacattcaactaagccttggtaaagggcattgttcatatgcctgggtttggattgtgggcatataccaattcaggtgcattcttg

SEQ ID NO: 544165 - DNA, 404 bp, Homo sapiens
gatttgtagcaccaagtacaggttccatatccaccacagaagaaagttcattccagacctgtataagcagttgtaatactaacgaaggagcatctccttggtgccacataacttaaaagacttgttaaaagcatctactggctaaagtcagatagttctgggcagactcgttgacttccatgtcctggtcatcagaagactcatcttctgctaggacatatgcagaatctggttcccgaatcagacagaatagaactgtccccacgaaggctaatcaccgttgagggcaaaaaacactgttcttcgggcactctctgatatctgagttttcccttgcccaggcacacagtatatgtcgagatttccaaagaacaagctagactgcagacgtgcccagaaactcc

SEQ ID NO: 544166 - DNA, 693 bp, Homo sapiens
tggtacccggtaattcggccattattgccgggagtgaagtagctgttttctttttgacattgtagacatggaaggtctttaatgcaactttaaatggttcaccaaaggatgctctaacggatgacagcgatactcctacatattatctgcacatagaaccacacgatggatgtcatcctgatgacagcgctgaaaggagtgtgacctgtctgacttctgcatcagatgaaagtgaagatcagcttgacgtggacgctcatgagcatctgaccagcatatacagtgcgacggcaaagtcccaagtgtctgtgcagctcagtctgagtagtaatgaaagctgcacattgagctgcgaggctcttacagtcgagaactggcacaatacgctttgtgaagcctacagagatgaccagcacttgttgataaaggacacatacctcctgtgaactgaaggccaccatgcactatggcgactgctaagatgataccaccacgtattggttaaccttgaagctatgctatactctaattagatacaaatgaaccgtctagccctccgatactgtgataactgccctgaaccttgcttttttgcttacgttctgcagctagatccgccgcagtacatgtagaaccaactgcatggtattccagtgggatacctctacccacttgtccaacccattgtccgct

SEQ ID NO: 544167 - DNA, 895 bp, Homo sapiens
  misc_feature (309)..(309): n is a, c, g, or t
  misc_feature (377)..(377): n is a, c, g, or t
  misc_feature (381)..(381): n is a, c, g, or t
cgtgcggctggtgctgagaggcatgggcgggcttcggtatgggcgtggtatgaccgagatcaacaaaatatgtctaatgtaataacaacacaagttcacagatttacagtgaactcgactctacaagcttcacagatccatggcggtggttcaatagatctattcctacggggaagtaagaagttgcagctcagtgcacataaagttgagacagagatggagacatccagccccacctctcgggaaccaagaaagatgacgggggaggaaacacaggtcagcatgggaacaggggctcacagcggacangggggtgggctgtctctccacctcctcacattaggctaacagggacgcagacacattcaggtgccttngcanaaagagatgccagaggctcttgaagtcacaaaggggaggagtgaagaaatccggcatctcagtccctcacaagacagctgtctcaggcttttcaagctgtgagagactcatcagagcccggggcacggtggctggacgcagcctgagagcagctccctccttttccactccatctcagggtgaggggctccggcagcccctcgtgctgaacagggcacgtgtatctctgctcttctccagaaggcaccaccacagctgcccacttcgggagggtccatctcctgcgggccgggtctccacaagctcggtgtcctgagtttgggtcctccccatcccactgccaggtcagtgtgatctccgcagggtagaagcccagggcccagcacctcagggttggcctcatggtcagagacgggatggtgggtcacgtgtgtctaggggtgtgccgcgcgcggcagcgtctccttcccgttctccaggtatcggcggagccactccaggcacgtgccctcca

SEQ ID NO: 544168 - DNA, 923 bp, Homo sapiens
  misc_feature (678)..(678): n is a, c, g, or t
ggcaattctcctgcctcggcctcccgggtggctgggactgcaggcgtgcgccaccacacccagctaattttgtatttttagtgaagacgggttttcatcatgtggccaggatggtctcgatctcttgacctcgtgatccacctgcctcggcctcccaagggcgctgggattagagctgtgagccactgagcctggcctaaaaattttttttaaacatttttttcaaataaaaaaattcgctgggtgtagtggtgtgcacctgtagtctcagctactcgggaggctgaagcaggagaataacttgaacccgagaggtggaggttgcagtaagccaagattgcactccagtctgggtgacagaataagaccctgtctcaaaaaacaaaaaataaaaatttcagcctggacaacatggtgaaaccctgtctctattaaaaattggccgggcgtggtggtgcacacctgtggttccacctacttgggaggctgaggtaggaggatcagtgcctgggaggtcgaggctgcggtgagccgagatcgtgccactgactccaacctgggcaacagagagcctgtctcaaaaaaaacagaatagaaaaaagaaattttttttgaaaaacacatggtgatgccgggcgtggtggcttacactgtaatctcaggagtcagatgatcatnggactccatcctgggtgaccagagtggaattctgtcaaaaaggaagcgcaagcgaatgagaactctccggcaggaggtggataaagctgacatccgtttgcgggggggaacgaccctaagggggaggcagggccctcggcaaggggccaaatcgtggacctgccggacccaggagacacagatacccagggagttgatcggcaggccaaggaaatgccaaccaggaccggaaaacaatttcttgg

SEQ ID NO: 544169 - DNA, 319 bp, Homo sapiens
gttctacccctccagctaccaccaactttcctgcacctcctacccgggccaggttgtccaggccagacagtggcatactggcttctagaattcctctccagagctactctcaagttatatccaggggacaggcccctttggctccaacccacacgcctcttttcccacccactggagggctcacaggcaaggtgagagaggacacagagggtgccaccactgtcgctacagtagggccctcagtgcctctgcgaattaccgtcacatccttccttaggggaggcattcgtagtcagggacagattccgtactttaccag

SEQ ID NO: 544170 - DNA, 415 bp, Homo sapiens
  misc_feature (5)..(5): n is a, c, g, or t
attanacgaaatcttcaaacattctatgaggtcatacaggcagcatgacaaatagattaaggcaaatcagcacaccaactacgaagagatacactgagcaacaaacaaaagtcctaaccaatccaattcagagtgcgacaggcaggccactgtcagttttataggcaaagaatggcagattcctgccgcgcagaaaccataactggtcaaccctggagtgctgctatgaacacagtcatgatgcagggtcaagaaaccctccttccatgatattctgctttaatcagatgcaaggttgcctttgtgagtagcaaagatggggtctcctacctgttatgatttgaggccccctgggaaggacccaattccctagtcctcacctcctctggtctgatggagttatatgccactccag

SEQ ID NO: 544171 - DNA, 527 bp, Homo sapiens
caaattgaataattatggaccttttggatgccggtatctacttaccaacctaccactgataagacgtctaatagaactgcctcctctacacccacatgaaagggcgctataatggatcaaagggtctctggatgcagagccttgtttggtgtaacgactattcttctcttgggtgagtaacatggaccatgacagcgctgaacatgtacatcggaaactcttgcgcgaaaatcatgcaaactgttcaatgacattttttagcatgaacaacagcctgatatggtctgccttgcacttaaacaacaacatgaaaggtaactgcatcactaaagaaatgatgcagacattttattccagatgctatagagaagctcacacctttaaaccctcctgcatttgtgcactcaaacttggctaccggacatctacccctacaaagtcaggcaagctgagaatgtacttccgtattcaaggattaccgagctacccctgcagaacgtactgttctgtttgcaacgagaaggata

SEQ ID NO: 544172 - DNA, 175 bp, Homo sapiens
tggaacatctcaaacatgcggctcatgtacctggccagcaagtccttccggcagatttcactcatcccggggacgtgattgatcttctggtaacttttcatgtccatcacacgttccagtgacacttagtaatctgtccaatagagagtccagtcatcgtctaaccctccctctc

SEQ ID NO: 544173 - DNA, 788 bp, Homo sapiens
gccatggctgcgcagcgggctggccgggggtctcctgaacccgggcccggccgccccgagccggccggccccgtctgccgtggcttgtccccgtccgcgtccgtagcgcgtcctgcgctgcggctgagatctctttaatgagtggatgggagagcaggcagactgcgtagtgtctctgcgctcatacaagatcagcgtagatcatcaaaggtataccgctgggtccgaccactcaagcacggtgctgcacgcaggctgcaacgacgcagcgtctccgcgggctcttctgctgacgtcgtcctggtggccgatgagcagctgtgtgccagtgccatcgcaacctgctggtccgtgtgcaggcgacgtacgttcagactccgatgttcaccgatcggcatgcagggaatgctttccagaatggacggtggagctgatcgtgcgcctcctacattgtggtctcaaggccgtggtggacttcctgtacggcggggagctggtagctggatgtgctggcaaacattgactacgtcctggacgacggctcatcttgctgcagatctgtgacggtggctagacttctgctgtgatgtacctggtagcaggagagtgagcgaggacaacgtatccgtgtagcctgtcaggagcttgggctcgcatctacgagccgtcaaggcggcttgatgccgttcactcgagtgggcttcatcctgaagccacttcgagcacgctgtccttttacgcgcgatttccttgcagaacgtgtccatgcagaaggctgagtgtctacc

SEQ ID NO: 544174 - DNA, 210 bp, Homo sapiens
caaagaattcggcacgaggcaccattgcgggttgcaagaacaagcgccttacggaaggcggcaaaaagggagccaagaaggaaggtggttgaccaatttttaagaaaggattggatgtagttgaagcaaccttcattttttaatatatggaataatttggaaagccgcctgcaaccaggacccaagggacccaaaatttcacctataggg

SEQ ID NO: 544175 - DNA, 266 bp, Homo sapiens
tggcaaccccacacgcctctggctcaatgaagagtgtaacccttatgtgacttctttttctatttagctcggatgattccatggctgtggttcgccgcgatgcacacacgagtgaggttgctcatctagtgacagattctggataagacttcgctgccttgatgctgatggcctgtgctgagtatcttgagcaatgctcatttgaagatcatgtaacattagtgaatgacgtaactgtctgcacttgtgatgccgttgattcactt

SEQ ID NO: 544176 - DNA, 158 bp, Homo sapiens
ctaacacgcggagttccccatgactttgcaatctccatttgtgagtgggggtaaaaaagggaacccagctagaggattcacagagaccttgaatgacacgtaacacactaccttatctacactctccgattctttaaatagcacaaagccaaatcccc

SEQ ID NO: 544177 - DNA, 204 bp, Homo sapiens
  misc_feature (100)..(100): n is a, c, g, or t
  misc_feature (105)..(105): n is a, c, g, or t
  misc_feature (125)..(125): n is a, c, g, or t
gggactgtcgcgctgtcctgatgagtcagacagaggcaggttcattttcctcaattgcgtgcttcctctgtatccccttgaacctaaaaacagctatctnaggangagggaggagagcgagtttnactgatggattccccaggtgcccaaaccctttggtccaagtgcctcccacccccaacaagtgccagcgggttttggttt

SEQ ID NO: 544178 - DNA, 83 bp, Homo sapiens
  misc_feature (27)..(27): n is a, c, g, or t
  misc_feature (82)..(82): n is a, c, g, or t
gttctttttttaatctgatatgtgagnggctcccaattttacaattcataataacgtcatgaacaatgaccctttagggatnt

SEQ ID NO: 544179 - DNA, 226 bp, Homo sapiens
taacccctttccactcagtgacaagacattaggacccgtagcgtgatgagaaacggatgtccatgtagagatgacacaatgtggcagctctactacagtggcagcagcgtcatttttataacaaacatagcaccctccctcgacacagtactttgagctagtcccaaaaccatggtatatatttctgaccagacaatgcactctattcccacatcaccttcccacg

SEQ ID NO: 544180 - DNA, 596 bp, Homo sapiens
  misc_feature (127)..(127): n is a, c, g, or t
  misc_feature (131)..(131): n is a, c, g, or t
gggaggattagcgcttcagaaggagatagtaggagatcgaggctgctggtgagagaatttgaagccatgcaagcctggtagtccaagctaggtgaagaatggagaagcagaagaccagaggttgcantganctctaaaacgagtgtagtggaaatagaaagactaggaatggaggccagtagtcagaaaaggaatattggaattttcagttttgaagctgacagaattcctgaattatatagctctggcatttgaccataggagtggatggctgtagtgaattctatcctagaaatagaaagtgaaaaccaattaaaaccattctttttctgcaatgccaaacttactgagttatccttcagcattggctttctctcatttatcccaaatacatcaaccagcagtatttattttaactgctaagttgattttcagcattctcacgtgatatgaaacaattgataattaggatacaatttataatccgaaactgatgtgtttgcctttgaattactcattcatctataagtttagtccttttattaggtgaattctgtgtatattggatgcaaaaaagaataagacaaaagcaaaaa

SEQ ID NO: 544181 - DNA, 1112 bp, Homo sapiens
  misc_feature (1)..(1): n is a, c, g, or t
ncaacatgtggatggcatgtggacgaggccgcgccgtcactgttcggtgtttgcttcttgtggtacggtgtcttcgtcgattgtcgatagcccatacgagaccccccgccggggggttttgttaccgcgccgcgtgtgcggtgctccgtaccgccgcctagtattgtaactcttgtgtggtgtcccaccggccacacgtgagtcgggacttaacgcgggtttaccgggggtcatagggtgtgcgcccagtctgtcccctgcgcgctgggggattttcgggcgcccgtggcttctcttctaaggggcgccatctggggccttggggtgaatgaagacttgcctgattccagaggcccggccctgtatgaccccggagaaaggagaaagggaccagacgtgaacgggttccaatgcccgccgggaccccccgaacgtatccccaacttcgcagagtgtttcaggatgacccccagtccggtaagcctgacctggaccaagttctggacctggagttgaaaggtgaccttgagaaatgcctccccgctttcgtgaagtgcgcccaccagccaacccagcgtttctttgccagagaagcttctatccagcccatgaaaggtgttggagactccgcccataaggccattgatccaggattatggtttccccgttcttgaaattgaccatggatgatatccaacgccattcttatccagaagaatgtatggtatctctcccctttgcccagccctccctggatgaaacccaaggagattatgagaaaatccctggtggctctctttgtggaggaaacttaaccattcccctgatggtctccagctatgatccagaagacctttaattattatattttccatccctataagctttaataggaaagtttctttccaccaggattacccgtgtagctacctacatgctgagaaaatatagccctttaaatccatttttatattataactctgtataatagagataagtccctttttttaaaatgttttccccccaacccattaaacccctataccagttgttttagtaaccatacatgagaaagatgtttatgtagctgaaaattaaatgacgtccccaga

SEQ ID NO: 544182 - DNA, 83 bp, Homo sapiens
gcggccgcctactactactgctcgaattcaagcttctaacgatgtacggggacatgatgtttttaaaatcttattaaagtttc

SEQ ID NO: 544183 - DNA, 546 bp, Homo sapiens
agactaacttggcagagtgtaatagagcaaaggtgtagataataggctagtatagggccaaataatgtacagactgtagagtttagtattttcatgggtgagtacagtttatatcttattctgaatgggttagagaaacaacttcacatagtagtttgatcaaatgtactgaatggaataaatgaaggcataatagtcatgcattcattttactgaccccattatgagactggggtccacctattaatatgtattcagttttctcaatatgaccacttagattacttaataatcaaaacaggacattatgcagtaaaagtaggatggcgggcatcaaactatgactacagctgaaatacaactgagtggtaggactacacaccagctcagaaacaaggatctcattcatccaagatggttatgtgtgaaatgctaacatatgaatacaactaggtcaatgtcaaattctaatgaaaactacctagtctataaaatagattatttccaaattgtaaagaaccacttctagtgtgtcatccaacatga

SEQ ID NO: 544184 - DNA, 490 bp, Homo sapiens
ggcggagggaaagtcaccctcaattaccatctgacatggtctggtctcagctatgccacggggggcatgaagagtagaaagtctattatacatgcccgactgaactgaggaacatggcttggggcctccaggacagttcaggtccccaagctaaccccctacttcccagacagctgctcgtacagtttgggcacatagtcatcccactcggcctggtaacacgtgccagccaccggggccctgagctcatactttttacggaaggacgccaccttgaatttgccacggtggtctccagatcggttgctgaggatgggctcgtcacactttagcggcctgtcctgctcgtaaaccagccagacatagcggtggaggcctgtgcccttgggaggcccgagcccacataatcggaaaggactgtgccactgctgatgtcattgcccttcatgttgaccaccaggaaatgatgcatactctgtatgggggatct

SEQ ID NO: 544185 - DNA, 105 bp, Homo sapiens
gacgcatcaaccccatctgctgaaccgtggtgttctccagtggcatctgggctgcccactttaggatacacagcatcagagcgttgctcacggctcctctatgtg

SEQ ID NO: 544186 - DNA, 1867 bp, Homo sapiens
aaagtgaacttgaggtatctctaaggtaggcctgtatttcatacatgaagaaaggcatagagaccaatataattagtacccatattctacctctctgttttagctataaatataattcttcccctccttgtcccagaggtagccactaattccagagtttgtgtgttgaagggcacctttcctgccagaagcccgtaccctggctgtgctgatagatggggtccacaaattctttgtaggatcccctttttaaaaaaagctttacataaatgttatcatttaaggtaaacaccattctgtaacttgattttctttaataaaagtcagcatgatatttttgagatgtattgttcttacatgaccagatatggccccatacttaatagttaaatcaggaaattgaagccagacagcttgaaaaccttcttaatggaaaaaaatgcaagaagtgggtgggatagagtttctgttgaatttttgtatagaacattgtcatttgtgggaaactagttgatttgaattctgtgttattttgaatagcctggggtgggggatggaattcaactttacctaaaaaaggtttcaggccaggcatggtggctgacgtctgcaatcacagcactttgggaggccgaggcaggcagatcacctgaggtcaggaatttgagaccagactgaccaacgtggggaaacaccatctctaccaaaagtacaaaattagccggcgtggtgacgcatgcctgtaataccagctactcaggaggctgaggcaggtgaatcacctgaacccgggaggtggaggttgtggtaagccgagatcacagcattgcactccagcctgggcaacaagagcgaaaactccgtctcaaaacaaaaaaaaaaaaccttaagctgggtgcggttgctcacgcctgtcatcccagcaccttgggaggccgaggtgggtgcctgtaatcccaggtacttggaaggctgaggcaggagaatctcttgaacccagaaggcggaggttgcagtgaaccgagatcatgccattgtactctagcctgggtgacaagagcaggactccgtctcaaaaaaaaaaaaaaaaaaaaaaaagaagtagagacagggagacggggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaac

SEQ ID NO: 544187 - DNA, 108 bp, Homo sapiens
tgacttttcacaggccacagatgcagcctgctattagagaacgagacttcaggtcttaacttcctctgaaagccaatgatgacaggagcaacttcgtgcaaaccaatt

SEQ ID NO: 544188 - DNA, 1319 bp, Homo sapiens
ggagaactaccaagaaagtctatgagcagttctcttgcaccttaaaggcttggtaatacacgatgactctcacacatcggaagaagctctccagaggctgtatacaggtactatacattctgagctctggtgagtgatgatgagtgtctctcgtcaaggcactacgtgcacctagtaatgacgggacgaacgcagaacatcatactctacttatagtcagcagtgtgtacgactctagatggactcagggtagcgtaacctcgaggactcgtattggtggtacaccgtcattgcgtgacaagcatggcctctatgacatgttgatctcaatatgaatttgaggccctagttcgcagtgagataactggtggtccatacacgctgacaggaacttatgagggaggcacatgatcgtgtagaacttgtcatgttcttcccaaataggcaacaggccctttggcacatcatttccccaaggacgggactggaggtgcaccatgaggacataacacagaaagccatgggcaatgacgacaaatttataccgagatgtgtgtgggacgaaactctccgttggcgacaaagaatccactcgaaaactgacccagtaactccggggaagcaattagccataaggtgttaggcatatacaagggctagggttccaagaatagggtccgaaaaacctctaggacattattgagctttggcaacaattccggacctccactaggactttagggtcatttggaggcacaacaaaggggcaaacacctagtttgtgaactccgcctaaacagggggaataaaccacatggggacgaagacactctcaatttgccttcacggacgtcctcacacaagtctcacttctaaaggaaagatacagagagggttctataaacaaagtagcgtgcgttaaatccgattgggggcattgcccagaggaggacaatacccgacaacattgggcattgactctagaagacaggcccttgattaacccccaaattgtgcgccaactgtaatttgggcgaggcaaccccttgtactttggggccaaagttaccactggacccagctaggggctccctgagtagaatgcaaaaggagaacccgagagatgtcttaggttccacaagggggagtccgggggggtacccataccttccttggacgtttttccacatgaaattaaacctttgcgcgccttggctcaattgggaaacttatgcggttagggatcttttaccgcaaaaatccttaagaggagagggcatataccttctccaaggaaacaagcgcgtgtgggctttaac

SEQ ID NO: 544189 - DNA, 383 bp, Homo sapiens
ctaggcaggtggaaatcaggaaaccatcttattttatgcgcgtgtagtgagggctgatgggccttgaaatgtatttcctgcactatgtgtgtgtgagtgtgtgtgattatactttttaggcctcacagccccatcatccctttctaataacgtcacgtcgataaggggcttaggattgcatctggcctgtgtaagccctctgagttctgcggttcttagagttcccttttcagcactatagctctgccttgttcccttgttcctccttctggcgccccgtgctgtgccccctgcaggagtccaagctgtccccatgctgcgtactggtccggccgcccctcccgtggtgtggccctggacgaaccccctcctgatttccacct

SEQ ID NO: 544190 - DNA, 141 bp, Homo sapiens
ctgtacaagagcctaaatacagtacagtcaagagagttgcctctttgcatgatctcaatatgatatgtcaatgtcggtacaggataaataataggaaactaccttcagattattgggacaagataagaatatcaggtgtgt

SEQ ID NO: 544191 - DNA, 710 bp, Homo sapiens
  misc_feature (134)..(134): n is a, c, g, or t
tgcccctcggtggcagcagtatacatcatgggtgatctggcgcagcagacttgtggagcccatgatagagatgacttgcccagcttataaccatcgtggtgtgcgtggaccgcgtatacgcatgccactgcttntatgacacactgtctgagcagggagagaatgctcttcaatagtgagcactacccactccgctcagaggacagacgactagagagacgcagttctaggtggaagtaagtgacaacgaaacccggctcctattcgtggtctagatgactcagtggcaccatatcgcacgcatgggcatgcagtgtgtatggataatgaccgcacatgacctactatgtgtctctagcccacactgatgccacgcgagcgcgccgagacccttggacacccaagtgcggatggtgctcgagatattgtgttgtgtgaagataacgctacacgtttattctctttgactaaactcacatcgccgcgtggagactgtgactacatgtggacacagggttgtaatacctgctttataaatgcactactgtgacgtgtatattactaagactaggttctccgcgcactgctgagcatacacaacctgggggaattgttcatcatgcacactttttgatactctgccttccgtatgttggagcccacggtagagggtgacggcttctgtctgagcgtttgataatactggagtg

SEQ ID NO: 544192 - DNA, 430 bp, Homo sapiens
gcctggggcactttccttttactccaaaaagcatcaggtctcactttcagcatgtctttgtcatagtctaagtgcataatccatgtaccgaaaatgtgtgttatagtgttgcagtttccagatcacaagatgtgccaccatttggcccagcgattcctcagaggatgtaacttttccaaagttcagccgtgtcccgggcatgttccttttacgccacacatgtatactcgatgcatgtaccatgcaggtccataaactctcataagtttcgacgcaattggccactcgaatcgaccgcagtgatgtacttgaaagatctggcggagaactttgtcacaaccgtcctcgtgtatacctctgtgaagttcaacttcattaccctgggtgccaaccaaacggataccgtcaagcccaggaaggttgcccactt

SEQ ID NO: 544193 - DNA, 1159 bp, Homo sapiens
  misc_feature (3)..(3): n is a, c, g, or t
  misc_feature (289)..(289): n is a, c, g, or t
  misc_feature (535)..(535): n is a, c, g, or t
  misc_feature (551)..(551): n is a, c, g, or t
  misc_feature (582)..(582): n is a, c, g, or t
  misc_feature (598)..(598): n is a, c, g, or t
  misc_feature (611)..(611): n is a, c, g, or t
  misc_feature (633)..(633): n is a, c, g, or t
  misc_feature (676)..(676): n is a, c, g, or t
  misc_feature (684)..(684): n is a, c, g, or t
  misc_feature (754)..(754): n is a, c, g, or t
  misc_feature (856)..(856): n is a, c, g, or t
  misc_feature (910)..(910): n is a, c, g, or t
  misc_feature (1043)..(1043): n is a, c, g, or t
  misc_feature (1049)..(1049): n is a, c, g, or t
  misc_feature (1056)..(1056): n is a, c, g, or t
  misc_feature (1061)..(1061): n is a, c, g, or t
  misc_feature (1093)..(1093): n is a, c, g, or t
  misc_feature (1098)..(1098): n is a, c, g, or t
  misc_feature (1122)..(1122): n is a, c, g, or t
aanaatctagcactagtatataagaaaaccaaatataggcagtgatttattcatatattcctgttcaaagccacactgaaaacagaggcagagacatgtactctggtgtgatctcttgtcctcagtgtctctcctgggctcctgtccctcttgctttatagctagctgcccggagaccaaggtacaggtgaaagcaaggtagcagcttgcgggaggaggcctgtctggcttaccagtttatacactgtggcctcaacctcccagacagggcagagaactgtgggcagcncgtttgctttctaggctggctggagaggtgggagcccattgatagactcatgaaggaaactatttttgaaacaggcttcctccttcaggagagaacatgcggactaaactgtagcaattccagtccacctggcagtaatccttttctttgcaaagtactgtctctttggttccagtaagttggaccaccacatgacaacaatttccctggaacctggtcactgactaacacagacaattgggactncagagcctcaagagcnaggagagggcacagtacatacagagggagtnaaatgggatctcattntgagtgctgcctnccgcacactcagaacggcagcnccaaggcccggagtgtacaggggcttctggcctgaggtgaatntgccaggnccaagaaggcacacaggtaggagcacagagagcgccattcccacaggcgggcggcccagcagcaccagtngaagctcagctgtgctccagctgctctcggcagagagtacagtgcacagtgtatgcgctagctgagaaagatctcccggacgtatgtgagcacaccctctcnctcctcctcctcagggctcctgctacaggcagagctggaaccccccggcctctnggtaaggctgagcgctggagcgagtgcctgtgtgcccactgtgctctccctcactgctgcgccgagagctcgtgtgaacgcgacaggagcagggaggggagtctcctgggtatagccccgccagcccggctcncgcagnctcttcntgttncgctctaataagattccagacacacaactatntactnatcagcgtcaagtctcgtgcaggnttgtttttattagaagtaattgtcttgtaaccggatc

SEQ ID NO: 544194 - DNA, 729 bp, Homo sapiens
tttcaagagaaatttttaagcttaaagtttatatcccagtgcctggtacaaacagtgtgtctccctgactaggcacacagcttgtagaaacagtgttagaactcactgaaagcctggtcttatagaggaatagcggcatcatatttcgttcacatataggaggttggtttaagccctttatttctcgttatggaccagagcaagcacttcttatggaaaaagtagtctgtggattcaacgttaactaagcagtatagttaaaagtcgctctttgggtgtctacctccctccatacatgagcttcaaggacactaagatgttataaaggagtaaataatgatgttcattttgacactgccacagttttggtaactagggtcctacggagggaaatgttcgcctgtcgaacttctctctgttatgagaggattcagttaggtcactcatgtgttgctcactcagcttcaatcacaataagcctagtataacctggtttcgttacaggtgtctccagtccagatgttcttcgtaatagaatcgaagtttttagtcctttgagtccaaaccagcttggtaggcataatatgtactttgaaaaataagatcttatcttggagccccatcagtatgtagagtttattatgtaaattatttctaaccaccgaaacgaaagctttgattatctaacatgtgagtctatgggacgaaagtgaaattagctttttattg

SEQ ID NO: 544195 - DNA, 113 bp, Homo sapiens
  misc_feature (93)..(93): n is a, c, g, or t
gcatgtggaagatctacacttcttcgtcgcgctcccgggatgcagcagcatgctgaatgtgtactgaagtcgcatcacggagagcacgagagnaccgagttcatcggctaacc

SEQ ID NO: 544196 - DNA, 1091 bp, Homo sapiens
cagtgtggtgtggccggtggtgtgtgtgagtgacctgtggtgagatgtaatgtaggctggggaaattggggcctgttggtggtgccgctgaaatatgtttatggtggttctttgcgtaggtgcgcagttggagggttggcaagggggggtgtgccgtgtcgcacaggcgcggtaagcttcgctagtggaatcgatggccccagtgtttctcacgggtgataatacggtattgagaggtttgtttggagggggaaagcgtgtgtggggatgtaagtgttgtatgatttggaggttgtgtggctagttccgttggtgttaccgaagatcctttggtagtggtacccaatggaaactggtgtaatgccgttcttatttctatgtggtctgcggccctatgggaggtacgcgtttatgtgtggtcggaggttgacccaggtgaattgctctgagctcatgttgtttggcgctttccctgcgtgtgtatgctagtgtgggtttcttgtgagtctgggtggttatttataacaagggtttctggggaactttgcggaggtatgtgggatctggtcaagctgggaggtgtctcgcatagtggctctgtgtgagtcgtgtgaattcatttgtgatgtcaatattacagtttattgtggtataaggaataaggagataggatgtatattatgaccaaggaatgttcatgtgtaggacggggattcctagaattatctcaggtaatcataggtagttggaattgcctgcgcccagatctctcaaccggagttggtggtggattttgtgtgatgtcgaagattaaggtgggctattgcccaagagttttttgttttcctatttttgacgattggagcccttaagatgcacgatggaagttgtgttgtctgcgtttctttggtaaaaggagcaaagcgaggacctggagataaaacgctggaagcaatctgccttggaaggattcagcacgagtagatggtaaacactcttaaaggggaaagggggggtttgatttaaatagtaaatcagtaagtcacttgtaatttaagcaaaacaagttggagttacagagggtagtttcc

SEQ ID NO: 544197 - DNA, 206 bp, Homo sapiens
ctgtcccgagtctacaatgctatcattccctttaatatgcgacatatgcattgtaccgagaaacttagtgccgaataagtgatcaggtattgctgtttagatatccccaagtccttcaatgctatcatttcctttgatatttggatcatatgcattgtaccgagaaattagtgcgaagtagtgatcaggtattgctgttaagggga

SEQ ID NO: 544198 - DNA, 875 bp, Homo sapiens
caaaataagacaaattaggcggatatagtggcatgtgctggtgtcccagctacctgagaggctcaggtgggagaatcgcttcagcctgggaggtggaggttgcagtgagccgagatcgtaccactgcactccaatctgggtgacagagcgagaccctgtctcaaaaagaaaaaaaaaaagggataatcgctggtgagccactcggcggcccgggcctctaacgactaagaatgacaatagaatagacttaaccaagactatggtgggtggcccaccttgtaaatcgccggctactgggagaggctggactgtgggagaatcgactctgagcccaggaagtcgatggtgtagtgagccaatgattgcagctcactggacttccagcctggggtgacacgtggaactggtgaacctctggtgttcagaatagaaaatagaaccgatgaagacaaagcaagttcaatctgcaaagagctccaaaaaacacacgtggtggggggaaacggagagttggctaggatttggactgggggccatggcgtaggccccaatttgctcgattgccgcccggctcgggtcactccggggcgagctggtgggttggggcgggtcgctcctaaaccgggggctgggcgccatgctgtgtgttactccgcagcttttgtacatggatgttcccctgagtgtgtgagaccttggcgcccaggtgggtctcctcgccgtcggaaattccccacgcaattcgcggggacggtctagaggtggggtggaactcccgttgcgcctacagggagcttaagccccccagcctgtgtcatgatgcgagagatccgtggtctgttcttaacatagataggtttcgccgggtttgttga

SEQ ID NO: 544199 - DNA, 765 bp, Homo sapiens
tagcctactgtggctagtcaaccaccggggtccctggccttctcgtggctggggccggcgcaccgcggcaggacggggaggcgggacatggcgtactgcgtgggtgagccggaccctaagcaagggatgatgtgaactacaaaatgcatattccggatgatcaacgagcagcaagtggaggacatcaccattgagcttcattctaccggtccgcaatgccatcgaccctgcgtcaggttcaccatcgtcagcctcatgtacttcgcctttaccagggatgactcgtgtgccagaagacaacatctggagaggcagtcctctcgtgtatatgaacttctttctgtatcatcagtgtgttagctttccccaatggtccgttcacgtcgacctcatccagccttatggcgaatggtttgagggactcagtgtgctctacttccgtgtgcctggtattccatactcttcctgaatttcgagcaggttaaatctctaatgtatggctagatccaaatcttcgatacgccacaagggaagcagatgtcatggagtatgctgtgaacttgccaatgtgatcacctgggagaggattatcacgccactttgatatatttggcattaggacattgtctggggctgggacaatgaaggggcttggtggatccggagtgacgggctctgctggacaatcaggatacctgggagctgatgcgactcatctcatgcattcctccaatgtgcaatgcgggggaccagggatcggaactc

SEQ ID NO: 544200 - DNA, 168 bp, Homo sapiens
ttctgaatgagacctgctctcgtctctctttctctctctctcacacacacacacacacacacacacacacgcacatatatatatctataaaaagtctcagagggaacatgtaaatgtgtcccactacatattatttactccatatatattataggtttcatcaaattg

SEQ ID NO: 544201 - DNA, 122 bp, Homo sapiens
gtcgaccaaaaatgctctgtatggttctctgttagcaagtggtgtaccagacaaacacacgtgtatgcacactcacatagacacaggcatactcgtgcccaaatgaaattaaaagatgattt

SEQ ID NO: 544202 - DNA, 595 bp, Homo sapiens
  misc_feature (492)..(492): n is a, c, g, or t
tcactgcagttcggtttgttgggaagtatattgacctgtgaaatttaaatttgcttactaggaaaaccgtcttcagaggcagtccctaagcccaagagagccccaaaacagaagaaagtagtagaggctgtaaactctgactcggattcagaatttggcattccaaagaagactacaacaccacaaggtaaaggccgaggggcaaagaaaaggaaagcatctggctctgaaagtgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttngtgttgccttttgtcttctctgtctcagacttttgtacatctggcttattttaatgggatgatgaaattgacgggtttttattattgtgggaggccttttaac

SEQ ID NO: 544203 - DNA, 468 bp, Homo sapiens
  misc_feature (148)..(148): n is a, c, g, or t
  misc_feature (150)..(150): n is a, c, g, or t
tgaggatcctgtgcactgcttcggatgcaggtctgggggcgcacggttggggcctgagctcagttatagggaagggctctggatgcaaatcacccatagcctactgcccccaacgggcaactgccctggtgcggtacaacctctcagngnctgtcacctataagggctccctgtgtcaccacaggcaggtggccagaaaggaaaacagtgaggcacccggaagagcagcaggcagatctccctgcagaaggaacacaagactcggaggacatggagcgcctggacctggagcgagcatgaggctgtgcggggaagcagagccaggatgggggtgctaagcgcctggtggcctgaaatgtaccacagctaccaccgtaatgacgcgagttaccataattacccagaatggctgcgatggatgctccctgctcagcgccttcctagacacagatgctgctggggcaggag

SEQ ID NO: 544204 - DNA, 280 bp, Homo sapiens
aaaagggtcgaccgggcgcggtggctcacgcctgtactcccagcactttgggaggcgatttgggcggatcacctgaggtcgggagttcagaccggcctgactaacatggagaaaccccatctctactaaaaatacaaatattagccaggcgtggtggtagcgtgcctgtcattccagcctgagtgcagagaaagcacctgcctcccaaaagaaaagaaaataaaagaaattcggaatatatagtaagtcaatcttaccctgtctttggcttgtaccgctg

SEQ ID NO: 544205 - DNA, 156 bp, Homo sapiens
ctcttgtgttgtgtggtatgtatatatcgtgtggtattgtgtgtggtgtgtgtgatgttttgaggtgtgtggtgtttagtggtgtgtggtgttagtgtgtggtgtgtatatatcgtgtggtgtgtgtggtgtgtgtcatgtgttttgaggtgatct

SEQ ID NO: 544206 - DNA, 287 bp, Homo sapiens
  misc_feature (9)..(9): n is a, c, g, or t
  misc_feature (90)..(91): n is a, c, g, or t
atcggcggnattcgtcgacccacgcgtccggcagaggcgcaggtagatcgagttggggagttgcctggagggcgggaaggaggcggcggnnaagagggcgagcctgaggtgaaaaagcggcgacttctgtgtgtggaggttttcctcggtcgcaagccttcagtgtccgcagttggcgtcaggtcttcctgccgagaaacgacgtggagaatgaaagggcgtttaacgtcgtcgtcgagccgccgtcgggaggagcgccgttgaacgccgaccgtaaccagctgctg

SEQ ID NO: 544207 - DNA, 164 bp, Homo sapiens
ttcacctctcagcactgaaaacccaaaacccagctggccttaacactccttaagacagaggtcacacttgaccaaaaccacacacaccaaaacctgatttggaggatggtgtctccactaggcacctgctgggctgagcttctacctacgagtaaacctctgtc

SEQ ID NO: 544208 - DNA, 270 bp, Homo sapiens
  misc_feature (179)..(179): n is a, c, g, or t
  misc_feature (182)..(182): n is a, c, g, or t
gagtttctggagctgttccgagtcccgtggagtctccatctgagccctttcctagtcctggcatcccgaagatggagaatacgtccctgagcgttttgccctgtgcttcttgctgttggctgtttttttttctctcttcggctcagctctatccatagatgaaacacgggcgcccctgntgntgaaagaaaagatgatgcggttcggggggcggctggcgctgaacaccaaggaggagctggccactgagaggctcctgtcgctcaaaat

SEQ ID NO: 544209 - DNA, 137 bp, Homo sapiens
  misc_feature (93)..(93): n is a, c, g, or t
  misc_feature (110)..(110): n is a, c, g, or t
aaaacaaccttcacctgtcgcacccacactcattcgggtggacttgccggcgtcaccgccgcggacttcgcttgggccatgaccagatataantggtgattacagacttntttccccttctaattaaatggggggga

SEQ ID NO: 544210 - DNA, 379 bp, Homo sapiens
cctgacgtagtcgctattggttggcatgatagctcatgcctgtaatcctagcatatttgagaggcctaggtgggaggattgtttgagcccaggagttcaagattcagcttgagcaatatagccagatattgtctctacagaatatttaaaaaactaggtgggcatggtggtgtgcacctgcagacccagctacttgggaggctgaggcaggaggagtcacttgagcctgggagttcaaggctacaatgagctgtgtaagtgtcactgcactccagcctaggtgacagagagagaccctgttgctataaaagaatacagtatacaatacttataacatacaaaatatgtgtcaaactatggtaaatgtagtaggaaaggc

SEQ ID NO: 544211 - DNA, 457 bp, Homo sapiens
  misc_feature (94)..(94): n is a, c, g, or t
ctgggctcccagtccagccactccagggtggctcctgcccggtgggggctgggccttgggccagctggcagcacagccagggtaagcatgtctntacccccacacatctcccacccacctgagcgccatgtgttcccggacacgggcgggcgcctccttgggcagcaaggggccccaggagccaccctggagtggctggactgggagcccaggagggctagggtgctggagacccctgaggacaagacctccttaccaacaggtacaggggcaggtgcagctcagtatcttaccgaccagctcagcccttcctgtgcgcactggctgagcacctgctagggcctcaggctccctcggccttcccatacctgccctgttgtacccctgaggcatccttatggtcttgcccatcccatgccaaggcagctctggcctgctcctcactgtcctggagcct

SEQ ID NO: 544212 - DNA, 343 bp, Homo sapiens
  misc_feature (94)..(94): n is a, c, g, or t
ctgggctcccagtccagccactccagggtggctcctgcccggtgggggctgggccttgggccagctggcagcacagccagggtaagcatgtctntacccccacacatctcccacccacctgagcgccatgtgttcccggacacgggcgggcgcctccttgggcagcaaggggccccaggagctctcactgttggcccttgcgtagttcactgtcttcccacttgtttagaatgaaggggcaagaatttatacaaataagcagaattttttctttcttttttttttttgagacagagtgagactccgtctcaaaaataaaaataaaaatttaaaaaacccaaaa

SEQ ID NO: 544213 - DNA, 129 bp, Homo sapiens
aggcacgacaatgtacatgtcataaggatgagactgtctcagagaaactgttagttcaaaaagtacagtacacatccggattacatcccatatttgttgcatatttttcacaaagtgccaatcaagcct

SEQ ID NO: 544214 - DNA, 329 bp, Homo sapiens
  misc_feature (181)..(181): n is a, c, g, or t
ataattactgaaagagcaccactgacacatggcaccgtcccaagcgctatgctgaacacttcacactcattaatccctttaagcctcccagaaatcccgggaaggaccattgctgtcatcactcccattttgcataagaggaaaccaagggttagagaggcgagcaaatgtgcccaaggtnacacaaacagccagcagtagattcccatgcaaggagtcttacttcaaaactcaaactcctatgaacaattaacacggttgctgcctacaaacacgttatgggacactagtgtgttgccagggcagttagggtcacgttacttttacag

SEQ ID NO: 544215 - DNA, 475 bp, Homo sapiens
  misc_feature (438)..(438): n is a, c, g, or t
atactgagtatggaacttctcgcctccgggacgggtgaaaaaataagttcgtggtggttaaagcatccagcctacgttattgtcgtgggggcacccctaccagactaatatagtagggtacctccctatttttctgactctagactcttttataccccctaccaaatccaatcctaccatagtggcccatcatctccaagtgggcattctctgcagtcaagtatggctctgcagggtgtccggaacactaccttgggtgcgggggggcgccgggttcaaaataagacgcaggccaatagattatttcaacagcctcccagtgggtctcggtgcctttccccttcagtttatcttcaatctactcctagaagagcggccaggggattctatgaaggcaggtccaaatatcttactcccctgtacaaaacctcggagggnattcccatctcactcagagtagaagatcatattctta

SEQ ID NO: 544216 - DNA, 146 bp, Homo sapiens
gactctaagaggatcccggtgtctttctgtccagaggggtccccacaatcttgaagcggatctcatcggcgggctgaatcacaatatcctcatccatggtctggtagcggggggggtgggagaaggaccggtggggtaccgagctc

SEQ ID NO: 544217 - DNA, 190 bp, Homo sapiens
caaccatgcatttgtaataatcttcttcatagtaatacccatcataatcgcaggcttatggcaactgacataattcccctaataatcggtgcccccagatatggacgtatcaccgcaataaacaacataagactacatgactctatacctaccctctactcctactacctgactcgacatctgcatacag

SEQ ID NO: 544218 - DNA, 326 bp, Homo sapiens
gtaatcactcatatattaggatttaagtctgccattttggtatttacttttgtgtttgctccctctattttacctgcctctatttcccctttcttatttttctgtaggttactttaacatttttagtgttctattttgattttacagtactttttattatatcactttaatattttaatgattgctctagagattgcaatatacatatgtagctgctcagcctaccagtattaatttttcattgctgctgttgttgtttttcgagacagagtctcgttctgtcacccaggctggagtgcactggcgtcatctctgctcactgcaag

SEQ ID NO: 544219 - DNA, 313 bp, Homo sapiens
aagcttcgactgtgaatggaatgttgtggcgtgtctggatcgtatgtctgttctgtgccagatgagctgtcagtccagttccagcctgactcgcagttggctaccggatcgctatccgcgatggctggaccaggacgatcgatcgagtcgatctggcagtcttgatcccttggactgtgggccgacgacagtcgcggatcgatccgagcgcgcgatccagcaggctggtcgatcggttctggtcggtctgcagcagatcggatcgatcgccatctcgtcggtggatcctgtcagcctggtgtatttgtgccgg

SEQ ID NO: 544220 - DNA, 374 bp, Homo sapiens
aaatcccctgcagataattatttgaggcccagcctgaaaatttcctctatggggaaatcccccaaaaaagtccccccccggcccaaaatgcccttttatccctaaactgaaaaaaaaaatgttttcagctaatttggaaccaccctttaaaaattttattacccccccccccccaaatttggtacaaaaatattcaaatttgggcccccccttagcatgggcaaacaactgtaaaacaaggtcaaaaacccccttttaaaaccccccaaaaaaaagccccttttattaccccccccactggggaagggaaaggcccttcctttttttaaaaaaaaacacttttttggaaatttttggcaggggttagatttttg

SEQ ID NO: 544221 - DNA, 204 bp, Homo sapiens
tgatcgactcgggccggtagagcggctgctgcagcagacacagaggtccactatatcttttcagatttagtgtttttgcattcttcagataaatatccagaagtggaatagctgtatcacatggtagttctattcttaactttttgaagaatctccatattattttccacagtggcgccaatttatattcccaccaacagtgtt

SEQ ID NO: 544222 - DNA, 126 bp, Homo sapiens
tacgcccagaggcagcatataccgtcatttcctggtgggcgaggcatgctgcttcccaatcatgaggttccttctgcatggggggagtgccagtcctggtatcacatttcgtgccttctctcccca

SEQ ID NO: 544223 - DNA, 127 bp, Homo sapiens
gaatggtgcggctaggaagatctcctcctttacatttctcttctccctcctcctcctttttctaaaactgtgcctccaccagaggggcagggctcttgtagatgagaatcctggcccagtgacagga

SEQ ID NO: 544224 - DNA, 792 bp, Homo sapiens
acggcgtctgctttgtcagaggaacctttgccccgttatataaggtgcggcgtgtgcctgtaggtaggtcgctctgccacgtgtgcgtagtgttccatcctggcacacgcacgattggggggttgtattccagcctcccctggttccgcatttctgccacagtctgcctgcctgcttccaccgatgtggggttgaatataccccgtggtgcacggcgacacccttaagaggatgcgccgtcgcttgttggtacaccgacgctgaggattgtggcccgccttattttttgccccactcttcggacgcatgactggcacgccttgtatgttccgccgccgcctgcccctcgtggttaacgtcttggcaccccggaaggccgactgcgcccgttcgttcactcccccgttgttccgtcctcccccccccctcttgtccctcccttggtgagctgcaccttctcgcccttatacctggctgtttgctgccccagtggctccccgtgctggtagatttctcgccccgaggtctaggcgtccctcgttctctgtctccccccactctgttcccccgctcccccctccttcaccctatccttcttctctcgccctagttatccccccccgttaccactgcccccaaatttagccaacggttataaataaaccctcacctctgggtaaaaacatcagccccacccccatgcgcctcctcacccatctttccccccttctgactgcgtagacctatactcacgtgccccccttctataatataaatcttcttaaacataac

SEQ ID NO: 544225 - DNA, 688 bp, Homo sapiens
  misc_feature (63)..(63): n is a, c, g, or t
tggaaatgtcccatcaattgggcggcccaggccatagtccccccacgatgcctgaccagttanagagtctaatcccggcactgccgttaaggacggcaggaccttcacagctttctgggagtcgtttcccagttgcaaaatcacatacaccgggagagcaaccccttcctgcgactcctgcttccctttccggagggcagcccctaagagtttcaggctgtccgcatccctgcgttccaactgactcaaagggatgtggagagagtgcggcaggcgacagatgtccacctctacttgaggccggacgtccagcaacacatggggcgccccggaatccagaagccgcttgtagtcggtcacagaaatccgctcctcggggcacagcagcttcagggcgcggcacttgtcggtggccgaggagccgcagaaggcctcgtagtcctgcaggcgggtcacggtgggctgctgcccgcacacgacgcagtcaggccggcggcgccgcagccggatccggcggaagtggcccccgaggccgtcgaagagcagcatgctgccgctgtaggaggagccgaggccggcggcgatcttgagcacctcgagggcctgcgcgcagcctagcacgccgggcaccgctccgagcacgccgccgtctgcacagttggtcactgtctccggcgggggcggccgc

SEQ ID NO: 544226 - DNA, 179 bp, Homo sapiens
tagcacgacggtgatgcataagcagtgagcggctagtaattatagtatgcttcgtatgtataactatctccacagtagtcaaggtaccatgtctgacccgctatccgtactcatcagaattccatcttaaaaaaggaagagcctgtacccaatggcctccgggcacacccagtattgct

SEQ ID NO: 544227 - DNA, 137 bp, Homo sapiens
tcccccacactcacggtgtcacactcacggtgtccacactcacggtgtccacacctgcacgggagcgtgtgttctccgaggaccgggccgttctatgcgctgagattgtgtcagccctggactaccttcactcggag

SEQ ID NO: 544228 - DNA, 1722 bp, Homo sapiens
gcggctccaggcagagggccacggcccacccacacgccacctctagccccgccccgcggccccttcacccggtgggcgggtgggcgggtcatcgccatgcgcgcgccttgccattggcccgcgccggtggaggcgggcctgctcacgtctgccgggccctctgttagtcgtttggcagcggatagaggacacgaccaagatggcggcggtgtctggcttggtgcggagaccccttcgggaggtaggcagcagcgcgcggcctgtattcccacgcgacccctgcccaccctgcgtcccgccgtcatcttcctctctccctgccaggtctccgggctgctgaagaggcgctttcactggaccgcgccggctgcgctgcaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggccttcagcctgtgcctatagtcttcagggggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctgatgaaagatgtatccaaacaagataacttatatgtataaaattaaagcatataatatacattta

SEQ ID NO: 544229 - DNA, 206 bp, Homo sapiens
  misc_feature (150)..(150): n is a, c, g, or t
gtcccaaagggagaaaggggaaagcagatgctggaaaggatgggaacaagcccggcaaaaaaccgagatgcctcgtacactccatgtcccgagaaagcgagaaggcacgggggcatgccaagatgaaatgtacatttttgcagagctctngtacttatatgtgactctacggtttgaaagtactattgtttttaaattcaaagttt

SEQ ID NO: 544230 - DNA, 1223 bp, Homo sapiens
  misc_feature (665)..(665): n is a, c, g, or t
cctgtgttactatctggtctttctattaggttctctttctgttgtttgtacgcgtgatgttttgtgtcccatattgtggtgttgttgtcctcgtgtgttgttgctagttccgactgtttttttttatattttcgtctcggggcatctttttttttgtctgtatctttcccgtgtgtccgtgttttaaccaggtttgaatagtagtttctcccttgtctttaacttcccctgaaggaggtgttttaatgtttcgccgcatatttccgggaccgcggccaatgtcttggaatgccaccgtgtttttggagatcctgtttggcctgtacttcctgtgatactgaactgttctgctgaaccagctattatttgaaaatatttagtatgaaaggggttatgttatactatcccttccctcccagaacttaagtttttaaaatgaccacaactgtgtccctaaagatgttgttattaacttcgagttagttcttatattcctctgtgttatattgtttgattctaagtgaccctgattctgtgaatagtgacctcttgtgttatgtaaccacgggagaagagaatgagacttaaatttgaaataatggccttctataagatatcactataaagggtggcttccacaaaataaatgtatgaaaccacttagntattgaaaaatcacgctgtttgtaacaaggagtattaactcttgctcgtgttgtgcctcgaaggtttttcgcgttcttgtgtcacaaaaggagagagaatttcttgccctcgccactaccacgagaaacttcttctatggcacctctccctcgagcctctaaaggctctttttctataaaatttctcgttttgtggtgagaaagtgatccacacgggatataccacaatagacttacacaacttgccacagcttttgtgaagacctaacgcgtcacacttaatgagattctggagatttaataaaccactgtaacttgggaataaacgctttttcactgttcccttaaatggttctctgttttttggctctaccacatctgttttgtttttgtttttatctaatatcttggtagaatgtatttcaatccctagaggcacggtcacgcctccttcccctaaatgcgagaatgcttgttttgttaagggaaagggcttcctcccacttcgtgtgaaattgtgatgttgaagtgaataaatgtctattgtgtaactctcca

SEQ ID NO: 544231 - DNA, 1766 bp, Homo sapiens
gcggctccaggcagagggccacggcccacccacacgccacctctagccccgccccgcggccccttcacccggtgggcgggtgggcgggtcatcgccatgcgcgcgccttgccattggcccgcgccggtggaggcgggcctgctcacgtctgccgggccctctgttagtcgtttggcagcggatagaggacacgaccaagatggcggcggtgtctggcttggtgcggagaccccttcgggaggtaggcagcagcgcgcggcctgtattcccacgcgacccctgcccaccctgcgtcccgccgtcatcttcctctctccctgccaggtctccgggctgctgaagaggcgctttcactggaccgcgccggctgcgctgcaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggccttcagcctgtgcctatagtcttcagggggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctgatgaaagatgtatccaaacaagataacttatatgtataaaattaaagcatataatatacatttactgttagtttgttttgataaggaataaaggaatttctaacatga

SEQ ID NO: 544232 - DNA, 1337 bp, Homo sapiens
tcttgcttttgtggtgtggtgttttgtgtcgcttgttgatgtggtgatgctcctcccacacgcggtgttgtgtgtgttcgtttctttgtttcgcggtgtttgcgtacttcttgttgttgctgctttcgcggttctggcgcggtgtgttgtgctggtggttgcgcgactactgccttcgtgggtgggtcttttaccggggttttgtggggtcctcccgcctttgttgcctcctcttatcgccggggatcacttttggtttggtcaggggtctgatttttttcccaagaatgttgtctcccaacagtggttcccccatatgctcgcacaagaagttttccccggggggagctccctcatggggcgttagtcctcttgtgggagaaattgtgtgcccctctggggcacaacatttgttgtgtgatttggtacgcccggctgtttcgtctctattcccgccacatgttatcccaccagggcgcgatgtacacccgggtgttcgcaaagggtttggtggcccaaaactgttcgcccgtggtgccctttcaagctttaccattaaggttctgagattggtgtaaaacccgttcgcttctttggggacccgcggattttcaactctctggtgtggacatgagccaccccttcttgttagctattaattaccgcaggcacactgtgtgtctatgaattattgtgctccacggtacaaattctgaaagttaatctcgctgagaacctcggaaattcacacttttaaagagcctcccctgtgggtaaattgtggaagaggtgaacccgcacgtacaccaccccgcgtggggctctctcggtacagaagtttcaccccgctatgcgtcttcttgcacccacaactcgcaccctgggcccgcctcaaagtctgctgaatgtggtattgtaacctcgtatcttataccccccctccacgataaaggaattttaccacgagaaacctgtgtaacaaggtttttcttctaaacttttctcacaagtccccctgatttgtggtgttgtggtctttcggggacaggggtttgttctctggggttgtgtttcttgttgtttttcttgcccacggtgaagatacaaactgacactatgagacaaaggctggaagagagattctgttgcactatgagctatgtcctatggagaaaaacccagcttctgttatgaaatgtctcgcccttaactggtttcccccagggaaagggaaaaatacacattccccccttttttctaagtgttcctctttagtctcccgattttggaaagatgttaagccgttatttttagttaaaaattaaaactaatttcat

SEQ ID NO: 544233 - DNA, 517 bp, Homo sapiens
tagacgatccccaggcaccactgcaagaaaagatatggaggtttaaaacctgacatggtcaaaaaacgtatatgggtagtctactttggctcgatggtaaggtatagttgattagttaagaagtataataaaagctttgttgttggggggcaggcagtcaggcatcaaagaaattattttgtcaaagataataagatggactgaaatgaaggaaaaggaaagagaaacaagtttaaaagctattatagttgccaagataagaagtaatgaggggctgtcttgggttgatggcaaaaggaattaaaaagggatcaacatgagaatcgttgtaaaggtagataatgtttagctcaataagcagttacaaagctgagttaagaaggacaagttcttagtctggcgcccagagaaaatcaagtgacacaaatgaaaagctggcaagtgggatgagaaattatttctgaataaatttaaaatcccaaccgacatgttaggaaggtactgaccaacaaatttt

SEQ ID NO: 544234 - DNA, 134 bp, Homo sapiens
gatacgaacttgagctgtgtaccagcttagttttggcctgccagctgcctgctctggcgcgtgaaatcgactccagccagccggtcagcatcgactcgctcaagcagtcgttggacatgcagatgcaacgtcag

SEQ ID NO: 544235 - DNA, 291 bp, Homo sapiens
  misc_feature (259)..(259): n is a, c, g, or t
ttcatctcgtcccaccgtcaccactccagccctagcgcaggtggacgggctgtgcgcatgctctgagttccggttgatagaaagccctgcggtgactcagtgccaagcgcaggctgaatcccaccctgctccttgttttccccttcccagcatcctgtagtttctggcgtgtccaggttagcagctgctaccttgggcctggttttacttcacgttctttctaaagaatcagaaagcttgggctgcagagtagggagtnggtgggaggaaaagagaaggaaaaattcaaca

SEQ ID NO: 544236 - DNA, 1786 bp, Homo sapiens
gcggctccaggcagagggccacggcccacccacacgccacctctagccccgccccgcggccccttcacccggtgggcgggtgggcgggtcatcgccatgcgcgcgccttgccattggcccgcgccggtggaggcgggcctgctcacgtctgccgggccctctgttagtcgtttggcagcggatagaggacacgaccaagatggcggcggtgtctggcttggtgcggagaccccttcgggaggtctccgggctgctgaagaggcgctttcactggaccgcgccggctgcgctgcaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggccttcagcctgtgcctatagtcttcagggggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaaggctgccacattcctcagctcactggaatgaagttgaattgaagactttatgaatgaacaagagccacagctggcggcacagtggtgtagcatcttcagtttcaacctgatctctgatctgtgaccactctgttttcaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctgatgaaagatgtatccaaacaagataacttatatgtataaaattaaagcatataatatacattta

SEQ ID NO: 544237 - DNA, 135 bp, Homo sapiens
tgtttcatctatttttatcaaattctgttatctaggcattcggtcaaccagatctcggttgactagcaagtgctgctattttagtcaccatatttatgactgatgcttcatgcagccccttcacaagggctcggg

SEQ ID NO: 544238 - DNA, 181 bp, Homo sapiens
tatcgccatgattacctccttgtaccaaaggaacgacatggcgaaatgttagcacaattttatttttttgttaccttgtaaatcgaatcgagcacttgagtaacagacttcggcaggtcttcggtggaaacatgcaccggctcccaccgtccgcggcagtgcgaatgctgcgcaccggatg

SEQ ID NO: 544239 - DNA, 1586 bp, Homo sapiens
gcggctccaggcagagggccacggcccacccacacgccacctctagccccgccccgcggccccttcacccggtgggcgggtgggcgggtcatcgccatgcgcgcgccttgccattggcccgcgccggtggaggcgggcctgctcacgtctgccgggccctctgttagtcgtttggcagcggatagaggacacgaccaagatggcggcggtgtctggcttggtgcggagaccccttcgggaaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggccttcagcctgtgcctatagtcttcagggggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctgatgaaagatgtatccaaacaagataacttatatgtataaaattaaagcatataatatacattta

SEQ ID NO: 544240 - DNA, 391 bp, Homo sapiens
  misc_feature (9)..(9): n is a, c, g, or t
  misc_feature (129)..(129): n is a, c, g, or t
  misc_feature (145)..(145): n is a, c, g, or t
  misc_feature (198)..(198): n is a, c, g, or t
  misc_feature (285)..(285): n is a, c, g, or t
  misc_feature (310)..(310): n is a, c, g, or t
  misc_feature (320)..(320): n is a, c, g, or t
  misc_feature (332)..(332): n is a, c, g, or t
  misc_feature (340)..(340): n is a, c, g, or t
  misc_feature (384)..(384): n is a, c, g, or t
cattccccntaatggcccccttccacctagttggggtatttccctataggtattttccctataaccttattttcccccagccctcagcctcaaccatgacctttcctccccaagtagcctccctcaatncctttaagcctcaaancccaattagcacaggggccctatgaaaccctgacaatttgcctcatatggagnattaggaaatattgcactttaatgcataagacaccttgtaaaatacccataaaattttaactggctgcagtgttaatgaagcaaatnccatggagttataatagcttttgantgtgatttantcttacagctantgaacagntgaaaagcactgtccttttttaagtaaacactacacactccagntggattg

SEQ ID NO: 544241 - DNA, 1283 bp, Homo sapiens
atgggagtgtcaataatcctcttgtctccatatcagagacaagaggattattgacactcccatcggtggcgtgggagggtgaatttatcgtcttgttctgcatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggccttcagcctgtgcctatagtcttcagggggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctgatgaaagatgtatccaaacaagataacttatatgtataaaattaaagcatataatatacattta

SEQ ID NO: 544242 - DNA, 408 bp, Homo sapiens
  misc_feature (18)..(18): n is a, c, g, or t
  misc_feature (119)..(119): n is a, c, g, or t
  misc_feature (162)..(162): n is a, c, g, or t
  misc_feature (164)..(164): n is a, c, g, or t
  misc_feature (290)..(290): n is a, c, g, or t
  misc_feature (307)..(307): n is a, c, g, or t
  misc_feature (352)..(352): n is a, c, g, or t
  misc_feature (381)..(381): n is a, c, g, or t
  misc_feature (385)..(385): n is a, c, g, or t
  misc_feature (404)..(404): n is a, c, g, or t
aatggcaacaccatgtgncgggcagggggtcccaggtgctccctggtgggctgcattctcccctgggctctgacacactcccaggggacagggccgatggggatggaggggagcgttgncaccactgggctcctctgcaagtgcgaggcctggcccccaccncncaactccggcactgagaaccccacacggacggatgatctgcacaccgaagctgctcttctgagccctcggggagccaggcctggggacagagggtcatgtcaattcagtgggtgctctcacccctnctgtggctccagtgcanctccccacaacctcggcgggccgcggcctcatcactgactcactncggagggaggcccctcccctatatctttntttnaccaatcattctttaattnaagc

SEQ ID NO: 544243 - DNA, 1542 bp, Homo sapiens
gcggctccaggcagagggccacggcccacccacacgccacctctagccccgccccgcggccccttcacccggtgggcgggtgggcgggtcatcgccatgcgcgcgccttgccattggcccgcgccggtggaggcgggcctgctcacgtctgccgggccctctgttagtcgtttggcagcggatagaggacacgaccaagatggcggcggtgtctggcttggtgcggagaccccttcgggaggtctccgggctgctgaagaggcgctttcactggaccgcgccggctgcgctgcaggtgacagttcgtgatgctataaatcagggtatggatgaggagctggaaagagatgagaaggtatttctgcttggagaagaagttgcccagtatgatggggcatacaaggggctgggttgcggcccatttgtgaatttatgaccttcaatttctccatgcaagccattgaccaggttataaactcagctgccaagacctactacatgtctggtggccttcagcctgtgcctatagtcttcagggggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctgatgaaagatgtatccaaacaagataacttatatgtataaaattaaagcatataatatacattta

SEQ ID NO: 544244 - DNA, 1042 bp, Homo sapiens
  misc_feature (14)..(14): n is a, c, g, or t
ggtaaactataganaagtttgacaaaaagcaggctgtaccgtccggattcccggatgcagtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctgatgaaagatgtatccaaacaagataacttatatgtataaaattaaagcatataatatacattta

SEQ ID NO: 544245 - DNA, 169 bp, Homo sapiens
  misc_feature (16)..(16): n is a, c, g, or t
  misc_feature (66)..(66): n is a, c, g, or t
  misc_feature (104)..(104): n is a, c, g, or t
gctattctggccaatnagatagcggtagtgataacagaggagttttattcactccattattgactnggtgaaggtctaccataagaaagaccaaacaggcaggngtagtctacctcctgtgaacactcaaaactgacttgccaaggtgccattctagaccagagcccta

SEQ ID NO: 544246 - DNA, 903 bp, Homo sapiens
caggcacagtggcacaatgcattgcatagcactgcaaggtcagactcctagtaggatccaccaggtaaatgtatgctgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctgatgaaagatgtatccaaacaagataacttatatgtataaaattaaagcatataatatacattta

SEQ ID NO: 544247 - DNA, 898 bp, Homo sapiens
  misc_feature (19)..(19): n is a, c, g, or t
gtaaggaataatttctccncatgaagtgctaccttcatcccaaataattcatcttcctgagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctgatgaaagatgtatccaaacaagataacttatatgtataaaattaaagcatataatatacattta

SEQ ID NO: 544248 - DNA, 1154 bp, Homo sapiens
tttttttgcttgtggtagacatacagatctttgttttaattaaaatttttccttttacagtttgtacattcatgaataggtattcataggcagattagattttcctagatacaaagattaacaggaaacaaaaaaggaaatggtattatggggataaggctctatttgtgctgcaatagctctgtaaacttgattatattacctgtttaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtatttcaaagaaactggttctagaatacagtcaagctatagtaaacatcatgtacctgaatacgtacaggataaagagattgaaagctaggagtggccaaacgacttcaactttaaacttgtaagtttggcatttctcttcaggcagatatttttaaaagcaaatccagaaagcggttccccataattagcattccttacattttcttcttcctggtcagccacacctctgtgcccaaggtggtagtgcccagctggcatttgcactctctcagttgagccttccttctcctagggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctgatgaaagatgtatccaaacaagataacttatatgtataaaattaaagcatataatatacattta

SEQ ID NO: 544249 - DNA, 123 bp, Homo sapiens
gagcgggctcgcgatgcttgtttattaacagtcggatcccctgtcgacagttctaagtcggctgctaggcgccggcgaggcgaggcgccgcgcgggcggggttggatgcagtcgggtaccgag

SEQ ID NO: 544250 - DNA, 395 bp, Homo sapiens
ggaatccttatgaatgtatagaatgcatactcctaggcccccagtcgttctgcagtaatttcaaaagcttggtatttttcttcctaaattgttcacattagcaaaggcttgccccaaattccccaaactttgttctttcaaaaggtttgacaaggcttaaattgttgggcattccagttggccttgttggacccccccccttgccaccacgacttgcttgccaacccggaggttcccccattgtcttttggtgccttgggcttccacgagtccctcccatcaaggctaccagcttgctcaagtagcagcaagcagtcccagctttatgttcttagctaaagcttgcatgagggcaagggtagggatgggtctgttagatgcctagctttgtttcg

SEQ ID NO: 544251 - DNA, 537 bp, Homo sapiens
  misc_feature (7)..(7): n is a, c, g, or t
  misc_feature (9)..(9): n is a, c, g, or t
  misc_feature (11)..(11): n is a, c, g, or t
  misc_feature (236)..(236): n is a, c, g, or t
ccaattngncntggccggggaaggacagcctaaaaatagtcactggtcttgactaaggggaaaaactagtaaaggaatatgcaagtagcaaaaatgaacacatgttttttcttgaacttggaagcaggtctgcaaagttagactatggtgacagattatgaagctaagggcgcagtgtaggagtgtagggaaataagtgactgagtgacacagcttattttatagccacatcttanaagaaatgtgaaggagtaaggtggatcaaaatgagatgattaactaaattctttatgtaaaacatttattcttttattttagtgtgtactgcttttcctgtacagtaagttatatatcctaataaaaattaaagagcaaattgtgtttggaagatcgggtcatcgtaattcattgacattaggccacataactgaataatgtcttccttcagcaaaatacatcaaatgagatcaacaattatgactcataaacatgccttgcaggcataaaacagcagggaattagcatgtgaggctgata

SEQ ID NO: 544252 - DNA, 214 bp, Homo sapiens
attactagtggtgcctcccaaagtgctgggattacaggtgtgaaccaccacacctggcctaagagcaccatagttctttgaactgttacgaggattaaaagatgatatacatatgtgatccactctggatagttcctagttcatagaatgctctcagttgatagctgttccattgtgaacaggcccacctatccatgaggctagagtcgctaga

SEQ ID NO: 544253 - DNA, 671 bp, Homo sapiens
aataaaaacaatggtcctgccattttttatttatcatagcaatacatacttacagaagaaaaagaatcacacattttaaattctgatcattacactatttttttggggttgaataataaaagaatgaatctcttagtgactttttaaaataccttcaatgttggaaaaatgcaaattatgatatgataaacattcaataactggagtgagttcacttccaaatgaaagacacttggcacccagtcacagtaatgaaattaaacatcactgaagacagtaaggaggtctgcctggaggtctctaaggaggtctgtctggaaccatatgtttagtgtagattcacaatcaatccaatctttcaacctacattttaataatttagctttagaagataacatgtgaattagttttctctaatacgcccttgaaaagttttattcctgaacactataaagagagggaaattttttggttgtaaataacaactttcaaatttgggttttaataacgattattaaatcctttttataaagggcaagggcccactaaaacaaggggatttgggctttaccagttagagcgtaaaataattagacacaaaattattctgggaacaagacctaattggcctgtaggtgggaaatttttataaaaggaatcctgtccggggg

SEQ ID NO: 544254 - DNA, 111 bp, Homo sapiens
  misc_feature (1)..(1): n is a, c, g, or t
  misc_feature (85)..(85): n is a, c, g, or t
nggtcagtgtctcatagtggttagcttctatagtctagtagataacatgcagcatccgtcagtgagtagctctaatacagatcanagggacagcatcaaggaagcagatga

SEQ ID NO: 544255 - DNA, 993 bp, Homo sapiens
  misc_feature (122)..(122): n is a, c, g, or t
  misc_feature (134)..(134): n is a, c, g, or t
gtaatgattatgattctcagggattgggcgaaaggcgttcacagaattctcgcgttaattccttctcgtgagacacttttcaagccacgttaactcaaggacgtgagcagtaagcacgtgantgaattgctgantatatcaggacgacatgatcatgaagccatgtgagtagattatctcttaaaggatatcatcatggtaatgactatttaatacagcctatgcctatagctttcttatctcagcaaaataaacgtcaaatagactatgatatcatagtatttctgataccttactttaagatgaaacaaccttgacgtgcaccaatcagtctgcacatcccaatcccttcacattcttactacacattattgctagatcactgttctttggttaggagcactttcactgagcatacatttgtccatggactacatagtcaactcagacatttacatcacgctaaatcctttagaacttggcgttgttgaaaatcgggagtatcatcatatttacaagtcatttctatgttaaatcttacagtaatgtgctagtctgttgtctctggacatctacgctgttaacaccggaacagttagaccttggattcatgtgaggctccttcccagtgggcttctaacggtggtttcgccgcaaggtaagactttccgttagcgttaacagattgatactatttaaacatggagcccactaagtgtgccagatatacttaacggtaattttggggtactactccagtatccccacttgtccttctgtgaagccatcctctgcacacgtgaagtcgggtctaatcgcctttctggcgtggattgaaacaattgtgttaacattcacacacatttgcgaacgtgccgcacccaggggaccccctgggtatcggtgacaacattatacgatagttaaaggacggtcttcataaattctgtcgcgtgcaaacaggtgtaaaggtaaattctacgtgggttagca

SEQ ID NO: 544256 - DNA, 873 bp, Homo sapiens
  misc_feature (14)..(14): n is a, c, g, or t
  misc_feature (165)..(165): n is a, c, g, or t
  misc_feature (414)..(414): n is a, c, g, or t
cacggcgcgggcantgtggccacggttgacgtagcgggtcaagcccacgagggcaccacgggcgtctggacgccagtacggcgcgaacaggccagagaaggccggcacaaagtaggcgccaccattgtcctcgacggtgttagcgagagcttcgatttgcggggnggtctcgaatatcttgaggttgtcgcgcagccactgtaccagcgatccagcgacggcaatcgaaccttccagggcatagacggtgggctggtcaccgatcttgtagcagacggtggtcagcagaccgttctcggagaagatggcctcctcacctgtgttcatgagcatgaagcagccggtgccgtacgtgttcttcgccatgccctttggaagcaagcctggccaaaagtggcggcctgctgatcgccnagaatgccggagatcggggtatcgatcagcaggccgttcttgcgaccatagccgtagatctcggaggaggacttgatctcaggaagcatggacttcggaatccccatgacctcgcacatcgagtcgtcccactgcagctttcggacgtccatgagcatggttcgggacgcgtggtcggatcggtgatgtgcacgccaccgttaataccgccaagtcaggttccactagcacccaagtgttcaatgttaacggaagcagcagatcgccggctcgggcctcgccaaggctcctccacgttgcgagaatccattgacttcggccagagaatcggtgacggccgacccacatctctggcgcggcgggcctggtaacagtcaatcgtcagaacttgatcgggtggcgccaagcgttcacgccagggttggccacacggtgcggtggatccaacaagcggggcgt

SEQ ID NO: 544257 - DNA, 115 bp, Homo sapiens
tggcctggcgtttctattagctcttataagattacacatgcagcatccccgttccagtgagtcaccctctaaatcaccacgatcaaaagggacaagcatcaatgcactgcagcaa

SEQ ID NO: 544258 - DNA, 1241 bp, Homo sapiens
  misc_feature (279)..(279): n is a, c, g, or t
  misc_feature (379)..(379): n is a, c, g, or t
  misc_feature (757)..(757): n is a, c, g, or t
gctgctggatggcttctgtgcgagtccggctgcgcgttctgctccgcgcgggggcccggttcccgggctgctggccatcgcgcgtcggacgtgaacgtcgggcgtgccgggcggcagggagactgtgtcgcgtccgctttcgggagccaagcgcggtgctggtggagccaggactgcggagcgctgccaggagtgtcagctagttgacttagacataattcaagaaccccccaatagaactacgcctgtacgctctggtacgttactagacgagggatnctgagtacatcagctctgtgagcaagctcggagcaattgacgaagacgcttcgcgcggctcgtcattcatgacctctgtgaccggccttgcgcgtgtctntctctggccaggactgggacgcttcgacagagatgattgttgtcgtggacggatgcgcccggcacctactactgctggtggtcactggtacagcgccgtgtcaggcctgctagttgagctcgcgagttcgtaccgcagtcctaaccttggtgctcggtcttcctgtccatgcaaccgtgaagacctcgaccgcgttgaagaaggctagccttctgtaggggccctggactcttgtagtacgtaaaccgcaattccttaggcagtgagcaaccccatgagtactagcatacgtgactcaagtgatgatcccaggaatagtggcgatcatccgactccctatttcatcgggttggaaaacgaccacccctatgcgtaggnaatctacgcattctggcgcgagccctgggcggcgctcggaagcggttgtcctatgcgagcttcgggtgcgtgcctcattcccccgcgctgacgggacgcgcccgtgcagggcttggggccttaggttcggagccaacgtgttgggatccccagctaaagcgaagcaaggatgctatgaagccaactggacaggcatgctccagctggaaaacgcccccaagatgggcatggggcccattcccaagaacgcaaatgcctccgaaccgtaggcattgagagcaaatgggtcctatggaatgggcgtgaaaaggggccaacaggggcccaaggcccggccctgtggtcgacgccaggacggggatccggaacggttgcaaaaaggtttcgcgtcacagggttccattcttccaagaagaattccatccaagaaaagtacccgtggagaattgtaactttagaagacgggtctccaatgaacaaactg

SEQ ID NO: 544259 - DNA, 238 bp, Homo sapiens
tacgtgtacagtgtataatgcttggcagcatatctgaatacaacatgaacggacacggtaccaccagtgctgcgtggagaccctgcactgcgggctcacaactcagctcgcaatttcagagtacatgtggtggggtagcggtgtgtgcctccggtccccggacaggcagaaccacgagcagcaactaacatgggtgagaggatctttgacgggggtgtgacccttgaggtcggaagag

SEQ ID NO: 544260 - DNA, 343 bp, Homo sapiens
ctagagatccctccgcaccctgcggatgggcactatcatgacgcggataccctggagcgcaacacccctttggatcaacttctatcacgctgagtgttccacgacatcctggccttggtctctctttgcagtcatctttcctagtgagattgctgggcaatgccctgggtgctctgagtgacggcacttcgaggcccagcggatcatccatgccatctggttcctcaactaggcggtagctaacttcctctcctgcctggcgctgcccctcttgttcacatccattgcacagcatcaccactggcccttgggcgcggccgcctgcagcatcctccatggtact

SEQ ID NO: 544261 - DNA, 900 bp, Homo sapiens
  misc_feature (228)..(228): n is a, c, g, or t
tggttcgcggtgtttaattgtcccgcgggggtttcccgccgtgtgtgtgccaaacccggggaatctcccactcttgtgggccccccgccttttgggaacccgtttcgcgccaccacacgggcgccagtgtccggtctcccccctctgtggcgccccgctccttcccgtgggaagttgtccggggcgtctcaaaaccaccgtttccttcgggcttatattctcgccccnggacaaattctgctcttgcaatgcgctgagcccccttttctcggcgcattgcccctgctgcatagcctctgggctttctaaccgtcttcttctcagtatgtctgaacctccagggattggtgccccccccgtgttttccccccgggcactcaagaccccccctcaacaagagacggcgtatacccccccgcggctcctcgtaggcccccttcccccttggaattaactctcgcccctggcccgctttctgggagtctctcccccccgggtgtgttctcccccgaggagacccccctcttctagggaggctccccgagggcaccccccccttctcccaaaagcgtggggaacgcagcctctttcacacagacagagtgggggtgcccccccggcatctgccacctcgatgggtggcccgccaaagaaggagctgggccaaccaatattctgttgcaagcatgtctctccagcacggaggatagggacgcctttggtgcgcccccggaaggttttcaagccgcgcgccctctcctcgtgaattacggtctgtgagcgctagagacacgaggtacgtcccccgcgacccaattgggccgtcgctttcttctacgttgcacccaacagccccgtggccccaaagggaaaaaacactcttttcgaacaaacaaaaca

SEQ ID NO: 544262 - DNA, 1232 bp, Homo sapiens
tataaaattggggtttcgccagtgtttgcccaggggggctctggaaactcctgtggagcttcaggtgatccgcccgcctcggcctttccgaaggtgccgatcacggggtggtgagtcacggcggcccggatctccacgtggtttctaattctccaagggagagtgcgaactctgtggtataagaagcctcaatcgtgggtgaacctcttaattccttatagtgaaccagaaagtgtgtgcagggacaattcgtgaacgtggaattccaccccgtgggcgaaaagtgttacacggagctttaatagacacgtgggcacacaagcgagagcgtgttttttacctcttatatcgcgtggtctctttgtcgcgtgagacaccgcagacacaactcttcgagagaggacctcgtgagaagggtggggactctcccgcggcgtggagaggacaagtagcaaacccccggagaccccacataagaggacactccaattacaaacacaacacacaaggtgagacaataaaagatatacgacagggagggagcgcagagaccgggcgggaagagcctctcagggaaacaatcccaagaacgaaatcccccggggaacgaacagaacgcaacacaaaagaccgcccaccacaaaagcgtggcgccaaagagagacacacaaacaaaactcaccaattaacacaacgtatcgggggggcgacaacaaagaggggaaaacacacagcaacacacaatcgcggaggcaaccaacagagaccaacacccacacaaacccgggggccccaccatatcgtggaaccacctataggaaacacatcgagagagggaggatatattaggcaatgataattagaaaccccagtttgtgtacaaaacaatttttaggacaataaagtgagagagaccaggtggtagaaacaagtggagcgaacagctagggcgcattccactcccaaagaggagagatggagcgaggagaaactctggggaaacgtacaaccctgcaacaacgcataacagcagcaagacaaccacaagagaacacaaaaccacataggcaaacaaactccaacacggagtagaacaaaaaagacacacgaaacgaacccaacgcaacacaaaacgtgcggacaacaccaaaaagcgagagggcccccaagcgacaccacacacacagaccacaatcaatacaacaccaacaccagaggacaacgaggaaaaa

SEQ ID NO: 544263 - DNA, 158 bp, Homo sapiens
ttcagatagcgtagtaagcggagcatcagtaagctcagtaagcggagcggtcacgcctgctgggtatgttgtgttgaaagaagaggaggcgaggaggtggcatatgctccgttaactgatgctcgcttactgatgctccgcttactgacgcttactga

SEQ ID NO: 544264 - DNA, 263 bp, Homo sapiens
cagtgacggatatctgcaaactgttccaagcatctgctgttacccaggttccaaagtcgcttccacattttcagcagcaccccactcgtggtaccaatttactgtattagtctgttttcatactgctgataaagatatatccaagactaggcaatttacaaaagaaagaggtttactggacttacagttccatgtggatgggggaggtctcacaatcatggtggaaggcaagaaggagcaacgtcagtgctcgttaacactgg

SEQ ID NO: 544265 - DNA, 433 bp, Homo sapiens
  misc_feature (52)..(52): n is a, c, g, or t
  misc_feature (72)..(72): n is a, c, g, or t
  misc_feature (87)..(87): n is a, c, g, or t
  misc_feature (124)..(124): n is a, c, g, or t
  misc_feature (142)..(142): n is a, c, g, or t
  misc_feature (161)..(161): n is a, c, g, or t
  misc_feature (175)..(175): n is a, c, g, or t
  misc_feature (193)..(193): n is a, c, g, or t
  misc_feature (199)..(199): n is a, c, g, or t
  misc_feature (201)..(202): n is a, c, g, or t
  misc_feature (215)..(215): n is a, c, g, or t
  misc_feature (223)..(225): n is a, c, g, or t
  misc_feature (228)..(228): n is a, c, g, or t
  misc_feature (235)..(236): n is a, c, g, or t
  misc_feature (238)..(238): n is a, c, g, or t
  misc_feature (241)..(241): n is a, c, g, or t
  misc_feature (245)..(245): n is a, c, g, or t
  misc_feature (247)..(247): n is a, c, g, or t
  misc_feature (249)..(249): n is a, c, g, or t
  misc_feature (251)..(251): n is a, c, g, or t
  misc_feature (256)..(256): n is a, c, g, or t
  misc_feature (260)..(260): n is a, c, g, or t
  misc_feature (266)..(266): n is a, c, g, or t
  misc_feature (271)..(271): n is a, c, g, or t
  misc_feature (276)..(276): n is a, c, g, or t
ctgaagagcagcacagtggggcccgtgctgctgtgggagaaactgaggctgngagcctcagcagagaccggngtcaagagtctctgngaactgcataggcctgaggaacatgcattttcaagtngtccattgatggtttcgnacctgaatttctcaccttntgtgaacatcttgngaggtgggggttttgcangggtgntnnaagcaaggcttgnagcccctnnnctncagctgnngnctncttntnangncctgncctnattcangccantttgnagagaaatgccctgacctcgcaagatggttgcccacccccatgtgatatgtagaggactgtgtgctcaccactgtgccctgtacacatcttaggggacggttaggattaggattctggcatggcgtgcatccagacacattgtctgagctccgtctt

SEQ ID NO: 544266 - DNA, 394 bp, Homo sapiens
  misc_feature (52)..(52): n is a, c, g, or t
  misc_feature (72)..(72): n is a, c, g, or t
  misc_feature (87)..(87): n is a, c, g, or t
  misc_feature (124)..(124): n is a, c, g, or t
  misc_feature (142)..(142): n is a, c, g, or t
  misc_feature (161)..(161): n is a, c, g, or t
  misc_feature (175)..(175): n is a, c, g, or t
  misc_feature (193)..(193): n is a, c, g, or t
  misc_feature (199)..(199): n is a, c, g, or t
  misc_feature (201)..(202): n is a, c, g, or t
  misc_feature (215)..(215): n is a, c, g, or t
  misc_feature (223)..(225): n is a, c, g, or t
  misc_feature (228)..(228): n is a, c, g, or t
  misc_feature (235)..(236): n is a, c, g, or t
  misc_feature (238)..(238): n is a, c, g, or t
  misc_feature (241)..(241): n is a, c, g, or t
  misc_feature (245)..(245): n is a, c, g, or t
  misc_feature (247)..(247): n is a, c, g, or t
  misc_feature (249)..(249): n is a, c, g, or t
  misc_feature (251)..(251): n is a, c, g, or t
  misc_feature (256)..(256): n is a, c, g, or t
  misc_feature (260)..(260): n is a, c, g, or t
  misc_feature (266)..(266): n is a, c, g, or t
  misc_feature (271)..(271): n is a, c, g, or t
  misc_feature (276)..(276): n is a, c, g, or t
ctgaagagcagcacagtggggcccgtgctgctgtgggagaaactgaggctgngagcctcagcagagaccggngtcaagagtctctgngaactgcataggcctgaggaacatgcattttcaagtngtccattgatggtttcgnacctgaatttctcaccttntgtgaacatcttgngaggtgggggttttgcangggtgntnnaagcaaggcttgnagcccctnnnctncagctgnngnctncttntnangncctgncctnattcangccantttgnagagaaatgccctgacctcgcagcaaggatttccccaccctcccctgtaatgaacaggtcagcgcggccaccagagcgtcctcgaaccatcctaccccaatgacgctggctctttgtc

SEQ ID NO: 544267 - DNA, 197 bp, Homo sapiens
catcagtggacaaggtgatggtggaggcatgaaggccctagatatgaatcatgtcgcggcccttcatcccaatctcatcttgttttctgcgcaaggtaggtttgtcaacgaaagggtgtaacgcacactacgtcatagtccgccgtagaagcatttgcggtggacgatggaggggccggactcgtcatactcctgct

SEQ ID NO: 544268 - DNA, 243 bp, Homo sapiens
ctcccccactatagtatccccatctccaaatatctcatcttctccgtatctaatcaccacccaacaatgactaggtcaaactaacctcaaaacaaattatatatccatacacaacactaaaggatcgaacctagatctctatatatctagtaatacctattatacatattttatatgccatcaactaaacctacctacggactcctaggctacactacattgtgacacctaatccacccgaac

SEQ ID NO: 544269 - DNA, 889 bp, Homo sapiens
tggttcagaggcaggttctagagctgcaggagggagatcgtgattgcagaggaagagcgatcatgtgggctaacatctgagaagtgaagaaatcggaagcccgagaacacactgtggccagccctgggggatttttttcttctatgcctcgtctggtggacatgacggttggcgtgtgtaggcagtcgttttcctgctgactgatagtttcttggcctggaagaggtactgagtttaaaagagacagctcagtgtgacacgtccatggaagagttagcctcttcgtgtgaagatctcgcctaccctgcatccgaatgacaatgtcgtggtctccacaaatgctccttatccaccatgtgcatatactgactgaggggcaaaaggatggcttcgagaaccttcgagttccttcagcggtgttaggtagaaggcacgtgtggtctcttgccacacaggttgaaagaagagcaggacaaaagaatcctcgaagctgtatgtatccagccacagacggctcccgatgcgctggccctctgagaaaagacttgaatggacgcagagtataaaacagaagatgtgaaagaggcaaagtggattgatcctgcagctcaagcaggttcttgcctgtggtaatagcaagttatgagggcattgacagttgtgattcagtcacctgctgtctgagcgggcaggaagctagctgaaacaaaaacaaaatcctatctcaagaacttgttaacctccggggagagctagtccactgcttcaaccacctgtgagaaattagaaaaagccagggaatggggttacaaaccgtgttgaaagcattcgtccaggagaccgggtgaaaaacgaacgagagaacgggtaagagtttacccaggggttg

SEQ ID NO: 544270 - DNA, 531 bp, Homo sapiens
tgttacacggttgcccggagtttcaacggccttgccggtttgacacagttacccggtcgcagctgtgtgtcagtgcccaaaggaggtcggttgatggtgcttacacagacatgaagtatggtgtaataagaataatatctatccaaaagatttttacaaatagggctgtgtttcaaaaataaaacaaaacaagaaaagcagcagtgatcatagagaggtcacactctaagtggggtcgcggcgtgaccacgcttcacggtcacgctcgtccgtcctgcagtggcgatgtttacatggtcacacgtgtgtgtatcaccagtgggtcaactgcttgtcatatcctcccgtggcagttggtgtagacactcttactgagcaaaaggcaatgaaaagtcttggttcccacactgcgatatattggaattttcacctcagtttatgaagttaatttcgaaatccatagtcatctaagcatgaatacctgtctgccatgtatttcactcttagtgagccaaaattgttagtttgtta

SEQ ID NO: 544271 - DNA, 109 bp, Homo sapiens
ttaagaccccatactcattacataaacttgcatcgcgatcgagttcaattggtatataggtttgcaagttgaattattctgcacatgagtcatgggtacgactcaatcg

SEQ ID NO: 544272 - DNA, 128 bp, Homo sapiens
tcagtgtagttgtgtccctccttatttcccagtgatggaagatggtgacagcttacaacacaagtatgagcaagaaaaacatgagtaggtcagcaaaggtcaatgtgcagggataaagaaaaagtggt

SEQ ID NO: 544273 - DNA, 306 bp, Homo sapiens
  misc_feature (275)..(275): n is a, c, g, or t
ctctagcaggatccccgggcacagaacttagaataacactgtacagctcacgagaagcccattctcatctgatttcacttcttcgctacctcctcaggagaagggagaggcccatgctattgccttccactttacctgggttgcaagctgaggctcacaacttatttcaaggacctcacagcatgttgggatggggcaggacctattccctatgtcttctttctcctatttctgtgcccttttcaagggtacccagcctcgaaatctccttgtcntcgtcctagctctttcctgtgctgacaaccc

SEQ ID NO: 544274 - DNA, 383 bp, Homo sapiens
gcagagatagaaaaacctctggcccatttggataaaaacttgtacaaacctccagctcactcagataaaggaacaagaacgacctagcacagaaatgcctttgtttggccagccacggtggatcatgcctgtaattccaacaatgtcggaggcagctgtgggcggatcatctgaggtcgggagtttgagaccagcatgaccaagatggacaaaccctgtctttactaaaaatacaaaactagccaggcatggtgctgcatgcctgtaatcccagctacttgggaggctgaggcaggagaatcgctagaacccaggaggtggaggttgctgtgagccgagatcgcaccattgcactccaggctggccaacaagagcaaaactgc

SEQ ID NO: 544275 - DNA, 139 bp, Homo sapiens
cggccagatctcgaggtcaggtgtacgagactagcctgcccaacacggtgaagcccaatctctactaaagatacacacacaaaacaagacgccggcgtgatgatgcatgcctgtaatcccaggctatcggcaagctgag

SEQ ID NO: 544276 - DNA, 115 bp, Homo sapiens
  misc_feature (27)..(27): n is a, c, g, or t
cgaaatcaatctcgttccccagaacgngtaaatcatggattgtgatggacggaggatcccctgctcctcactgagaggctccttaaaggtgctagcccctgatacagccacaccc

SEQ ID NO: 544277 - DNA, 917 bp, Homo sapiens
  misc_feature (23)..(23): n is a, c, g, or t
  misc_feature (29)..(29): n is a, c, g, or t
  misc_feature (330)..(330): n is a, c, g, or t
  misc_feature (371)..(371): n is a, c, g, or t
  misc_feature (382)..(382): n is a, c, g, or t
  misc_feature (505)..(505): n is a, c, g, or t
  misc_feature (524)..(525): n is a, c, g, or t
  misc_feature (558)..(558): n is a, c, g, or t
aaacctatactgggcttaagtgntagctngaggcccctggcggtgttttaacaactttccggggcacggaggcttctctgagtaggagtcttcatccttagcaccacagacttctgaggtcctgtgccctttacttgctggtgaggtgtcataggtagaaaagggctggcccttcagatctgggggtgtggtgagtggcaagtaagggcagaattttaggagaaccagagtcacccgctggctctactgagattgttacacccagaatccttttgtgtttttttgtggtttttttttttttggaggtgggagtctggctctggtcacccnaggctgggatgtggctggtgggtgcaatctcgggctcactngcaacctctgnttcccggggttcaagctatttctcctgtctcagcctccccagtagctggggattacagggcacccaccaccatgcccagctaattggttggtatgtttagtaagagacaggggtttcaccatngtgggccaggctggggctnngaactcctgggacctcaagtgatctacccgccntgggcctcccaaagtgcgggcatttacagggtgtgagccaccgggtgccccgggccaccaagaatcctttggggtatagccaagcctttgggttaccggcctcattgaagaatatgcttcccgcatggtcctagtcccagttgtattctcacaggtgtatgtcgcggacacaatccaaatcataaaccgggtcatggccaaacatttctgctatagggagggggacccacagaacccaaaatggcacgggtcctcctcaagaggagaggggccgggtctgtaaagggtcaagtcggcacactgggaaattccccaaatttgatcttcccagttaaaaactttcccctgagaacgaggtg

SEQ ID NO: 544278 - DNA, 469 bp, Homo sapiens
  misc_feature (55)..(55): n is a, c, g, or t
  misc_feature (394)..(394): n is a, c, g, or t
taaaatccatattccatttattagtggattttattgtttggaaaggcacatgcangtgactaatatactttcaatttgcattgaagtattgtttaactcatgtcttctcataaatataaacatttttgttatatggtgattaatttgtaactttaaaaactattgccaaaatgcaaaagcagtaattcaaaactcctaatctaaaatatgatatgtccaaggacaaactatttcaatcaagaaagtagatgtaagttcttcaacatctgtttctattcagaactttctcagattttcctggataccttttgatgtaaggtcctgatttacagtggataaaggatatattgactgattcttcaaattaatatgatttcccaaagcatgtaacaancaaactatcatatattatatgactaatgcatacaattaattactatataatactttcaaataaaagaatctaaga

SEQ ID NO: 544279 - DNA, 328 bp, Homo sapiens
tactaagccccgcacttctagtggtctcacctggaggcaagagggaggcgacagaagttcctgccacgctccgctgcctcctgctctctggaggtactgagacagggtgctgatgggaaggagggtagcctttggggggccacccggagcctggacctatgcagcgaggccacgtgccaccccacctcttggctctgggtccctgctcccctttgggaagtgagtgcgtgatttaaatttctttaggggcaaagtggtcagaaagaaaatggaggacttggagtttcactgcagtaaactggccccatgcggcccccgccaaaaaaaa

SEQ ID NO: 544280 - DNA, 574 bp, Homo sapiens
ccggcggtctgacatgtcagaatgggaaacaacccctgtacgtcatatggaaccaaaaaagagctggcatggccaagacaatcctaagcaaaaagaacaaagcgggagtcattacactactggacttcaaaatatactacaaagctatagtaaccagaacagcttggtatgggtgtaaaaacaaaggcatagaccagtggaacagaacatagaacccagaaataaatccacatatttatagccaacggattttggatacgggtgcaaagaacatacatgggggaaaggatccttcttgaattggctgagaaagctgggtatctctcaagtcaagatgaattacagacttaaacataatacccgaaactataaaattactagaagagagcataagggaaacacttcaggacattagtctgggcaaaaatggtatgtgtagcacatcaaaagcacaggcaacaaaaaaatagacaaagcagacgatatcaaactaaaaagcttctgcacagcaaaagaaacaatcagagcaaagagacaacctgttgaatgcagaaactatctgcaaactattcat

SEQ ID NO: 544281 - DNA, 257 bp, Homo sapiens
tctgtgctgaaaatgatgtctccacactaggctatgactcaccttcagcactgaggtccaagagttggagtttgtgaagttcgtgacctcaaaccccaatgggggcccacattcttggtaaacagaggagaataagaaaggagtatgtacacctgggtatgccaagatgagaattgacagggaggccattccggcaaggcaggtttgggcgggctattcctttaaggaaagcggctctcctaatggaaggaatccaa

SEQ ID NO: 544282 - DNA, 389 bp, Homo sapiens
catggtctgtgggatcctgtcatataggcttggctcaggcctatctgaggtgctgacaagggcgggaggattggagggaggagggaagtgactatgtgcatgcagaagccatggtaattgcaaagggaatattagtccaggagctgctggcccaggaaattgctttctgtagaagctttccttttcatggttttcaatgcaaattgaaaacataaatgggcacagaaaagtgtaggggggacaggtggggtgccagttgggatgtgataacatccaaaatcttcagcagggtcttaatttgcagaagagaatttcaagtaacaagagacaaccttataggatattaaaataatgttagagcatgttttgctgtgacctacccacaacca

SEQ ID NO: 544283 - DNA, 786 bp, Homo sapiens
  misc_feature (614)..(614): n is a, c, g, or t
agaatacctttgaacctaatgggccctttaaataaacttgttccataggacacactgagggggatatttgatacccggaacactttcgggtgggcctttcttttgggtttaaaatgtttaagcccccccataagtgtttaaaaattccacctagttgttaaatgagccgaatgcctgtaggggaaatccaagtggtccaggtaccctggccctatttttaaagctagggtatatccaccctatgtcatacccacttcacgtaatgtttgctcttttaaaaataaggtgaacccacccacttatagttggttgtatgcccctgcacacttccacgaggatcctagttctttaactttcacaggttgtctgcttaggtccctctctgtttatactatgagcggagatgcttatatataaaactaatgcgagcctgaatgggattttcacgcccaatttatgtcttgtctctcactcttgagtttggaaattaaattcccaattctaaatgaagtgtcacgtccacccatagctctatggggatgaagaaatttgccctactttgccccggtcctaagactgtgagttgtccaaatccctatgactgtaagctcttncaaggagcccacagaaggcgcacattttttcccggtcaagtaattttttttaaggtgtttggcagccctctgtaccctgtggagtactccgtaccttttgtttgatgttgctgaccagacctggaaaaaaatcccctttaaaaaaaaaccccttaaagtgtagccaaaccga

SEQ ID NO: 544284 - DNA, 157 bp, Homo sapiens
ctagagtatcccaagcttacgaggcatactgggctgcttcttgtaggggcttgatcatttatgaagtacttgggtaaatttataacaccccgcttccttttgtttacgcctttaattccgtctttgtgtggattgcctttcatcatagatgagtaca

SEQ ID NO: 544285 - DNA, 125 bp, Homo sapiens
  misc_feature (119)..(119): n is a, c, g, or t
cttgaacaggataacgagggctcatcagcttcgaggaggagcgggccagctgtccttcaacactggacacgctctgttgaccacccagatgctggtgcacgggaggacactgctccaanctgacc

SEQ ID NO: 544286 - DNA, 442 bp, Homo sapiens
  misc_feature (111)..(111): n is a, c, g, or t
  misc_feature (153)..(153): n is a, c, g, or t
  misc_feature (264)..(264): n is a, c, g, or t
  misc_feature (287)..(287): n is a, c, g, or t
  misc_feature (289)..(289): n is a, c, g, or t
  misc_feature (306)..(306): n is a, c, g, or t
aacgatggtcctcagctcaacgatggtcctcagctggggtaatggatgtataacacctctcgtcactgtttatgagtctataattaaaaagcagggcctggcaacagagtngtgttgaatcccccattaccccagctgagaggtgactttttnctcctggcatttaacgtaattcttaactacctatttgctctgtgcctttctcccccaggagaaagcagaagctgagtctgttttgttcactgctaaattctctgtctcctngcacagtgtgtggcacctgtgtntngaagtcagatgtttggntgaaagaatagttatggacacaggtgacttaaattctctcaggcggtctgcagttaggtcaatacctccctgtcaggacgatgggagaattagatgtgtataatgtagctcaagctgaggaccatcgtgggggtac

SEQ ID NO: 544287 - DNA, 283 bp, Homo sapiens
  misc_feature (228)..(228): n is a, c, g, or t
  misc_feature (258)..(259): n is a, c, g, or t
cgcttggggctggatgagccactgcacccagcctttttttgagatggagttttgctcactcttgtcgcccaggctggagtgcaatggtgcaatctctgctcactgcaacttccacctcctgggttcaagcgattctctggcctcagcctcccaagcggctgagattacaggtgcccgccacaacaccgggctagtttttatatttttagtagagatggggtttcaccnatgttggccacgcgctggtctcaatactcnnctgacctctatgcatactgcctgc

SEQ ID NO: 544288 - DNA, 232 bp, Homo sapiens
aggagccagcctcccaaagtgcgggatacaggcgtgagccaccgcgcacagcaaggcgggtctgctggtgtttcccagactagacgggtcttgaattccagtgctcaagagatctcccacctcagcctcccacagtgctgggattacaggcgtgagccgccacacccagcctattcaaaatttttttttcttagagacagggtcttggttgcccaggcggggcgtgcagggg

SEQ ID NO: 544289 - DNA, 978 bp, Homo sapiens
  misc_feature (228)..(228): n is a, c, g, or t
  misc_feature (687)..(687): n is a, c, g, or t
  misc_feature (737)..(737): n is a, c, g, or t
  misc_feature (894)..(894): n is a, c, g, or t
ggcgaactggcgcctccggcccccggcccggactccggtggctccggggaggtagacgagctgttcgacgataaatgaacgccttctacatctggcagctaccagcattgcataaacgaggcgtcagcgtggttgaagctgtcaagctcctagagagagaacgtggatcagggacggtcttccggatatagagctgtaccttgtgcgtcagagtgaaggttctggtgntggttccgtggattgagtatcgagtcccttccgtcggaccccatggagctccgaggtcctgtgacgcattgtttgcctgatctaccgtcggcccatcgcagaggtcaggagggtacacgtcgatctgatggtccgcagtgctggatccgatgatgatgacgcagggcagcgtggtactgtgaatcaatcaccaacccttgccttgctacatgggactctgcacatcctactactgattcgtccgatcgaacgcaagtaacccccgtgagtgtccgtccgcttgcggtgctggctgctagccgatggggtgacaagccctgagaagtgcaacagacctatgaactagtgcgagaatccttgtcttgagagctaggaccccgaccttgggatccttctgcaccgtgcacagggagctagacatgagtacattgcattggatcctagcgagcgaaggattgnccaacccttctagccctatggctacgcacacttggccctgaggatcaagnccattggtgccagcagggttgagttgaagaaaagcgttagcatgggaattgccttgacttaagcatactttcccaagggagcattggcttcgactagagttgcttcgagcctaaccatgcgtgactagcttcaaatgaggccaaggccgcgccctgnccacattggggccccagggtcccgctaggcgatggccgcttgaagggcccttgcttgcacgaaggcggctagaacgaagggatc

SEQ ID NO: 544290 - DNA, 255 bp, Homo sapiens
ctggtgggggtgcggactcatctctgtccgctggccacagccctcttactggtcccggtaggctgccattttctcacactcttaccttatcatgcctcatggccccacccccattctaggctgcgaccttttcgccaaagtcaaagcttctatcacctttactggcccccttcacccacgacgtcccctccggctcctctccgcatagtccggccccggacccccctttcccacgatcccccgttccggcctctc

SEQ ID NO: 544291 - DNA, 209 bp, Homo sapiens
tgaggacggttgaactcctgacctcaaccgatcgcctgcctcagcctcctgactagctcggattacaggtgcaaacataccacggccagctaatttttgtattcgagatattctttttgttgttgttagttgttgagacagagtctcactctgttgcccaggctggagtgcagtggcacaatcttggctcattgcaacacggtctctca

SEQ ID NO: 544292 - DNA, 197 bp, Homo sapiens
aagctgcactggactcaaccaagaaagagagaattcaaccagatggtagtgaacatcagaaggactgaatgacatgcaagcgcaattggtagaggatgtgcacataggatgagcttcagatgcagttggcagcaaagggggttattttggcatttcgttctaactttggcccttcgggttctcaggtttgctggttc

SEQ ID NO: 544293 - DNA, 312 bp, Homo sapiens
tggttcctgcagtgtagagatatgaacagggtatggtaggattggggaaaggggagagatacccattaaattcactccttatcctccccaaagtttaagctctatttctgcgccctagtcctagacacacattatactcagggagttttgcctgaataccaggtcccactgcccactggttgaagagtttgttttacatgggaaaactacgctggagcatgggtttttaggcactctgagtattcttagggtggctttgttcttgcctcttcagggtaattaggatggctgatctagacattttgttcttct

SEQ ID NO: 544294 - DNA, 259 bp, Homo sapiens
ctccatgttggaaaaagtccaaatttgcacatagattcatctaaatccccgcgtaaagataactgttagtgcaaagaggaacagctctgtgaacactaggaaaaaaccttgtggagagagtaaaaaatttaacaccctagagataacagcgcaatcctattctagaggccatataaacaattgtgtttacgacctagaggtcggattaggacatgccgatggtgcagccgctattaaaggctcggttgctcaacgatta

SEQ ID NO: 544295 - DNA, 100 bp, Homo sapiens
acagcagtgatcgagccggtcccacttcaggactacagtgaacattgtaaacacaatgatagtggtaaaagagatgttggaattaaccaagcaacccctt

SEQ ID NO: 544296 - DNA, 1535 bp, Homo sapiens
  misc_feature (551)..(551): n is a, c, g, or t
ggcggcctcgaggtgacaactgtctccgtcgcaggctccggcggtgtggctgcatggatgtgtctgccctggctgctgtcactgtctgggtctgtgcgatgccactggtgtggcctgcctgcagtcacctatgtgctgatccacctgtcagcatctcatgtcgctgtggccctgggttgttaccatttcgtggtgaaggcttccaccgctctagtgatgacgccgtatccgcgttcctgggcatgtccaatacatggctctccaattcaatgcagtggagcgaaagttcaatagcctgtggttctaacgggtggtatttccccaaagggtcccttaggcgggaagccttgggccccctccaatggtggtcccggtggtgcgcctgctaaaagggtcctgaattagtccctttttttgcgcccgcacattgggctttgaactcccctcgctgggcaacggtgtgttggtcctattgtgtcccaatcgcggctcttaggctcgggtatggtcccataatcgctctcattggtcatttgtgtaggagtaggtcnctcccctgtgggagatgcgctccttttcgggcagacaaacgcgcgaagtgttttcgaaatgcccatagtcgggcttttcgcacgggctatttatgcgcgaaacgtcaggtaggggtctctcaactcaactcatactgcgcggcatttcatatgggcgcgaagtgagccgccctagaaggagaattgcggccaaaacgaaaccggttttatattaagacagcccgtagagctgtagagggtcgcacgcagaaagcgttttttttgcgagaaaaagagccagatcccgatagcccgccgtagggggttcgtgcctcgacgcatacgaacggattttttttatgctggttgcggttcgaaaatgatctcgccggtcgccgtatacgcccgggcgacgcctgctggtgttttgtaaaaggcgcgccgcgctgtagttattttagggtggagccggcacccacccatgtgggtggatgaacaagctctccgcaggtttttaagggcggatggcgctccatcaggatggtcgctcctctcctgtgattatttattgagtgcgctctcggcatgagagggctgcccccccgctgtgttatttataaaacagccccgcgaggtgggaagcccacctggaggaggggcgggccactcatatgtggggggcgacgacacatgtatttatattaaaaaggccgcctcctcgtatgtgtgtgagtcgtaagaaacatgagctggtgcggtggttcactaaaaaagatactgatctgtcagctgccgactgtgtggggtgaggttgctcgctccgacttgagtccactactgatgccgtcgctagttgaagaataaaattgacccccgctgaggtcgtatgaggtgggtgggtgtcagctatcgaccgtagtaatattagatcatcgtcgccgccgacagtccacgtacgtatgatagagtcaaatgccctatccagctaaatattagtccattatg

SEQ ID NO: 544297 - DNA, 397 bp, Homo sapiens
ccgattagcccagagaaccgtctatctcttgtgaagtttagactgtagatcctaggacggacagctctcaggacactagggaaaatcatgttgcagagagagtagaagattaatgtccatagtaggcctaaaagcagacgacaattacgatagcgtgcaagctcagcacccactacctataaaatcccaaacatattactggactcctcacagccaattggaccaagctatcaccctatagcagaactagggtcagtataagtaacatgaaaagattctcctccgcataagcctgtgtcagatgaaaacactgtaactgtcaattaagaggccaatctctgcaatcaaccaacaagtcattatgagcctcacggtcgggctgagcggggggggatcc

SEQ ID NO: 544298 - DNA, 386 bp, Homo sapiens
gcattcaattaacattaacctggttttcatgataggatatgtgtcaaatttctctttttccacttgtgcttttgaaatcttgtttcatctccttattttttaaactagttttgtaaagtttcctaattataaatctctctgtctctgtctctctgtctgtctcgtgtgtgtgtgtgtgtgtgtgtgtgtgtgtgtgtgtgtgtgtgtgtgtgtgcgcgtgtgtgataaatctgttctggctgcacattcaccttctacaattcaggccagccaaagcccataaattatagggtaacttgtaataagcaatctagaagcatactgttcaggagaaatataatgtgtaccacatatattaattttaaattttctagaaggatactaaa

SEQ ID NO: 544299 - DNA, 122 bp, Homo sapiens
  misc_feature (47)..(47): n is a, c, g, or t
  misc_feature (76)..(76): n is a, c, g, or t
  misc_feature (119)..(119): n is a, c, g, or t
tccagtagtataagcgacagacctatgtgatagggtactgaccttcncccggcctgccttgatcttggatcacaanacggttctgggcacttgaactcagggcccaagcagaagcacangcc

SEQ ID NO: 544300 - DNA, 1262 bp, Homo sapiens
tggtgtgcatgctgtgctgtgctgcggtgacctggtgcctggtggtgaatgagtgcgtgccgcgtgcgggccagctggctggagccgtgtagctggatgaatgctccccctccctgcttcccttgtgcctgatgcctggtggtgctgctgctgctgcactgctgtgactgtccatgatgctgtgtgctcccacacccctctgactcctgctgaccctgcacctgaacccccaccctgggcccgggagtgatgatcgaatgctcaatgtctgaaccatgaaccctgcacctactgactgtgcgactgtgctacaatgaagctgtggcctgcagtgccattgttggtttcctgcaagctgaggatgctgatggagggatgtgttgcctagctcgatgcagcatgataggtctgccatccaagacatggatggactttgtcccctggacgtgacgtgcattggaagccctgagggacggaggccacaggtgttggcaagcagtttcggtgacagtctgtgatgtgatggctttgagtacaatgggacattggggaagattagtttggaatttgttgagaagccaggagaggaagcaacaggaggtatgtctatgtgctcattgtccactgaagtgctggaaaactgggaagaattcaggataccatttggcacggcaacaacggaacttgagagaagaataccacagacgacaaaaacacgatggctgcagtactccccacacacccgtgcacggcgcatcaactcaggcaaacaatgacggcagggctactcagccagacggtgtagggacacgccaggtcgagtaggcaggcagacatactacaggttccgtcggtcacgagctctcccatgtcaggggcctcacagatcagcttggagacagttcctggtcacaacaccattggcagctttgaagagccacacatcgacattcgaagatgcattcccgcaaacccttgcgtcagtcgcccagactccacaggccccaccctaacaacataaggggttgcaggggaggcacccacagcggagcaagagaaaggcagacacacgaggacagaaggcaggtacgcagtcacagacggaggggcgggcaggaatggagagggcgacgggcacgggacgggcacaacagaggaacacacacgacacggccgccgagcacagagtagagcgcgagagcagaggggagccgaacgcaggggcccgcaatgtcttataggagccaaaaagaaagcaaagg

SEQ ID NO: 544301 - DNA, 903 bp, Homo sapiens
cgtatcctgaaaacgtggaggtgccttcaaggttctcatcgctgctcagtacagcgaggttcaggtccgcgtgctctccgagccagcccacttccattttggacaaaccaaccgcacccctgaatttctccgctaattccctgccggccaggtcccagcattatgcagggctagactagactcgtgcatatcttgttgtgtttccgagagctaacgctcattgccatacgtatgtgctgacaaatgaggagctgtcggggaaagtactccagaggcgagcagcccaggtgtgtgcacgtcgtgtgagctttgctgattccgatatatgtgcccccagccagtaccttgggtgttccccacgcttgggcatcatgcaacaaacaaacaggccactgagaatgcaaaggacggaacgtgagtgcgaattcctggggctgctggatgcttacttgaatgacgaggacttaatctggtgggcgaacgagtgacattggctgacatcacagtttgtctgcaccctgttgtggctctataagcaggttctagagcctactttccgccaggctttcccaataccaaccgtggttcctcatctggcattaaccagcccagttccgggctgtcttgggggaacgcggaaacctgtgttgaagaagaatggcccaagttcgatgcctaaaaaaggttcggagagaccaagctataaagggacacaccacggaacggacaagggtccgggaagaagaacagaaggctcggcggcgcggacggcggcgacacaagggggcgtgccctaccgtagaagcgactggtactgtgtacggcggtgtgtgccccagggaggagccccgttcccgccaagaaaccgttggggggcaaaagcgagcaccccggaaacccctg

SEQ ID NO: 544302 - DNA, 122 bp, Homo sapiens
ttcatagtaatacccatcatatcggaggctttggaactgactagttcccctaataatcggtgcccccgataaggcgtttccccgcaagtcaaaagaaattagagctgatcctctagagtcga

SEQ ID NO: 544303 - DNA, 260 bp, Homo sapiens
acattcaagcagtactctgcctcagcctcccgagtagcttggattacaggcgcccgccaacatgcgttgatcgttttttagtagagacagggtttcaccatcttggccaggctggtcttgaactcctaacctcgtgatccaaccgcttcagcctcccaaagtgctgggattacaggcgtgacccaccatgcccgggctaatcttctttttttttacagtctccctctgttgctctccatcacagctcaccatggcggacg

SEQ ID NO: 544304 - DNA, 350 bp, Homo sapiens
  misc_feature (194)..(194): n is a, c, g, or t
  misc_feature (342)..(342): n is a, c, g, or t
gggcacagtctgtcatattgggactgattacctcttctcccgatgccactaagcagtgatcacactgcagatggcactgatttggttggcaagagacatgccaggaagaatattaagggaccaggcccctatgattaggcctaatcatagcctgttgtttgaaaagggcatgagggacattcatccggcctggnactgtgccctagacctgctctccagggtagtggggccctccattgcaacagaggtgtgggtagacataggtaagtgtggcaagacatgcctcggaggttgtactttgccttcaagggctgtgtgacccttgataaactgccttctctnaatctctg

SEQ ID NO: 544305 - DNA, 213 bp, Homo sapiens
  misc_feature (73)..(73): n is a, c, g, or t
  misc_feature (85)..(85): n is a, c, g, or t
  misc_feature (191)..(191): n is a, c, g, or t
  misc_feature (200)..(200): n is a, c, g, or t
gatttgagtacagaggacaagatattcgtgtgatgatgcaggcggagactggagtgatgccaccgcatgccanggcaatgctggngccaccaggagctgggacaggcgggagggattctcccttatacccctcagagcaatcttggcccctctgacgtcttgactttagacttctggtccccagagcgganagatgaatnaaatctttccttg

SEQ ID NO: 544306 - DNA, 634 bp, Homo sapiens
  misc_feature (290)..(290): n is a, c, g, or t
acccacccgaggagagtctgagctcagacatgcccagcccctcccccacctgatggtccttccctttccaccctggtagtggaagacaaagagcatataatcttggaagttctagggccctgcctactgcgggtccctctccgcaatactacagctgatggtttctggaaagcgccacctcctggccaaccagcataaaaatagagcattaaaccaccaaagcttaggaccctcacggagtccattgcaccctccacctcctccaccagaccaggcactggtatgcatgngtgagagacccatagatggttcacatcgcaggactctgtgcagacaaccgccagtaccaaccaggatctgggtagactcgctgggtagctaagacccagaagagagacaacaatcactgcagttgtggctcacagaagccacatccataggaaaagggggagagtactacatcaagggagcaccccatgcgacaaaataatctgaacaacagccttcagccttagaccttcctctgacagagcctacccaagtgagaaggaccagaaaaccaacagtgctaatatgacaaaacagtcccttcaacattctgaaaaaaatcacactaggtcacagcaatgatccc

SEQ ID NO: 544307 - DNA, 439 bp, Homo sapiens
  misc_feature (75)..(75): n is a, c, g, or t
  misc_feature (106)..(106): n is a, c, g, or t
  misc_feature (225)..(225): n is a, c, g, or t
  misc_feature (420)..(420): n is a, c, g, or t
  misc_feature (427)..(427): n is a, c, g, or t
acagcccccaatgccgcttccagctccacctcggcgtcttgggccaagcgaatcaacttcccgggtgaggcttgnggggtcgccatcgaagagcgctgactgaggntggcctgccaggtctgggcgcgtccagaagaagaggagcagcagggcattccaggccacaaagaggatagcgccccacagcacaagccctgcagactgcttcttcagcatcctgtgccncaccggggagggcaggccaggggacggttcaaggctgccctgggcttgcccggctcccttgcccgcagtcctagggatgcctcctctggactatgggattaggaggcagccatgcaccaggtcctcccgacgtcctggccccgaacttggcctgctccggggcgcagggagcgagcccggtgcccaggcgcgtcnctcaagntgccgcggtcgc

SEQ ID NO: 544308 - DNA, 691 bp, Homo sapiens
  misc_feature (521)..(521): n is a, c, g, or t
  misc_feature (615)..(615): n is a, c, g, or t
ctcctcctttgccttttgccatgattgtggggcctccccagccatgtggaactgttagtcaattaaacctctttcctttataaattacccagtttcgggtatgtctttattagcagtgtgagaatggactaacacagggagcccgcctaaggacaaagctgacatggacaaggcagagcgggagctctgaactgaggcactggagtgtgctctgtttgcggacttcttgttactatgtccctctttattgttaatgccaacttgaatccagtttctgttacttgcagctgaaagcagcttactgatgaagcaaggctggggtggatagagagcatccaatcctcttaaggctctccagaatgcaggaaataccatctgccctttcttacattatatgttaatccccccaagcaatgtttactatatgaagtctttcatacttgaactgataaaggatcattttgaactagagattagtgcccgagattagtgccacctgtcacctacattcaagtctaagntctttggtttgtttttagagacagagtgtcactctggtgcccaggctagtctcgaacctctgggctcaagtgatcttcccaccctagccctccnaaagtgcttgggatacaggtgtgaccccactgtgccagcccaagtctaggttttgctcacattcaccgcttactcg

SEQ ID NO: 544309 - DNA, 740 bp, Homo sapiens
aagcggcctgaagcgtcgtaggagcgcgccgcataatatagaggtaatctatgagcgagcttcggactctgtcgcagcgtctgctgccatttcgagctgtctgcggcacccaaggagaagtctccggtgactgctctgcgagactgtctagctacctgctaaaagaccattgggaatccaatgtatatatcctctgcctggtatctcattgaaatgagcagtcacccgagcatgtgttcactacgaggtcagccgcatggtcttgctcgagagcgctgtggttatttgacatggagtgcactccgctgaccctgtgcacggcaaaatgggaggcttcaaaggattgggctcttactctggaccccattgcgtagaagagttagcgtccgtaggtcctatactcaccgcgatcaccatgtctactgaacaaaattgagatactcggggatcttccatcactggatatggactgtaatagtcagccaaggacattacaatacggcctatggtcgcgtacgacgtggaaagtccatagattctgataacttcaagaggtccagtaggctaacttagtgaaactttacttgaatcctggcattcccggaatcattttggacatctgaagcgaagattgcgaatcgacatcatgacggattcctaagacaagggagaacatggcggccagttctctacacgaaggcttgtaccttagctcttcatctgttgcacttgaatattga

SEQ ID NO: 544310 - DNA, 242 bp, Homo sapiens
taaaataaacataatccttacttcacatcatgtagtaaaattaatttcagacaattaaaagatataaaaataatactataaatagctttaaaacatataggtctaaattttttcaataagtagaatatttctatccttattgacggaaaagtgaactaagaaaaataattttaaaaacccacacacaagactggattgatggcattaaaattttgtaaatgtctgtatatacaaatgaatga

SEQ ID NO: 544311 - DNA, 324 bp, Homo sapiens
ttaaaggcccactgccccattttgaactggacatgggaaccctagccaaatggccttaatctttatgacctagcaggcagaacaggaaccaagcagcttctattttgtcaaactccttgggacaaatattcaacattcaacaccaggcttggtaaacctaacgctaaacaggtcatggcaggcaaactggattttcttaagaaatgaggaaaagtgcaggtgatctcagtactgtgggggaaaccaaaattaaaaccaaacaggttgcacttggccactggctgcctaaaccaatcacagcttcagtttggttttttgtcaggg

SEQ ID NO: 544312 - DNA, 114 bp, Homo sapiens
aggctcaagaaggtagaggggacatagagacagagtaccattctatcctactataactctaggaaacagagagtacaatagataccagtaggggacccaatactagtaggagcc

SEQ ID NO: 544313 - DNA, 610 bp, Homo sapiens
actcgatggcggaaaggagtctgtgaggagacgtctggagcttatgagatggagtcctatgcggaccacaccaactatgatgagcatgccattttcctgaccaagaaattcagccggcatcatggacccaccattactgccaagctatactggcgggcagccgtacctgagggaaactctcctgcaggacttcatagcggttgcccatagtgtgggcatccctgaggactccatcttcaccatggctgaacgaggtgaatgagttcctggggagcgagaaccagagccgatcttaattcggagagtgcggagggctgtgctccccccagaagaggaaggatcaggtggtgggctaccggatactgaagtcactaagagagaggattcttgtcacttggtctactcgatcgatccttgcatggaaatgaccaggatgtaattctatacagctacatccatggccagcgagactctccagtacggcggttggatgagcaacggcagcaacttcggaacagcggagagccctgctacctgccgctactgagggggcccgctactaccgtatttcggctccccagccgaccctcatgcacctctggcttttgtt

SEQ ID NO: 544314 - DNA, 220 bp, Homo sapiens
actagactacgacaagtggctttaacatatctgaacacacatagctaagaccaactggatagatacccactatgcttagcccctaaaacctcaacagttaatccaaaaccaaaaaaatcgttgcttccggccagaacactacgagccacagcttaaactcaaaggactggcgggcttcatatccctctagaggagcctgtttctgtatatcgactaaacc

SEQ ID NO: 544315 - DNA, 521 bp, Homo sapiens
tcgagtttgggactgaaaagcttactcattggaattctaaggacagctccagttaacatgaaagtaaaaataaaaacccagaaaaccttttggacagattacaacaaagaagaattctgatacctcttgtagattcattttccaccccaaagattaggtaacaaaggagatgtgggagagaaagaaacaaaatgggagagaaattgagataagagaggaccatgtgaaggaggtgaagtatttaaagtggaaaggaggaaaataacctgaactcttaactgctcttgaaagttcactctgtcttcactccagctctattgactgattacctgtagcccacttgctattcaacagtctttatcaaagacagatcacttggatacttttgtatgagtggtgtcacaaaaagacatcttgagccaccaaataaggtgcaatatacaaaccagaagtcccattcagcccagtatttgttctcaaatgtcataaatgctgtggacaagaaactaagaacaaccaaa

SEQ ID NO: 544316 - DNA, 191 bp, Homo sapiens
aagtttacgttgctgagaccagatggagaaatgatgggggcgcccctctcctcaaatggccccatgtggcccctcggcatgaaatgaaggctaggagagtagtccgtgggtcaggaaatggggggggggaccaggagttgacttaagtccatgggggcctgtgtttgtgccctgggctacccagctctggc

SEQ ID NO: 544317 - DNA, 390 bp, Homo sapiens
ttcagtgtcacccaagcaggaattgctggggttcaggaaatgcttgtcagtcacaccagtcataagatgcaagaaggcagccggggtagggcagcaagaatggagtgacactggacatgctgagttgggctcaaagtcaagttcaaaaaagtccaggtcaggtctctgccctctccagcttatagcaatgctggttatgtatgccagctgcttcctagaaaatcattcattcattcattcattcattcattcattcattcattcaatagttgcttaattgagcactgactacatgccaggttctgtcttatgtcttggggatagagcagtaaccaaagcaggtgttgcaatgactcctgtggagctcatgtactggtgggagacagacag

SEQ ID NO: 544318 - DNA, 85 bp, Homo sapiens
gcggccgcctactactactactgctcgaattcaagcttctaacgatgtacggggacatgtaataaagaattacttttccttttgc

SEQ ID NO: 544319 - DNA, 192 bp, Homo sapiens
aactcgacatcgctaggctctgctgtgctttatttaaaaagatctcatctggagcataatgagtcacagaccttttaaccgatcatctgtcctatattgaacattcattactgagacaagttcgggatcttatttagaacccctaaagggcagtaccactgtctcattacaagttcgtagaacattatagtt

SEQ ID NO: 544320 - DNA, 558 bp, Homo sapiens
  misc_feature (519)..(519): n is a, c, g, or t
ctttcagagcgcccagaccagggccatattcctcttgctaaggaggcgggagtcaataggctaaaagaccagaactggaagggatgatgtcgttaaaaccaccagacagcagagctggctcccaagcggctctggcaaatttcatcaactttttacttttcttatgatttgctaacatctccaccaacaggtacatcccttaaaataaacaagccacaacaaagcacttctacgaacaaatggatgtggcggctggagctcgcaggaggcaacacaggggggcgcccttccctcctcccggccactgccactgaggcaggaacgtgggaacgtggtctcagccggtgagaaactgcagagcctgaatccagaatttagaaacacagaggcaaacacttacacgtatgggaaaagaaaaaagcctccactgatggcctcataatatgagcatatttgcaaaataaacagttatcatcatttgcaaattattgtggctgtaaaaactgctctgccctcaanggaggttgatacaaacccaataaattctgcactttgtta

SEQ ID NO: 544321 - DNA, 213 bp, Homo sapiens
atagcagtgaggagctgagaatccaactgcggtgggccatggtgagtggagactttggccttgactctaagtgaagtgggagcggagggagtgttttgggcagaggaggggcccttctggctgctttgaggagcaaggacagtttctcttgcaaagccagtcggaaatattcctcccagggcaccgccatccttctggcagttgccccagctt

SEQ ID NO: 544322 - DNA, 391 bp, Homo sapiens
gtagctgggattacaggcgcccgccaccacactcgcttatttttttgtatttttagtagagatggggttttgccttgttggtcaggctgatctcaaactcctgacctcaaatgatccacccgcctcggcctcccaaagtgctgggattaaaggtgtgagccaccactcctggccataaaaatttttaaatgacattttttggctactgttaaaacaacaacaaaagcaggaactaagaagtatcgatgaggatgcggagaaactgcgccctgtgcatcgctggtgcagaatcaaatgggcagccgctgtggaaaccagtgtggtgggaggctcctcataacattaaacagacaattaccaaacccattgcaatcccgctcccggtatatgc

SEQ ID NO: 544323 - DNA, 186 bp, Homo sapiens
ccggaacagtagatttagaggttaaggagggtgatggtggctatgatggtggtgattatgcaggctattgctttttttcgtgaattcttcgacttatggcccaatttgggtcaaatacagccggcttagcggtgggctaggcctctctacgggcacgaggacgggtggcatgcgaatctcaagcgt

SEQ ID NO: 544324 - DNA, 789 bp, Homo sapiens
  misc_feature (20)..(20): n is a, c, g, or t
gctgaagacgagacatggtntcggagcatacagactaacgatagggcgactagcatgtgctgcaaacagctaaactgacagtattggtgtcttgtatatacagactattgcttcttttgtctaggatcataatggactctacagtctgatattaaaggcattggatctatcttggatatcatacatggtcaaagaagcctttaggatatttattagatcatgtatatgattggaacatcacatggattctaccgaagatgtagtatggactttaatgacacaatgatcagagataaaatggacattatacagggtcagtactgtaaaaagaatatgcgctaacaaagactcttaggaattattttaagcagtgcagatactagggataactgtagatattacaataacgttactctactaatgggaaaattaattctttaatgctgagaacagaaacagcggcaaatctaactataatggtacttaaatacccgggacacacaaacccagtaaaaagcgcagacaacaacacggaccaagatgatacccgcggtgtacgaaagtcgtaacagcccactacgcgatattaagagtaagataaaccgaaggcagagatggggtgtaggtatatgaagtaagccagagctgggcttcgaattctaccccaatcagccataactagatatctagatccaccgggagagacgtgaggtgcgggttacgacacgagattaagcgtcagcagcagagtacagagctgaggtaacgagagcacaacgggaccagacg

SEQ ID NO: 544325 - DNA, 268 bp, Homo sapiens
cgaatgtctaatagtatcttgaaatgagagtggccaatgctgcaaaccatcccctccacatacagtctcctcatcttaagagacagcacctccatctctctagcagcccaaagcaacactctagcagtcaccttggtgcctctctccctcttacatgtccatctatgactgaatggttttgacatttgtccctgccaaatctcatgttgaaatgtaatccccaacgttggaagtagggcctggtgggaggtgtttggatcacgggggg

SEQ ID NO: 544326 - DNA, 207 bp, Homo sapiens
ggactagcgctaactcaagtgggggggacatagtgattcctcaggtggtggacccaggctgagatgcttcaggtggcggaaagtgggcattcctcaagtggcggggacaaggagattcttcaaatggtggggacaggggcgatgcttcaagtggtggggatagaagcgtctcaagtgcaggaaatgggggtgactcttccgggtgga

SEQ ID NO: 544327 - DNA, 140 bp, Homo sapiens
catatctttaaaaatacaaaatacatataggatgtcagcatctagaaccatctttatagaaaaatatctgaccctcaaaaacatatccttattgaactatctgaaaagaatagttctaatctctacaggactcaggcaat

SEQ ID NO: 544328 - DNA, 696 bp, Homo sapiens
ggtggcctcgctatgctgatcacaatctgggcacggtgaagcccaagtgctagtcatgaattgctttagatttccaagagagggaatgatgtgccttccactttaagccacgcttcactgagaacaacaggagagtcattgtttgcatatacaaagctggatactaactggggaagggaagaacgacacgtcggtttgcccaatttgaaagtgggaaaccattcaaaatacaagtactgggttgaacctgtaccaacttcaagggttgcagtgaatgatgcgtcactgtggtagtcgatgtaagaagtcatcgggttgataaaacctcaatgaagatcaggcaaactgggaatttctggtgacatagacctcaccagtgcttcgtataccatgatataatctgaaaggggcagattatgagacccatagaatctagttccttgatgtgtaaaggtttcatgttcactgtgagtgaaaatttttacattcatcaatatccctcttgtaagtcatctacttaataaatattacagtgaaaaaaaacacacaacgaggcacaagaacaaaacgacaccaaaaaaaaaaaaaaaaccacacacaaaaggggggggcccaaaaatattcacccgggggcgccccaaatacgacaccacaagttttataacaaaggggtcgccaatagtaggggacgaaaca

SEQ ID NO: 544329 - DNA, 333 bp, Homo sapiens
ttttttttcttgagacagagtcttgctctgtcacccaggctggagtgcagtggtgtgatctcggctcactgcaacctccacctcttgggttcaaacgattctcctgcctcagcctcctgagtagctgggattacaggcacgcgccaccacgcccggctaattttcgtatttttagtagagatggggtttcaccatgttggccaggctggtcttgaactcctgacctcaggtgatccgcccgccctggcatcccaaagtgctgggattacaggtgtgagccactgtaccctgcctggtatgtagaattttctaacaaatagtttagtgcttctc

SEQ ID NO: 544330 - DNA, 500 bp, Homo sapiens
  misc_feature (22)..(22): n is a, c, g, or t
  misc_feature (32)..(32): n is a, c, g, or t
  misc_feature (68)..(68): n is a, c, g, or t
  misc_feature (88)..(90): n is a, c, g, or t
  misc_feature (96)..(97): n is a, c, g, or t
  misc_feature (171)..(171): n is a, c, g, or t
  misc_feature (190)..(190): n is a, c, g, or t
  misc_feature (219)..(219): n is a, c, g, or t
  misc_feature (311)..(311): n is a, c, g, or t
agaacgggctggcttctgtttncctgctcacnggctctagccagcccagggaccacatcaatgtgagnggaagcctccacctcaggtnnnaaactnnatactggagactggctgagaacttacggacaacatcctttctgtctgaaacaaacagtcacaagcacaggaagnggctgggggactagaaagnggccctgccctctagaaagctcagatctnggcttctgttactcatactcgggtgggctccttagtcagatgcctaaaacattttgcctaaagctcgatgggttctggaggacagtcggctngtcacaggcctagagtctgagggaggggagtgggagtcttagcaatctctttgtcttggcttcatgggaaccactggtcaccctttaacatgccctgtttatggcagaacttgggcctgggaaaggtggtggcagaaacttcaaactgagatgctgagagagaaactaataactcctgggcaggaacca

SEQ ID NO: 544331 - DNA, 717 bp, Homo sapiens
attctagaggccgaggcgggtggatcacttgaagtcaggagctcaagaccagcctgaccaacatggtgaaactacgtctctaccaaaaatacaaaaatcagttgggcgtggtggtgcacacctgcaatctcagctactcaggtggctgaggcatgtgaatcgcttgagccaggaggcagaggttgcagtgagctgaaatcgagccattgcactccagcctgggcaacagagtgagactctgtctcaaaaaaaaaaggaagaaagagaggccaggcacaggggctcacgcctgaatcccagcacttggggaggccgaggcgggtagatcatgaggtctgtagtccaagaccagcctggccaagatgatgaaacccggtctctactaaaaacacaaaaattagctgggcacagtggcagacgcctgtaatcccagctactcaagaggctgaggcaggaaaatcacttgtgaaccccgggcggcaagaaggttggcaagtgaagcccgaagaattcggcccccatttacaaactccccaggtcccgggggccgaccaggaagccagggaagttcccattatccccccccatccaaaaataatatacaacacaaccatacctcacaacatcacacactttgtttggcgggcctcttgggccttctcaagaaagcttcttttaaacaccacttctgtggggggcccagggggccccatatat

SEQ ID NO: 544332 - DNA, 174 bp, Homo sapiens
gattacaggcgtgacaccttgcacctggcccgtgtgttgttttgagcttctgtcttatgtaccacttcccttggctcaaggcgtcctttttatctgtcataccacttgactaaatgagatagtgtgggtcactctctacctcctcccatctgtcggtcctttcggagataggcg

SEQ ID NO: 544333 - DNA, 488 bp, Homo sapiens
tagctctgccccgggaaatctcctcgggagggacggagagtcctcgggtctaggctcatggcacgggatggcaggaattccttcgagcaaagttcatattccggcatgagggattagggcaaacccaatccccagtgggggggtctccacctctccctggaaagcctccaggacctctatatcctccagggcctcgcggcccacctccatttccacctcctctcatgaatgcaggtcttctaggggcaagggacacttgagggaggtggccagggaattcttttccatcaaaccagtcaagggctggccttagctggagggagggtcatcaaaggacagggtggccccccccgttgggcttgccgggtgtcctggtctggtataaaggatttatcgatggggtttcccgggtcttcttaaatgggtctgggatcaattccttattgggttacaaaggaactccccaaattgggatctggtagacaccc

SEQ ID NO: 544334 - DNA, 166 bp, Homo sapiens
acccactccaccttactaccagacaaccttagccaaaccatttacccaataaaggtttaggccgttagaatttgaaccctggcgcatagatattagtaccgcaaggaaagatgaaaatattaccagcatatatagcaggcttacccctataccttctgcatatgat

SEQ ID NO: 544335 - DNA, 1422 bp, Homo sapiens
ggagagaactagtctcgacgttatttaatataatattttttacaaaatgaggcaatttattaacccagcatggtatggttctaatgcttcttgttggcagtgccacctgtccgcggattctgtccaaatctctattgtccctgaggtgttcagtttagcggccgccatcttgagtcctatttgccaccattttacagcccctaccagggcttggaggacccggacagggccacactcttgtgacgcctcggctagaagtggctagggccatggacagccgtatctctgacgtcccccatagatcttggtcataggagccaaccccaagcgccacaccctggaggtacagtgtgcccgccgctgtggaagcagatcagcgtgtagaaccagttctcatcgtagcggagcaagctcttttgtgcttggcccagcttgaaggtatccacccattcagggggccttacaggttccccggactatttatgcaggaaacggcttgccagaagttctagaacagaatcctagctaggtatcaccgtccttttaccaagaaactcccagagcatccgtcgcaggctaacacttgaagcataggcactcctcttgcatccaaccacgcatgaccaacacgcgctgtggtatttaccaccaaaagaactgcgcgatgtgacaacaccccgtgaaagaccccccagcaagaagacactcagaaccacacatcaacgacgcgacaaacaaacacatcatccagcacccacggacacgaccagaggcgtagcagatacgacacgacacaccacatcacagcgagcaccggacagaacgacaaaacgacagcatacgacacggcgacaccacacacagaagttgaaagagatacagaacaagtccgccaagactaggcgagaggcgtaccaggggggacgaacaggacagccgtaaggtcacacgccagcgatccgaagatcgcacgccaggcagcacagactgatgacaaccaacagccaccgaccacacacgaacggagacatcggcaacaaccatgatgacacgcgtgcgcggcggcccgacagtacgtcgccacctgcaccacgagggagccgaaacacgcagagacaaaacaggacccaacgacaacagctacctgacaagcagaaccccctgacaaaaagcgagagaacgagctaacgaccgcggagaggacaccggactaaccgacagaaacaacggaccagcaggcacacgaagcaccaaccagacaacgaagacaggaggaagggagagacagaaagagacgtagagagtacaggcacagcagaggtcacagaaggtaggcgaccaacccagcgacgacaatagacactgcaaacgagagaagcgagaagagaccaaccgcaccaagcgctctaacagggcgaaaag

SEQ ID NO: 544336 - DNA, 1285 bp, Homo sapiens
gacgcggagcccggagcccgcgccgagcccctggcctcgcggtgccatgctgccccggcggcggcgctgaaggatggctgacgccgctgcctccgccctccccgcgagcacctgcggtctgctggcggctgctgctactaccgagcctcgtcctcggcgccgccctgcgtggagccgctcgtgcggccatgccggatgtatgccgacctgtctcctgggagtcctggactgtgccctggaagaggcgggcaaggtgtcctcctggatgcacatgacctgtgtggccctgccttcagcccttccaggaggaccaggcaagggctctgtgtgcccaggatgcgccggcctccaggcgggggccgggcccagcccaggactggaagatgagattgacttcctgtgcccaggatgcttgtcccggaaggagtctggacatctcaactccgcccctacccaaggaccgatcaggcggctcccgggagcctggcaccctgtggcttctcggcgacgggggcaggggctggagctgggcctcccctccactccatggaacccccagagcccacgcctcactaaatccgtcctctgtgggtccccgtgtgtcgatccggacaccggtgtcgagcaattgtcggcccatgtgagcccccgggggagggcaacggcgatggggcatcgcccgcgtcgatgctgaatccctggcgatcgtgcttgttggccgattggatccggttccgttctcgtaggcgtgccatcgtgtggggctgcgacgactgtaatgggtgaagattcaggatgagtcaagaagggcttgaacaacgtcacaatggtgatgggccctctgggtagagcctgtgtgtcccagggcataatcgcgctggggacctagcgggctggccacagagcgcgggacattttcacttagcagtacaagggcgaaccaatgtgaacaatggagacggctaaagagaccaaccaacagagactggaagacgaaccccccccggaaagaggacaacgtgggccgggaaactaacgtggaaacacagtgcacgggcgcgaaccgaaacaggtaaagagagtgtggcgaccacaagatgccaacgcacaggacaaggccacgagccccccaaaacccgcgcgctagaccagaggagaggaacaacggaccgacacccccgccggggggtgagacccaccaaacaacacgctgagaagcagagcgcgacaaacagcaacacgcacaccaccgagagcgcaaccacacacatgacgagcgaacacg

SEQ ID NO: 544337 - DNA, 734 bp, Homo sapiens
  misc_feature (159)..(159): n is a, c, g, or t
gagctgtgactgcctgcagggcttccagctgacccactcactgtggcgggggcacatggctctggaatgtggcactctccttatcagcacagtatccgagaagaataccctgtagtcggcactcatgcaataccttcaggtggtggtgccttcatcccnacagaggtggtcctcgcacaccgctgggtgcgagtccctgactagagtgtcctagcgcgctcttccggtgcccatccagattgggtgagcagacatactgcaatggaggaccttgactttggcgatttgcactaaacgaagtgcgccttcctatagatattcatggcgttgcgccgctacgtcatgcaaagcttgacgcacgacccaagcgcctacagggggatgcttgaaacccaaccctttgtcctccaagggcaacccagtagaagttggttgtcgaccaatcgcttgccctccccgtgtttccccttgtgcccgagcgtccacactgcgttggaaccctcccggcgggagctattgggcgagtacgaaaccgattgggtcccccccgtttctccccgactgggttgttcgcaagctatttccatatataaatgccccgtggggcgttttgtgtcccccctgtgctccacccaaggcgcgccgggggaaagtgcccacgccagcttattcgcagggcctcgtgtcaccagatgtcccggggaaacttcgctcccagggacgggcgccgttcg

SEQ ID NO: 544338 - DNA, 490 bp, Homo sapiens
  misc_feature (479)..(479): n is a, c, g, or t
acctgccatttactccatggccaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgaccatggataaatgcangtaccgagctt

SEQ ID NO: 544339 - DNA, 343 bp, Homo sapiens
gcatgatccactcttcttggctcaatctccttggcctctgccctccggcccccgggcaccaggagaccttctgcatcaaggagccttgtgcctctccctcagggtgtgagtccccacaccgcccctcactgtcttccctctgttctctctcctgccatccaacagcctcttcttccaacagcgtccacttttctagaagccccccagcctccaccatggctcccatcccctctgccctcgctgtttgggagcccgctggatccagcccacagctgtcctctgcgcctgcagattcctcgttcctttacccgccctccctaaggtcctccctccctggactcaa

SEQ ID NO: 544340 - DNA, 263 bp, Homo sapiens
aggattacacatacgcaccacgataagctattcttagacaaaatttaacattacagagttcgtggtaatacaatccagactttttttggaaatatcatattgtctttcggaacaaacatttcttatagtgtgtctggctacaatggctcatgtctgtaatcccagcactttgggaggcagaggtgggtggatcacagggtcgggagtttgagaccagcctggccaaaatggtgaaaccctgttctctactataaatacaaaaa

SEQ ID NO: 544341 - DNA, 301 bp, Homo sapiens
  misc_feature (9)..(9): n is a, c, g, or t
ctcgattangtaccatcgaaaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcacaagaagggatccgtctagagcaccacacac

SEQ ID NO: 544342 - DNA, 101 bp, Homo sapiens
gactgccacagactcctggcatatggagcagagcagactttctataagccagataggtatgactcgtggagtctagagtcagtgctgtaaggagtgtgtgt

SEQ ID NO: 544343 - DNA, 479 bp, Homo sapiens
tgtcctctgtgggtgtgtgtgtgaatggggaggtcagttgcaactgatgccaattccaagaacctgtgaagttcattcggctgtcatggggaggagttgtggccatgtccaaggcacctgtcccatgccccctgcctcctctcacacaggatggtgtgaggatggaggagattgtggagggctgcaccggagcactgcacatcctcgcccgggaccccatgaaccgcatggagatcttccggctcaacaccattcccctgtttgtgcaggtgagtctggggcaggtgggcaggagaggtccccccaccactgcttaaagggcaaggttaggagtcccagatttgggaggcctggaccaggtatcaagaggtctttggaggagtttggaggaaagttgccactccagattgactacttagcaaccccctgcatgggcatggctttctaagcttcaaagcaaggaaagagatcacaaatgg

SEQ ID NO: 544344 - DNA, 379 bp, Homo sapiens
atctagaggatccctgcagcagacacagcatctggtgcaaaatcaatgtggactgaacataagtcacctgaatggaaggacttactactacgacactgaaaccaaacagtctacctgggtagaaaccagatgatctttaaagacctgctgagcaactcttatcttaatgcccctggaaggaatacaactcagattctggaaagccttactattatcattctcaaactaggagaatctcggctgggccaaaccttaagaacttgaggatcttgaaggatgccagaataccattgttgctggaagtcttattacgaatatcaacctgcatgctatgatcacagctgtagaaagcagtccgccagaagagtgcaccataaca

SEQ ID NO: 544345 - DNA, 3216 bp, Homo sapiens
aagctggtacggccggagatttaaggatcagagtcggagcagccgccgccgaccgcgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacaga

SEQ ID NO: 544346 - DNA, 667 bp, Homo sapiens
caagcgcctgctggagggcgaggacccgaggctatatgaagccttggggctgtgaatgtctggtgtccaccagctcccgggcggggtcgttttcggggacctttgcgtgtcaggctcccggcccagtgactggccaatgtctgcagcgctccgtgccacgggaacctggcggtgagcccccggcctggtgtgcgccccttcggccacacttgtgagcacccaccctgcgcgagggggttccttcggcgtgggctcctgtggtatcacgctccctgggtgtggggtctttcggcacgcacgcttccggaaaatgtttatggcaccccccactccagtcccacggccccacggcgtctttcctggcctgccttgcttggcccactcccgtccacggcgcctggagccagtgctcagctacttctcctcccctttgaagacccctcccacctcctggcctcacatttctctgtgtgatcccccccttctgggctctgccacccccccgtgggaaaggcccccctagaaagaagtccgctggcacccataggaaggggcctcaggagccggaagggcccggaccagaaccttgcccccggcaactgccttcctgcctctccccttcctcctctgctcttgatctgtgtttcccataaattaatgtagccca

SEQ ID NO: 544347 - DNA, 3330 bp, Homo sapiens
aagctggtacggccggagatttaaggatcagagtcggagcagccgccgccgaccgcgccgagctcagttcgctgtccgcgccggctcccaccccggcccgaccccgaccctgtgccctgtgtcatggcctccattagctcactgtgtgctgtgtgctcatctgtgggcgcagtgtatctgttggtgtgacagaggggttggctgagctgtgcctgctgggtgcctggtcccagccgtccctgtggcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacaga

SEQ ID NO: 544348 - DNA, 424 bp, Homo sapiens
agcgttgtcaatgagcccatctccacacgcatccctgctgacgtcagatcaaccgcaatgccactatctttccagaagcgaacattgttggtcaccagtcggtcataaggtgcattgatgaacagttgatagctgatattgcgtttttgtgtatcgaaggtgctggtttcaaccgaacctacccgatagccacggaacagcaccggatctcctggcgagagtgcccggcttttttgctatcgagaatcacacggatacctttcgcatcaggcggggccaacggtggcgagtccagcaaatcgtatttatccattttgctgcctttcgcgcctggctgcagttcgatataaactccagacagcagcgttcccaggccgctaatcccttcgcgaccaatctgcggtttcaccacccaaaagacggt

SEQ ID NO: 544349 - DNA, 135 bp, Homo sapiens
cccccagccagcgcccgccgccaccaccgtagcagcagcagcagcagcagcagcagcaagagtaactctgacttaggaatagagacagccagagttactcttgctgctgctgctgctgctacggtggtggctggg

SEQ ID NO: 544350 - DNA, 3118 bp, Homo sapiens
gggactaactcacgatacgcccaacggagctgggaagggtgactcgacaacgcatcgacttggcatgacagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacaga

SEQ ID NO: 544351 - DNA, 3513 bp, Homo sapiens
aagctggtacggccggagatttaaggatcagagtcggagcagccgccgccgaccgcgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtacggccccctctttgcaggcttttcctcctctctagaacctccttctgttggaggccctcccatctccccgctgaaacctgcgctccttttttggggggatcctttgctgctgagcttccccaagcacggtgtgccctggcctgccttcttcttgtgtctttggtggggatggggaggcctattcctgctggccccttctgggggtggcgggcaggtgacacggagtggcttgagcttctggggatgcaggtccaccgagcccctgacccctgtctgtccccgctcccctaacaggtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacaga

SEQ ID NO: 544352 - DNA, 838 bp, Homo sapiens
ctgtgactagctgtggcctggcccgggcaggacagcggggcggcgggcggcgcgggcctggccccgggatggctatgttcctgcagcctggtggcctcgtgctcagcagcggcagccgccggccgggcctggcgggcggtgactgctggctggatgtgcaggcagtacacctgccccatctgcctggaggtctatcacctgtgcccgtggccatctgtgcagcttgcgtgcacactgttctgcggggagtgtctccagccctgcctgcaggtgccatcccctgctgtgcccactgtgccgcctgcccttctgacccaagaaggtggacaaggccacccacgtggaagaagcagctctcatcctacaaagcgccctgtcgaggctgcacaaaaaggtgaccctgtgcaaagatgaggagtgcacatttcgtcctgcctgaaggtccagggagcagattgggcaatgccccaagttcgtccccgtggtgcccacatcacagctatccccagaacatccccaaatggtccaccttcgcctgcccgtactgtggtgcccgcaactggacaagcaggagggcttggtgaaggcactgttgttgaaaagcccaccggatggaccccaaacccgctgtggtgttgccccatcttgctcggcatgccctgggtgtgacccagttacaagaagcgccaacttcctgcagcacttgttcacgacacaagtttccttcgacacctttgtgactcacagattgagaggggcgcttccggttgctgcctggcttcttggaactaaggaggcacacgctggtctgggtaggagcccgcctgtcactgcttta

SEQ ID NO: 544353 - DNA, 609 bp, Homo sapiens
  misc_feature (137)..(137): n is a, c, g, or t
  misc_feature (148)..(148): n is a, c, g, or t
gccttgccatcatgcaaggggaagggcgactgtgacagccactgccacagaggatggcagttggctgtgtccctttgtgagggtcttcaaatccttttccttctgcagggccttgggcctgtaaatatcctcatctntctattctttnttttttttagttgccccctcacctaatttccacctcagttttgaacaaatcgttctcttcctgaatagatcaaaacactgatgtgaagataaagcctgaagcaccattgccctaaacataatcctgccttgatcgcctgagcaatgccaatacggtttgtgtgtcataaaacaacgttctgaatctttgggcggagtttcgttgcttttttttctaaaaaaaaaactgccccttttaatggcgtttccctttcctttttgtaaatgctttaagagcaagcccttcaaatttgttggttcccttaaaaagggggccttccccaaagggccctaaccttgaaggtaggaacccatccttggcttttttcaatggcggggcctggtttcaaaagggttttttgcaaaccgttttggaaccatccaaaagggtttttctttttttcccaaatttttcgggggaaa

SEQ ID NO: 544354 - DNA, 3280 bp, Homo sapiens
aagctggtacggccggagatttaaggatcagagtcggagcagccgccgccgaccgcgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacagaaaaaaaaaaaaaaatatttgtggggggggcccggcccttaattcccttaagttggtcgttttac

SEQ ID NO: 544355 - DNA, 760 bp, Homo sapiens
tatatttggcaatgtttttttccataatatttaagttttcgatgttaaatattttcttcggtgaagcacaagtttctttacatggtccctgatcaattttaaacagtgggaacaccgggggcactgttaactggctttctggggcagcctctttagctgggggggctggtagtacagctacagcttcatcaaccttaagaacggagtgactctggagactcgagcatatgaaagaagttctgaatatatcaatctccaacaacatgccagtgattttaccagcaagagtagggtgcatggcttgaataagaggaaacagccgttcacccaacattggctttggctctggaggaggggcagatgccaacagggaagcagtcaaaggttcctgacctggtacatgaacagcaggctgtggcatggtaactgggggcggtgcataagatgtgctgaggatggcaaactccgtgcagcatatcatacggtggaacggtgcggacagcaggagtagctgcagcggctgacagctgacacggacgtggaccccatggtctgtgatagaatgtgtttagcaacacgctgtgttgcacatgactcggtggaactcggtgaaaaacgctggtccacatagctactaacagggggggtctaggagcacatggggcaggcaagcacggggcatattcggaatggatagaggtctggacccctgagcagtccaagcaggacatgggctcacctgaacaatgggcaagaggca

SEQ ID NO: 544356 - DNA, 2320 bp, Homo sapiens
aatcatgcggccccctcaacaattgcctcctggtctcgaggcctcccttggccaccgtactttggcctgaggagggttctgcctgggtctgagggccccagggaaaggctgatgagttggagggaagagatgtggggcttagagccaagcctgggttcagatccagccactagctgtgtgtctgtgggcaagttccccaacctctctgagcctcattgcctcacttgcaccacaggatagtaacgccctctcacagggtgtggcgggtcatagggatgaaagttcccgggcacacacaggcagggctgacccctttaggtcatcccactccccttggacatattcgagaaggctccctggagttggctgctccctgactcccccgtcccttccttgccctccaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacaga

SEQ ID NO: 544357 - DNA, 3466 bp, Homo sapiens
aagctggtacggccggagatttaaggatcagagtcggagcagccgccgccgaccgcgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacagatggaccacactgacacaaacaacccgagggccctacgcccggcggggcgaacaccgggcaatcgatggccatgggctacggggtcccgaccagttttggccacgtgcgcactgccggcgcccaaaggagcggctaatcgagacaggtccctgtgcagacacgcgaaccgcacaacgccccccacagcaaacaccaataccaccgcgaacgcgcttcacacgacctactaacacaaacaaccccccgacaa

SEQ ID NO: 544358 - DNA, 158 bp, Homo sapiens
actacatacttccgggggcacactattccactgtcacactattccgctgtcacactgccacactattccgatcacactattccccggcacactattcctgtcccactattccactgtcacactattcccaacacttcaagcactgcggaggaatgaag

SEQ ID NO: 544359 - DNA, 976 bp, Homo sapiens
  misc_feature (466)..(466): n is a, c, g, or t
  misc_feature (491)..(491): n is a, c, g, or t
agcggagtggtgggagagagggcccacatcccacgggaaaataccgaaggagatactctgtatatggggatcgcgtaaaccagtcctatatctgggcagagggagactgggtagtgagtatctctacgatactggaatagccacgaatatgggataacacgggtccgcgacatgggggcgcgttaataggcacgttgactccgttggaccctcatgggggaatatcatcactcaagacttcgaagggcacgtgagcggcgaagatgggacctaacaaaagttgctaagggtagcgatcggtgaatacttatatagcttaggtagagacagttgaatcagtcttatatgagggggagtgagcaaaaggagtttgtaaaggagtatagtcgtctattcctgtggtacatatgagacacaaatttgtggctatacaaggctcatcgctgctagagaatagagtaggagntcctcgctcatgggcgttggtcgtntcgtggatggaggctagggtgctagaagcaagagaagtcttgatccaatgtgaaaatggttcgagggtgatcttagtgggctcttgcgagaggtgaaagagcgtgaaatgtaaggggatggggagcttttaggcagtggggttaatcataatgcgcccttttgttgaaactcaatccgcgcttttccaatttgtcctatcgtgggaggcatgggtgtgtacgtattgggggtagacccatgggaaatgtgcaagtaaatctgttagctacagaatatactatggtgagcccatcagttgccccccactttctcccagggagagagcagccttgagtgtgggaggggctgatccatgattgctcccatgcgtcacacattgtgttcccttgggaggggcggctagggataatgggccccagcactgtgccagtcgaaattggtggcttgaccacaggaggcttaaatggggtaagcaagacgccag

SEQ ID NO: 544360 - DNA, 106 bp, Homo sapiens
catagctctccgctccgggcaacgtgtgcactaaatgctagttataccttagtaaaataagagtgtaggcaatataaaatgttacccatagagtaaattaaatagt

SEQ ID NO: 544361 - DNA, 363 bp, Homo sapiens
  misc_feature (53)..(53): n is a, c, g, or t
tctgtttattctttgcagtatctcccactgccctagatagcatctgcacatancgcacacttcagacacatttgtcgaagaggtcaggcgcggtggttcgcgccttgtaatccggcactttgggaggccaaggcgggtggatcaccttaggttaggagttcgagaccagcctggccaacatggtgaaaccatgtctctactaaaaatacaaaaagtagttgggcatggtggcatgtgcctgtaatcccagctacttgggaggctgtggcaggagagtcacttgaatctgggaggtggaggttgcagtgagccaagattgtgccactccactccagcctgggcaacagagtaagactctggctc

SEQ ID NO: 544362 - DNA, 296 bp, Homo sapiens
  misc_feature (27)..(27): n is a, c, g, or t
  misc_feature (32)..(32): n is a, c, g, or t
  misc_feature (37)..(37): n is a, c, g, or t
  misc_feature (102)..(102): n is a, c, g, or t
  misc_feature (185)..(185): n is a, c, g, or t
  misc_feature (194)..(194): n is a, c, g, or t
  misc_feature (210)..(210): n is a, c, g, or t
  misc_feature (216)..(218): n is a, c, g, or t
  misc_feature (220)..(220): n is a, c, g, or t
  misc_feature (231)..(231): n is a, c, g, or t
  misc_feature (241)..(241): n is a, c, g, or t
  misc_feature (248)..(248): n is a, c, g, or t
  misc_feature (260)..(260): n is a, c, g, or t
  misc_feature (267)..(267): n is a, c, g, or t
  misc_feature (270)..(270): n is a, c, g, or t
  misc_feature (273)..(273): n is a, c, g, or t
acaacatggcaaatctttttataaggnaaatngtganccctcctgctctatctcagtcgtcacacggtgaagcctcgagccctctccacatttctatttggntccattcgaggtgcagcccccgtggctgtggaacccggggcagcagtgcgctcacttctctcacccggcctcctgccccatcntgctgcctnctgctggggttcaaanacaagnnntntccttaagaangcgcctgcanggactgnttacctggtgangaggcgngantcngtggatacgtcctactgtaaaac

SEQ ID NO: 544363 - DNA, 158 bp, Homo sapiens
cgctggccacacattgactcaccctacacaactcacaacgggcctcacgcttgcggacgatgccaacgggtaaggaatagtcaaattgcgccagagcgatatctcagctcatgctatgtggtatctcaaactcgtctaactgaagagcaaaaaggtat

SEQ ID NO: 544364 - DNA, 190 bp, Homo sapiens
gtgctgttatttgtcagtcagtgttttaatctgacgcagcttatgcggaggagaatgtttcatgtacttatactaacattaggttctttctattagggtggatagatatggtcccaaattggggttgtgagggagtccagttatatgtttgggattttccaggtaggtgggtattgaaccggatagcttg

SEQ ID NO: 544365 - DNA, 883 bp, Homo sapiens
cacagtgcacatctgtaatcccagcactttggaggcagaggtgggtggatcacctgaggtcaggagttcgtgatcagtctggccaacatggggaaaccccgtctctattcaaaatacaaaacttagcggggcgtggtggcgggtgccctgtaatcccagctactgaggcaggctaaggcagaagaaccatttgaatcagagaggcggaggttgcagtgagccgagattgtgcaacgactccaagccttgcgtgacgagagtaacgatcctgtttcaaacaaccggaaatggtcacagtggttccttaaaaaatagagccagtaatatgctatctatttgtaaaaactcactttacaaagacagacacaggttagacgtcaaaggtatgggaaaaacataccatgccaaaataatcaaaagaacagtagagtagctatgtaatctacagacaaagcagtttcaaaataaggaaacataaaaaccatttcagacacaaggctcagagttgcatacacaaaatattgttgaggcaaaaatggagtccaagagtacagacaaatcagtattataatgggagactcacacctcttataggtagctgacacaccccagtcagtagcaatccaatgagcattagtcgagctgacaggcatcaacatccagtggttcgcgcttatagtatttttcctccagaggcggcaaaactatcctctcaattcaaaggacttccaaggagacatactgggctaaataaccgctaaattacggcagacacacagttggctcccacgagtcgtttcagcacgagacggtgacccatggggaaaccccaatcagcggcccagtctgccgagccctcttcgccccgttgtcggcaataccc

SEQ ID NO: 544366 - DNA, 192 bp, Homo sapiens
gaggctcagtctaggcttcactatacttacagtatctccccactcttcaacccaagtacagtgctgaaattcttggtcctggttacatgcctcatgtctttgggttgattgtttttccttggttcacaaaaaattaaaatcagggaacatctcttgtattggcctaggttccctcagtgtccatggtcactt

SEQ ID NO: 544367 - DNA, 258 bp, Homo sapiens
ttcccaaatgaaggaagtaattagaaaaaattcctccagttttatgtgatggccagtaaaggaagagagaccccagaaaagatagaacgggaagggcaaatgggaaggaaggagagtatgccccagagatgatgacgcaaaaaaagagagtgaagaaaagatgaacatggacccatccccccccacacacacattttgattttatggaaaacctgctttgtaaaattaaagtttgtcttttgttgtttttcccctgta

SEQ ID NO: 544368 - DNA, 299 bp, Homo sapiens
aggaccaagaaaccacctgcccaacccagggtgggaaatccacttaaagttgttcctgaactacaaacaataacatgagcgacctgtgccttaaggacatgttcctgctgcagataactagccagagcccatccctttgtttcagcccatcgctttgtttcctgttttagttaatctatgatctatagaaacaatgcttatcactggcttgctgtcaataaatatgtgggcaaaactctgtttgaggttcacagctccgaaggctgtgagtcccctgatttcccactccacacactaaa

SEQ ID NO: 544369 - DNA, 111 bp, Homo sapiens
ttcaagaggagccggggcaacatagagagaccgggtctccacaaaaggtaaaaaaaattacccaggcaggcgggcacacatctctaattccagtggcgggtcccgcggggg

SEQ ID NO: 544370 - DNA, 342 bp, Homo sapiens
caggctacgtttatccatatggtgtgaaaaattcatactcatctttctttaaccgaaagtgtctagatctcaatgtggctcaggttcacatcattctcctcaaataagcgcaatcctttgggattccagttgtctccaatatagcttgtttcctgtccaaagtcagaaagtttcctgcccaagcttgggttttccaggaccccagtgcacatgctggctccccggaagtgaggtctggcgctttttaggcgcctcaggtacaggcaggtttgcacacagcacgtgggtctaaaggttttaacctcgctctagagaggagaagagagtcacagagtgtgtctc

SEQ ID NO: 544371 - DNA, 209 bp, Homo sapiens
tgtcttaaggttataaaagtataaatccagactaaagacacaattatctttatttgtataactttttaatgactaagactaacactgttagtttaatcaaaattgctgtatcttctgtgttatcagcaaaatacccctatatttaagtttctcaggtgaaaacctgatactcataggctatacaaatgggggaaaagggaaataacttg

SEQ ID NO: 544372 - DNA, 272 bp, Homo sapiens
cccccccccccccttgggtggggggggtgggtttttggggggtggggtcgggggaataagggctgcggtttgttttcctgggggggccccccccccttttggagatttttggcccccccccctggggggggatgggcccattttttaaagggaaataatcccgctttggggggggggggggtcccggggggccccccctttttttccggggggggtttttttaaaagcccgggggggggcccccccttttttttaaggggtttgggtccgga

SEQ ID NO: 544373 - DNA, 102 bp, Homo sapiens
cacatatgcttttgaccaggaggtgctcacggtactacagttcaagcacaaggccagcagggcacgcgcatggagccccatgcagtctggacactgacgtgg

SEQ ID NO: 544374 - DNA, 297 bp, Homo sapiens
tgggcgggtataatatagataatagttgtgatgaaattgatgagacccaaaaccctaattacgtaataacatgtactgctgttagtcttccccatagatgtcattcttcttgcgcttcatttctttatgttcttcccttgtgttttgatgatcttctttagcagtatgtctgtgttcccttctttttggtttttgtaatttgtggtgaccacggacttcatacatgttgacctctatgaacatgccttaagctggttcaaacacattctaaaagagctctattttttgctcccctcc

SEQ ID NO: 544375 - DNA, 956 bp, Homo sapiens
  misc_feature (1)..(1): n is a, c, g, or t
  misc_feature (342)..(342): n is a, c, g, or t
ncacccatgtcgtagcgccaaagttgccgccccgcaaaaaaaacgtcgtgggtaagagaaacaccgtttgcgtttagtgggccccccccgtgaggtgtccgcttcccgctgtgacagcatcttaagccctctcgtgggacgctccccgttcctccccagagggggccgccccctttgcaagactctcaggaagaggcggtttataagagctaagagccatataataccgctggtacatgaacagaatttacataaccccggtgcaaagctgcctcacgttttcagcccccccaaacaaaaacccactcccctctggttttgcaattcacagactcacactgncccctattataaccccaacggtcattaccattgatcactagaggtcccccacgctattcaagaattcttagggccccgcgactgggttgccaccacttctccagaattcaatggtccccccttactgttacaaagtgattttatttatagacacaatttggtaacagagccaactatcattcagtgggtatacattttgtgtatgaagtataaaaacgatgtttcttccgcccgctcttccacacctttttccacagatttattatccagagccacacacatcagctttttaaatattgaccaccacttacatgcccactctctgcaaatatctccacacacagtgtacccctcctcacacattattaatcaaggtgtttccttttaaaccccccctccttacagaacaccacacagcgggtacaatgcagccgtgtacttcttcatttgcgagaggagacccacttttagcaaccacacattcacagtagtttatacatgaccgcggcgaataatacacccacacacactgttcaaattataaaatcatcggttactcacccgcacatcaaaataacctttaaaaaacaaccccccaaccaaacaaacaaaac

SEQ ID NO: 544376 - DNA, 158 bp, Homo sapiens
cccccgggggggcccccctttaatttcccggcccttgggtttttaccccgggcccccctgttggggggctttgggggcccaaacccccatttggggggggggccccccccgggtaggttttttgccggtttttgggcctttttccccgttttagaaga

SEQ ID NO: 544377 - DNA, 572 bp, Homo sapiens
tgctctcaaataaaagacatcacagcaactggtacttagatttgagttaataaatggtgtagttgagatacacatctgtaatgatttcagtaatataatgatggtgatagcaacttttatgtaaccacaagtaatatatcaaagctccattctgattggaacagaccagcagattatgcatccaaaggactgactcttacagtcttactttcgccacttagtacgaccgagatgaaccatacaatgagaatggtaatacacgcttctactcagtgtctataaatgatgaagacctaacatactgcttatactggaacatcattctgacactcctaactggaacgcactgtcacaggacatacagcttgagaatcccccttcaacacaatatacaatactacatgtttgcccacgcgtgctaccaataaccacaacattttacaaaagtcactacacacaagctacaactttctgggtcaaaacgtcacattcttcattacacatcaagcattcgccttcacagttcgacgccaaaggctaactgtgccattccaacactagcgggtcgccac

SEQ ID NO: 544378 - DNA, 117 bp, Homo sapiens
atccatacggaaagtcttctgctggtgggtgctcttcttcccctggatgtaaatgtttactttgtaaccaaacaactgtgaggcaatctagagagttagcgagcctcactttagttt

SEQ ID NO: 544379 - DNA, 117 bp, Homo sapiens
  misc_feature (11)..(12): n is a, c, g, or t
ggccaggcacnnggtcctattttgctcactgttgctgtgtgggaaagagctagtacagcagactgtcgcaagcttggctcttggctgcatctgggaacttggaatttaggcggccgc

SEQ ID NO: 544380 - DNA, 247 bp, Homo sapiens
gtctatagccattgctgcgtgacgcctatggaagcttttcatgcctcagcagagagaaaagtcaacaagtggtctgcccatggtgaggaaaggaagttacaataacaagttcaacgacagaggagagacaggaaaaaagcaacaaaccacagattctgaattgttggtctacaaaataaaagtctaatttctccatcagtcccaggtaaataccaacttagctgctattgaaacttctaaaactagg

SEQ ID NO: 544381 - DNA, 427 bp, Homo sapiens
caccgggtcaggagggatgtgtagtgatgcatcttgtgtcatgcaagctccgcctacccaggtcaagtgattctcccacctcagagctcctgagtagtcaggagtataagcatatacaccacgaaagggtaatttgtccatttttagtagagatggaggtctcgcctgtgttgcccaggttggtctcaaactcctgagctcaagcaatcctctggtcccgtcctcccaaagtgctgggatgacggatatgcgttactgagccaggccgaaacgatttctagatgatttgtatgatgcttttatcggattagagtacaacgatacggttgggttttgaaatagactttattttgtgagagctattttaggtttacagcaaaatcgagcggtaagaacagaaagttcccatacacctccctgcaagcca

SEQ ID NO: 544382 - DNA, 989 bp, Homo sapiens
  misc_feature (989)..(989): n is a, c, g, or t
tgagtgaccccttcaagtaactacgttttgttctgccctttgtttgtttttgagatggagtctcgctctttcgcccaggccggagtgcaatggcgcgatctcggctcactgcagcctccatctcccaggttcaagcgattctcctgcctcggcctccccagtagttgggattacaggcgcccaccaccacgccctgctaattttgtatttttagtagagacggggtttcgccatgttggccaggctagtctcgaactcctgtatctgcctgttctgtattcatcttgtgttgttgtttccctgcatgcatttgtggtctcattcattgatgacttctattcgcaatgcccggtcaaaggctacgcgatacagatcccaacaacggacagcttactgtttaaaagtgtaagtccgaagtgagaaagtcagaccactcagaatccttgacaccaccattaggggcacaatgtgacttttgaacaagtcagctattcatagcttcttcgccgcctccgtccgcttcatttgtaaagtgaggtacacacatcgcgcccgactcactgacatatgtctgtgacacgttgctgtggcagaacgcccatacatatcactcctcactctgcgcacgaagtcggccgcactaccgtcgggacgggccccggggaacgatgcatgccaacacatggtaggacgtcgacgcgaaagccgccgaagcaaagcgcacgagactaacccgggcaccagaacagcggacacacgctgagtgcaggacacggccgtcacgcggaccgaaggcgcccaaccaacgaccaaggagcgcgcttcaacgaccacgaggtaaccaacggaagggacagctccccacacacacagcgacacaggagcagaagagccaaaagcccgacgacggaacgagagacacgaacaagagacgcaccgaagaacaggagacaaacaacacgaccgagaagccgctcgacccgcatccn

SEQ ID NO: 544383 - DNA, 147 bp, Homo sapiens
gagtcgtaccgtctgagcagctgggaagtcacagtatcagatcccgtggacgtggacaggcgggcaggcagagccacaggaaatagcagccacccgggtagcccgagggcaggtgctgcgtcagacagtttgtcctatgcaactctg

SEQ ID NO: 544384 - DNA, 293 bp, Homo sapiens
gcatgttagaagttaatagacggaatgcttgatggcttcttatagtatttagtgagaagtctatagtttgttcgggggagttaggtattataggtactatgtgtgagtgtgagtgtgtttgtgtgtactcgattttaaaactatttcttgagttctttagaccataagaacatagtgtataatagtaaagacttatttcaatttatttgaactttttccaaaagtgacatagattggccaggtgcagtgggtcacacctgtagtcccacactttgaaccggcggtgcggcgtg

SEQ ID NO: 544385 - DNA, 795 bp, Homo sapiens
tggatggagtctcgctctgtcaccaggctggagtgcagtagcacaatcacggctcactgcaatctctgcctcccggtttcaagtgattctgctgtctcagcctcccaagtagctgggactacaggcatgcgccaccacgcccagctaattttggtattttaagtagagacggggtttcaccatgtgggtcaggatggtctccatctcttgactttgtggatccacctggcctcgggcctcccaaagtggctggggattacagggcttgagccattggcacccagccttgaattttaaatttaatctctggatatacttcattaagtggtcgggagaacctaattatcctaaaagaatcatacatttttctacctatgaatttggcgtgcatacagaaaaggtgccctttcctcaggaagtttgcgtggtgttccatttcttgggatggactcttatctagaatacttagcagttctgcaaagaaacggtttttaaaaatggggaacttctactttggaaaagtccccatttttggtggccaactatgattagtggagaggaagaaatcttattctagggcatatgtttggacagggtgtaaagattctttggaaaggtttattcactttgtcgaaccagaaatgacttttttacagtattttttgggtaaagcaaactatttggtggccttgaaatggggcatatgggtactagtgaaactattgtcaagggtgaacttctacctctgatatctaaagtgtataccaatccacttgtaagtgctataaactattg

SEQ ID NO: 544386 - DNA, 257 bp, Homo sapiens
tagaggatccggtgttccctttgtctctactaaaaatacaaaaattagttgggcgtggccaggcacggtggctcacgcctgtactcccagcactttgggagatgaaggcgaatggatcacctaaggtcaggagttcaagaccagcctggccaacatgatgaaatctcgtctctactaaaaatacaaaaattagtcaggcgtggtggcgtgtgacttagacccgagctaaagggacactgaggaaaggaagctgaggc

SEQ ID NO: 544387 - DNA, 597 bp, Homo sapiens
gcacgagatatcacggcatgtccttagcgctgagcaggtatgacttcacaagcacatttgcttgtgccctcccctcccttaatgatcttattcgtttctgtaattttatattttttttacatacattcattaatcatccgtagcatacatacccgcacaatgtcgttattgtttcaaattttgctttatcctcccttcaacagaacgtgaagggggaatttctatggctttggaaaccgttcctattcttgcctatcccttccagcgcctgtcaaaccccgcctaaacagtactacctctttgggtaatggaaaggatatttcaccttgcaatggccaggtagggaaaaaaagaaaaaaaaaaacctttcttcttcttggtattttgactaggaggccatcatgaaatagtcacagaaacaacaaatttattgtcttggcttgcgatccacattgataattactttctcggcacttgcggcgcacacatgcagccggacggcagcaagattttcaaaacccaagcaaccgatactcaacacaatggagcccaacaaattggagtaatgaccttattgggtaatcaatattcccaaaa

SEQ ID NO: 544388 - DNA, 198 bp, Homo sapiens
tttattacactcattgcgtacaattgatcatagtattgtctgactttttattttctactatggttcctttagcagaacacgtaacttttgtgcatatattgaagtggtttttcagctatgaattctttatggtagaaatttatttagcaaatgtgaattcttttgagaatgtctgacgtttggctgaaattgactgtg

SEQ ID NO: 544389 - DNA, 158 bp, Homo sapiens
  misc_feature (130)..(131): n is a, c, g, or t
gggttatgttgtcatgtgtggtgagtgagcccattgtgttgtggtaatatgtagaggagtatagggctgtgactagtatgttgagccctgtaagtagggagagtgatatttgatcagggagaacgtgctnnactagcacatgagagttctcctaagta

SEQ ID NO: 544390 - DNA, 573 bp, Homo sapiens
  misc_feature (292)..(292): n is a, c, g, or t
caggggcaaaagccggagtggacgtgtctttgggaaactgctgctctttcacttctcaggcggtcaccgagagctcagcaccccaggctggaaactcttgtaccattgggcaacgactgggaagctggatgcatctgtgtgaccatgtttttcccaaaagtcctggggaggcaatcagctggccttttccagaaactttaccccaaaaatcgttggtgttgtggcgcacacggaacacccacttttgtgggactttccgtgggaacacaatctcccaaaaaaaacacgctgnggacttcaacgacttgcgcacttgcaaggcgatagaccttggggaaaccgcctttaaagacgcacacacagagacctccaagggccaacttaaagggaaaaaggcttccaaaccaggtcaatgaaaaaccaaggaaatgggcttttcttacacgaggacctatgtgtgcgaaataacatgaaggaaaattccccctagctggaacaaggaagaacctttttttccaaggaacgttcaacggacgaggtgcaacacactgttggtttgggcccaattttcta

SEQ ID NO: 544391 - DNA, 333 bp, Homo sapiens
acatctagcagcacttcagagacgacatcgcacaaggtggctcgaacgattctggtggaagaacgtgaagattattgtccttatctgcgtgattgtatttatcatcatcctcttcattgtgctcttagccactggtgcctatctcttacgtaacagggaacctctcccacctgcccttctacttcagggacaaccctccatcaatgtgtgccacgagggtctcctttcctgtcttcctactactgagaatgctgctacggacctcctacccctaattacccgaggccctgctgccatattgtaagccccgatagggggaccctctcagagtcg

SEQ ID NO: 544392 - DNA, 355 bp, Homo sapiens
aactatactaggcacctccaggtatctatcatagagactctgaactgtaaaccaggtataaagccaattaactttattcatttcaatttgaatctaagtaccttcattgtatataatactaacacttaagagaaaatgacaaaaaaataaatgtgccagggcaactgactacttcctatcataatatatgtttttacctttagagagattaaaataagacaaaaaaatgatgagagaagtagctactatccatttttatcatcatgttccacttggcaaggcattaataaaaaattatttcacaaggcccacaactatctggtatttgaggcctgatagaaaactaaattatatt

SEQ ID NO: 544393 - DNA, 198 bp, Homo sapiens
gctagctcctcgatatttgccacatcacttcccttgccttcattcgggaccggcccttctgcttctctggcttgtatcgttgtgtgcacgtcatcaaacagcttctgattcatttgcataaacaagttcaggccattatagatcagtccatggattgtcttgttccagtggactcttggcgtccgtgtagagatgcag

SEQ ID NO: 544394 - DNA, 105 bp, Homo sapiens
  misc_feature (6)..(6): n is a, c, g, or t
  misc_feature (81)..(81): n is a, c, g, or t
gcccanacccactccaccttaccaccagacaaccttagccagaccatttacccgtattcagtataggcgatagagattganacctggcgcaatagatatagtacc

SEQ ID NO: 544395 - DNA, 136 bp, Homo sapiens
tacatgtaatctgacactaaaatatgaacttagtctaacataagttactgttatagctgtaaaatttcaggcagagccatacacattagtacagcagtgtcgcacttgatactgaaacctaagcctgtaaaatcct

SEQ ID NO: 544396 - DNA, 104 bp, Homo sapiens
  misc_feature (86)..(86): n is a, c, g, or t
tctgactcagtggttacgaatactactaggaacatgaggttgtgggtcagtccctggcttgctcagagggtaaggatccagcattncatgagctgtggtgtagg

SEQ ID NO: 544397 - DNA, 201 bp, Homo sapiens
aaaacccttacgggaaagaccatcaccctcgaggatgaaccctcggatacgatagaaatgtaaggccaagatccaggataaggaaggattcctcctgatcagcagagacttatcttttgctggcaagcagcttgaagatggacgtactttgtctgactacaatattcaaagagtctactcttcatctgtgttgagacttcg

SEQ ID NO: 544398 - DNA, 813 bp, Homo sapiens
gcacattcaaagctgccctggaccacaggttggacaagcttgggctagagccagaggccatgggagacaggatgcagggcagggagtagggcctctgccagaactccttaagccaggtgccatgctcacctgtaatcccagcactttgggtaggccaaggggtgggaggatcacctgaggctaggagttccagaacttgtctgtttagttagtctctattgcccaggctggaatgcctctcaggttcaagcaattctcatgcctcagcctcccaggcagctgtggttacaggcatgcgccaccacacccagctaatttttgcatttttcatagagacgggtttcgccatgttggccaggctggtctcgaactcctggcctcaagtaatccaccctcctcggccttttaaagtgttgggattacaggcgtgagccaccctgcctggtcagaagaccccgtctcaacaaaaatgtgaaaaaattggctggatgtagagcacacctgtagtcatagctgctcacgaggctgaggtgggaggatcgcttgggcccgggacttcgaggctgcagtgaggcgtgatggcactgctatactctagcctgggcaacagagtgagaccctgtctcataaagagaaaagacaaatttgctcctcttttagctcagccaagagatgctgtttatctagaagcttccccttggttgtctccattcttcctgggtgaattctccctctctgtttcagcagcactgtagtgatgattcctcctgtcccattctttccagcctcatggcactatttaggtaaccagag

SEQ ID NO: 544399 - DNA, 117 bp, Homo sapiens
cgggaagtagtccaaaaaaaaaagaacctggaatctcacttttaattatatccatatatcttgcagatgaatatggccttgagtcaacgctacgatctatagctagaacacttactg

SEQ ID NO: 544400 - DNA, 589 bp, Homo sapiens
gtgagaattaaactgaatcccatcagtgttaagtgagcaagatcggtgacgtcagcgatgggttgtggttggtggggatgggcagagactcagctccactgttgcaggcctagagcctagagcagaaagaagggcaatgggaatgggacaaagaagaaatgggagagacgttgttaagctttggatatatttatttacaaaaaccttgaatttaaaaactttgttgctttatttcaaaagtatttcttttaacacaaaagaaatgtgttcattccagacaaattacaaaataaatgaggcaaataaaaaaagatcagcacaatctcatcacccagagagagccatcatcttccagaggttttctctgcatattcaagtagtccacaaacgttttataaattagggaacatattcttctccaagctactagttactatttttttattctaacaagctgttccagctgtctttctgtgtaaaaaaaaggctatattttcaccccaattctaaaaggttgcatattatatcaccatgtggtcgggccactctatttgaattctgcattgaaaggcaggataatgaacatgga

SEQ ID NO: 544401 - DNA, 159 bp, Homo sapiens
ggctataccgtttgcagtagacgggcaggtaatgaagagagtgtaaatagccaatctgcataaacaggccttgtcccaggtgcatgattcgcaggtcagcctatttccaggtgaagtgcttacttgctataaggagagctacttggggcaatcaagagg

SEQ ID NO: 544402 - DNA, 107 bp, Homo sapiens
gggaaactacattacagaacgggtcctttactacactggcagacttgcaaagatgcatgaggtgaaggtaaagatggggttggtgctgtcatgggttccatgggact

SEQ ID NO: 544403 - DNA, 324 bp, Homo sapiens
ggtgtacgactgcacacaagtagagctttatcaaaaacaacgatactatttttatctccatctgtctgactcctgcatctgccactcaactagctctgaactcaggtagaaattaaggagaataagtcaattccaatattacataaaactgagtaccatttttacacattttcagttattttatccaccaaaactttaggttatggtaaaaaatcgtatcaagttcccttacctgctgttgatcttgtaatgcattttgagctgtgtccaaatgattttgaagatctgctctttgagcagtttttgctgcttctgctgatagtc

SEQ ID NO: 544404 - DNA, 298 bp, Homo sapiens
cccccgtttttttcccaaccccctttccttttgccgggggcccccagatttttccctttaacccagaacccggctttttcccccccccccttttccgggggcccttggttccctccccccccccccccccgggcccccggtttgaaaaatggggggggggaaggggaaagggtggggccccccccccccccccccttaaagggccccccctttttgggccccccccctaaaggggggccgggctggggggggcccccactttttttttctttgggccaaaaaaccgtttttgccccga

SEQ ID NO: 544405 - DNA, 351 bp, Homo sapiens
aggcaatgatctctaagctcttccaagtataacggatcgcgcctaccgatgaaaatcagcggtagatttaacacgacatccagtgcattgtcttctcaaattcatctgaacagccgccggagctagaataacccgaaacacttcgaaaaagaaaataggaggcctcatcagtgtaccgtgataacaaagcttatgatatagctatagtaatccagacaatatattatcagctgggggacatacacagatcaatgaaataggagtagaaaatgcaaaaacagatgaacagatatgtccaagtgatttttgagagaggtgcaaaaaaaattcatggagaaaaaataggcttct

SEQ ID NO: 544406 - DNA, 213 bp, Homo sapiens
atactatcagatatccagtgtgtccattctggcagtggttttgagtaacttcatggaacttggacatataccacctggtcctacatgggtatgcataaacttgttgagaacatctgctacacctaaattgtgactgataatcaggatgctgcgatgtcactgagactaatctagtacggtgtttctcagacccagcctatgctcctcacctgg

SEQ ID NO: 544407 - DNA, 826 bp, Homo sapiens
aaaagaagttgtttttattttaattcaagagggttggaaacttaaaaacagtacatttctccttgcagaaaattaccccatttaaattactattgggtacagagattatttattacactgcatttaggcaatttctaacattaagtgacaagttatactttggatttttttttccacttgggagctattcatgattggccactctaataataccaaagctactgaactcaccaatttttttcttagtatttaaaaaaaagcacacagaaattattataactacaattagattaacttttatcaaaagtaactctttcagaccaaaattccagtaaaaccacccacctcccttcagattataagcaaattaattcttgcctcttttctaacaaggtgcagattattcctctgtatccctttaatttctcaaactgagtccccgaagtgaagcaaacctttcttctccattttttccccttcagagatttgggtgaaggcaggtttctcttaccacccatggtggaaaggtctccaccaccttgaatttccttgactgagcaaatcttctgcgaaagaaaccaaagtagcccagggtgtagccaattatttggcactggcggaattgttgacatttatccccctctcgggggcatatttgttccccggatgttgttttgggactctattttaaagtcccctttatacaacccctttgtgttcttaaaagaaagagatgtagtccaaaatcgtgtatacatgttcaacgctaaagatagagctattgataaggggggatgtaaaaattatcccccttaaaagaagtctc

SEQ ID NO: 544408 - DNA, 517 bp, Homo sapiens
ggcagttaaaataaatgtttgtgcactgttggtggcattgtaaaatggtgcatactttctgggaaacagtatgatggttcctcaaaaaaataaaaatagaactatcatatgatccagcaaccccacttctgagtatacattgaaaaaaattgaaagcagaaactcaaacaaatatttgtacatccatgttcattaacagcacaattcacaatagccaagaggtaggtggaagcaacctaaatgtccattgacagatgaatgaataaaccaaatgtatatacatatagtggaatattatgcacccttaaaaaagggaaaacaggaaagaaatcctgtcatatgccacaacggggctgaagcttgatgacattatgttacctgaaataagccaatcacaaacaaaaatacaaatcaacatatatgtatgattccacatatatggagtacctaaagtagtcaaatccatagaaacacaaagtagaattctgattaccagagcttgggggcagagggaaaa

SEQ ID NO: 544409 - DNA, 248 bp, Homo sapiens
  misc_feature (134)..(134): n is a, c, g, or t
  misc_feature (142)..(142): n is a, c, g, or t
ctacccattggggtcagaggacgagcataaagcctgcaaattgaccctccttggatttccactaaataggagaatgcttggaaaggggagacaaaatagagatatatttccagccaaggaatactctttcttgnggttaagnaattatggcaattatgctaggatgtggagcaggatgcaccattggggaatagcatttccagtgattccaaagacatatacagattccacctatccctttccccaag

SEQ ID NO: 544410 - DNA, 306 bp, Homo sapiens
  misc_feature (74)..(74): n is a, c, g, or t
  misc_feature (76)..(76): n is a, c, g, or t
aaggttttagaaaaatccagcaaggctgggtgcagtgacttcccccttttggaagccgaggcgggtggatccananaggtaggagttcaagacccagctggccaacatgggtaaaccccctttctactaaaaatataaaaattagccgggtgtggtggggtgtgcctgtaatcccagctacttaggaggctgaagcaggagaatcgcttgaacccaggaggcagaggttgcagtgagccaagattgtgccactgcactccacactccagcctggcgacaaagtgagactgtctcaaaaaaaaaaaa

SEQ ID NO: 544411 - DNA, 570 bp, Homo sapiens
ggcgcatctggccatcaccgcgcggcctgctgcagcgggacaccgtgctgtacctggcctgctggcgcccggccaccggggcggaccgctggaaccctgatggccatgtcccatgaaaagatgttcatttgtgttgtcgttggggacaacatatccttccctcccaagccctggatatcctgtgggtgggccccaggccaacccattgccccaccttagtgctcagcctcccatacccttggtgggccccgttacccacaggcaccgcgcttattccagaggccctcgccccacagaacaggggaccatgccacacgggagaatacccgcgcacaagagcgacgcagagaggccgcgcgaaagcccacacaaagagggggagaataacgccgcagcaggtgaactcagccacaacgcgcaacaaaggggagccaaccaagcgaccccaacaaggcgaacccacacaaaacacccgacagcggcaagaggggcaagagcgcccaacaaggggagcccacgaaagaacggcccacaaaaggagggcggcgcgtcaaccgcacaaaggcgaga

SEQ ID NO: 544412 - DNA, 767 bp, Homo sapiens
tacagataaacattttaatggattaaatatattactttcaagaatcttttggaaatccccctgtggcgggactaatcaacagccaagggcaataaaaaagttaaaaccaaaaatattctgacttgaacacttgacagggaaccggctggctatgtaaagtaacatacagtgggtcccaaagaacaagggatatttttaaggaagataattcatcttaacattggtgcaagggacacatttggtaatacaagggctgggaaagaaatatatataaacgtggccggcttttaaaaagtttatttcacatttcaaatacagtatttttctcataaaaaaaaatatccagggaatgggcctaaaccccagtgggtgttctaataccattatggtcactatggaaacgactggacaagagacgcttggacaaatggtgcctgggatggttcaaccagttatggaacacttatatcgaagctggggactcacttgctggaaatcaaaacatttctacaaaacacaaaacaacacaacacccacacaacaacacagacaaccaaccaacaaaccacaccacgcggcggccgcgacgcacacaacaaagaaacgacaaccccgaacgaagaggggcccccaccacatagacgccaacgataccaccgcagactccgatcgacaacacagagggccggcccaaaagggagagaacgcgaaaaataaaacaccaggaacgacagcggtgagcaacaaggcgccggcgtgtgacaaac

SEQ ID NO: 544413 - DNA, 250 bp, Homo sapiens
  misc_feature (35)..(35): n is a, c, g, or t
atcgtttattcttttttcttttgggaagacagggnttgttgctcaggcgggagtgtgcggtgatgtgatcatagctcacggtagctgcaatctcccgggcacaagcaatccctccgcctcagcctcctgagtagctgggactacaggtgtgtgccaccatgtccaactaattttttttatttttagtagaggtaaggtctctctatgtggcccaggcggatctggtgctatggaaacttctaaaactagg

SEQ ID NO: 544414 - DNA, 295 bp, Homo sapiens
tcgatacgacagtttcatattattttttatgttatatgagacagcatcttgctctgtcgcataggctggagtgtagtgctcacggcagccttcctccagggcttaagtgatcctcttccctaagcttcctgagtagctgggaccacagccgtgcaccaccatgccctgctaattttttgtagatacgagattttgctgtgttacccaggctggtctcgaactcctgagctcaagcaatcctccctcctcagcctcccaaagtgctgggattacaggtgtgagccaccgcccttgg

SEQ ID NO: 544415 - DNA, 187 bp, Homo sapiens
tgacttagaggatcccaagctccaacaagagtactacaatcttcccatgcacagatgattaatacagatcttagcagaatcttgaaaggcccagagatcaaagagcctttgagcacacgcaagaagatcatcgcagagtcctaaagaagaaccactgaaaatacttgagaatctttgttgggagctt

SEQ ID NO: 544416 - DNA, 405 bp, Homo sapiens
cctagactgcatctatagcacagtctacgcggaggtgagtgtatcggtgtgtctaccctgtggaaatatcgcaacatggctcgacaacacctagcgggatcaacactcactgaggacaaatgcatccacaacccgagtatctcgctgagaggcctgacattgaatacaggcagtatacgactgagctcatgagctagggactctgtgtcgcggagcgtcaaggcatggagaatgaatctgtagtgatgcactacggatgtagagagatgtcaaggaagcagactggagtaagacgactgagtcagcattacgcgagacgttactcagtatcacggaacgcatgaggtgtctgagcgatgattgagacactggcgtaaatgctgcgctattcaatgctcacggcgg

SEQ ID NO: 544417 - DNA, 772 bp, Homo sapiens
  misc_feature (37)..(37): n is a, c, g, or t
  misc_feature (61)..(61): n is a, c, g, or t
  misc_feature (80)..(80): n is a, c, g, or t
  misc_feature (140)..(140): n is a, c, g, or t
  misc_feature (161)..(161): n is a, c, g, or t
  misc_feature (219)..(219): n is a, c, g, or t
  misc_feature (223)..(223): n is a, c, g, or t
  misc_feature (225)..(225): n is a, c, g, or t
  misc_feature (229)..(229): n is a, c, g, or t
  misc_feature (231)..(231): n is a, c, g, or t
  misc_feature (234)..(234): n is a, c, g, or t
  misc_feature (253)..(253): n is a, c, g, or t
  misc_feature (259)..(259): n is a, c, g, or t
  misc_feature (261)..(261): n is a, c, g, or t
  misc_feature (270)..(270): n is a, c, g, or t
  misc_feature (280)..(280): n is a, c, g, or t
  misc_feature (286)..(286): n is a, c, g, or t
  misc_feature (306)..(306): n is a, c, g, or t
  misc_feature (310)..(310): n is a, c, g, or t
  misc_feature (318)..(318): n is a, c, g, or t
  misc_feature (337)..(337): n is a, c, g, or t
  misc_feature (342)..(342): n is a, c, g, or t
  misc_feature (349)..(349): n is a, c, g, or t
  misc_feature (382)..(382): n is a, c, g, or t
  misc_feature (384)..(384): n is a, c, g, or t
  misc_feature (398)..(398): n is a, c, g, or t
  misc_feature (421)..(421): n is a, c, g, or t
  misc_feature (423)..(423): n is a, c, g, or t
  misc_feature (434)..(434): n is a, c, g, or t
  misc_feature (439)..(439): n is a, c, g, or t
  misc_feature (441)..(441): n is a, c, g, or t
  misc_feature (452)..(452): n is a, c, g, or t
  misc_feature (462)..(462): n is a, c, g, or t
  misc_feature (467)..(467): n is a, c, g, or t
  misc_feature (474)..(474): n is a, c, g, or t
  misc_feature (478)..(478): n is a, c, g, or t
  misc_feature (484)..(484): n is a, c, g, or t
  misc_feature (488)..(488): n is a, c, g, or t
  misc_feature (515)..(515): n is a, c, g, or t
  misc_feature (557)..(557): n is a, c, g, or t
  misc_feature (561)..(561): n is a, c, g, or t
  misc_feature (563)..(563): n is a, c, g, or t
  misc_feature (581)..(581): n is a, c, g, or t
  misc_feature (595)..(595): n is a, c, g, or t
  misc_feature (605)..(605): n is a, c, g, or t
  misc_feature (615)..(615): n is a, c, g, or t
  misc_feature (678)..(678): n is a, c, g, or t
  misc_feature (751)..(751): n is a, c, g, or t
agttggcgggagccacggtcgctgggcggtgtctttnagggagggggcggacacgtctctngacatcctgagcccaagtnccccacactcagtgcagttatgagtgcggaagttaaggtgacagggcagaaccaggagcnatttctgctcctagccaagtnggccaagggggcagcgctggccacactcatccatcaggtgctggaggcccctggtgtntacntntttngnganctgctggacatgcccaatnttagananctggctganagttactttncctctnccttccggctgctcacagtntttncttattgnacatacgctgactacttanctgangcccggnatcttcctccactaacagaggctcagaagaatnancttcgacacctctnagttgttaccctggctgctaaantnaagtgtattcnatatncngttttgctggnggctcttgcnctgcnttatgtncggnactggnagancttgttatttatgctgtttattctgangtgctttgtggctccctggaccagcgcaaccagcggctcgangttnantacagcatcgggcggganatccagcgccaggncctcagttcnatttctcganccctgcaggaatggtgtgtgggctgtgaggtcgtgctgtcaggcattgaggagcaggtgagcngtgccaaccaacacaaggagcagcagctgggcctgaagcagcagattgagagttaggttgccaaccttaaaanaaccattaaagttacgacggc

SEQ ID NO: 544418 - DNA, 248 bp, Homo sapiens
cccaatggaatcccccaaatggaatctacccagaggataacaatctccaaatgtgattatgaaacctgtttctggtaatggagctcagaggactaggtggaacgaacagagccctcagaaataatgccacatatctacaactatctgatctttgacaaacctgacaaaaacaagaaatagggaaaggattccctatttaataaatggtgctgagaaaactggctagccatatatagaaagctgaaact

SEQ ID NO: 544419 - DNA, 562 bp, Homo sapiens
tgtgacagagtaatcgtgatgtggatatacatggtaactctcagatgtggaagatgatgggtcaaaaatcattgtcgatggaacaggaacgaaaaacctgcagagcaacgtcaggtgtatccacttctgtacctacaaagccatcagaaaatatctcatagggcctcttcatgtaccccagtgcctgtgagcatgacagataactccatgtcttccaaagcctgtgaatacttctctttccccttccccaggcattggttttgccagatctggctaatgtggatctggcatagatcagttccatccttagcagtataacatcagtcttgaatagatactggactgtcatctttacttcatgagtgatactgggaatcccagttccagccagtgaagctgactcagagtagcacttcagcctcccctggcaacatcacagtctctagcatatagggaagaaatctgccctccagtggccaaccttttattcccaaaagcttcaaatattctcctaagtcatcactttgtgaggtctcttcaacttcagccagcaagggctcaa

SEQ ID NO: 544420 - DNA, 410 bp, Homo sapiens
gctaccaagattcggagcattatgggtaacgctgccataaacacctgggtgcagagttagtgtagacctaagtttacaattctgttgtgtaactactaagtggtctatatggtaacagtatgtctagtttcgtaagaatgccaaaactgccttctgaagtggctgtactattttccatatccaacagcaatgaatgaacagtcctgttcctattgcatccacttctcaccagcattgggtgttgacagagttctggattttggccatgctcacaggtgtgtagtagtgtctcactgttataattcacatttctctgatgacattacactgtgtcaaccatcttttcacatacttacaatcatgccctctgtatctccttctttggtgagatgtctgtcacaggtctatgc

SEQ ID NO: 544421 - DNA, 255 bp, Homo sapiens
tctttccgtctcaggtcgccgctgctaattggagccgccgccatgtctgcgctctgcacatgattgtcgtgcggaactgctccagtttcctaactcacgatggaataaggcagacctactgcactgagcccaataacttgaaggcccgcaattccttccgctacaatggactgattcaccgcaagactgttggcgtggagcctgcagccgacgtccaaggtgtcgtggtgttcattaaccgtgagatccggccag

SEQ ID NO: 544422 - DNA, 397 bp, Homo sapiens
ttttcccccgggccccccccccccctttgggggtttcccttgggggtttttggggcccttcttttgaatagcccccccgggggttgggccctttttggggaaaattaaccccgggggtgggggggcgtttttttttaaacccccttaaggcccgtcctttccccctgggggggggggggggaaggggttttttttttttccggggggtttttggggccctttggggttttttaaaaattgttttgggggggggtttggccccccccctgtttttttccgggcccccttatttttgggggggtttcccaaaggaaaaaatatgtgaaatgtaaaaccgagacaaatggtggcgaagtgtggaaggtaactatgagcaccagatgacagtgtatgacag

SEQ ID NO: 544423 - DNA, 1421 bp, Homo sapiens
gctccgatctcagatcatcctgaatgcttcgtgccatacactatcgggagctgtgccacgcagcgagagggcatagagcctccacgggagtcttctcaaacgcgcatggaatgcgtggagcgactcacggtggtagaccaaggatcgtgagcccctgtagacccaggcaattggtgaaaccagtcgatgattatcttcgcaatgtatgtcgctgcacacatcgaatgaaacgaagattgctactcatgagtttattctccgtaatcattgttctgcgggagcgaagccattcgtggcctgctctttatattatagcggacggaccgcacatgtggctgggtctcattcgaggtctcatggaagtgcactacccctgcacaagtatgtgaaaggtggttcgaaatggaatgttgtgatagaacatctctgtttatgctgcgcttgctgcgaaaagagacctagttcacgggctctcgatggagagggaactaagcatgggattcggtgctgggaaggctggtctgcctgaagtgcagcgagtggatccgcgcatgttcgtcgcgacccgacaaggtcgaggaatcatctcgtataggagacatggggcattcatggcatgtacatagactcttatgaccaaattagtacctcgtggtagtatatcgttctaaaacgggacatcccggagaagaaagacaacctttgacccattccggttcagaggacaaaagaagcgattcgtcaggaaggaagcgtgggatgggcccccatgtagggttgggagcccccagacctcatggttgtaccttgctaaccccaaggttccgggtgtgggcatagttgtcttgcaaaccgtgccagtgcccacagctgttgggagaaattggcacaattgggaggaaaccagaaccggggtcgtgcaatacccgggttaataatgggacgaaaggctgggaccacaaggggtccaagcgcccggaaaagttaaacttttcagacaaaggcttggttgggcttcccttttaacacgggctagccaagcgtggcattgagatggactccttggcctattagaaaaaggggtacataggccccagcgggcatagggaggtctttctagcagaagggtcaccagcactgaactgttcaggaagctggaggaccttcctaacgaaggggggaacggggcatagaagggaatcggctgagctgtggcaagtgtcatatggaggcccataccagacggacacaatagggagcgcacaggcgaataccatatgacataggaactgaaccccacaaggggggacacttccgcgccaggaacagagtcatgagcgttacacagacaacaaacaagaaaatatgggagacccgagcggggacccgggctaagacagtaggacacacgcagatgtggc

SEQ ID NO: 544424 - DNA, 223 bp, Homo sapiens
tctacttcggcctcccaaagggctgggattacaggaatgaaacatcgggcccagccggtaattggcctatggattatagcatttcaaggggtggtttcggcttttcttttatactattctgtggatttttttttctataataattatgtttcatcttaaggatcaggagaaataaaataagccgatggaaaaggcaagagaaaataataggaagggaaaccat

SEQ ID NO: 544425 - DNA, 881 bp, Homo sapiens
  misc_feature (9)..(9): n is a, c, g, or t
  misc_feature (67)..(67): n is a, c, g, or t
  misc_feature (77)..(77): n is a, c, g, or t
  misc_feature (151)..(151): n is a, c, g, or t
  misc_feature (157)..(157): n is a, c, g, or t
  misc_feature (270)..(270): n is a, c, g, or t
  misc_feature (272)..(274): n is a, c, g, or t
  misc_feature (277)..(277): n is a, c, g, or t
  misc_feature (286)..(286): n is a, c, g, or t
  misc_feature (288)..(288): n is a, c, g, or t
  misc_feature (297)..(297): n is a, c, g, or t
  misc_feature (301)..(302): n is a, c, g, or t
  misc_feature (310)..(310): n is a, c, g, or t
  misc_feature (323)..(323): n is a, c, g, or t
  misc_feature (327)..(327): n is a, c, g, or t
  misc_feature (335)..(335): n is a, c, g, or t
  misc_feature (340)..(341): n is a, c, g, or t
  misc_feature (346)..(346): n is a, c, g, or t
  misc_feature (353)..(355): n is a, c, g, or t
  misc_feature (358)..(358): n is a, c, g, or t
  misc_feature (363)..(363): n is a, c, g, or t
  misc_feature (370)..(371): n is a, c, g, or t
  misc_feature (373)..(373): n is a, c, g, or t
  misc_feature (375)..(375): n is a, c, g, or t
  misc_feature (384)..(384): n is a, c, g, or t
  misc_feature (394)..(397): n is a, c, g, or t
  misc_feature (399)..(399): n is a, c, g, or t
  misc_feature (404)..(404): n is a, c, g, or t
  misc_feature (411)..(413): n is a, c, g, or t
  misc_feature (415)..(416): n is a, c, g, or t
  misc_feature (438)..(438): n is a, c, g, or t
  misc_feature (448)..(448): n is a, c, g, or t
  misc_feature (452)..(452): n is a, c, g, or t
  misc_feature (457)..(457): n is a, c, g, or t
  misc_feature (461)..(461): n is a, c, g, or t
  misc_feature (463)..(464): n is a, c, g, or t
  misc_feature (472)..(472): n is a, c, g, or t
  misc_feature (475)..(475): n is a, c, g, or t
  misc_feature (484)..(484): n is a, c, g, or t
  misc_feature (490)..(490): n is a, c, g, or t
  misc_feature (504)..(504): n is a, c, g, or t
  misc_feature (507)..(508): n is a, c, g, or t
  misc_feature (515)..(515): n is a, c, g, or t
  misc_feature (529)..(529): n is a, c, g, or t
  misc_feature (531)..(531): n is a, c, g, or t
  misc_feature (535)..(535): n is a, c, g, or t
  misc_feature (542)..(543): n is a, c, g, or t
  misc_feature (553)..(553): n is a, c, g, or t
  misc_feature (557)..(558): n is a, c, g, or t
  misc_feature (562)..(562): n is a, c, g, or t
  misc_feature (570)..(570): n is a, c, g, or t
  misc_feature (572)..(572): n is a, c, g, or t
  misc_feature (691)..(691): n is a, c, g, or t
  misc_feature (718)..(718): n is a, c, g, or t
  misc_feature (721)..(727): n is a, c, g, or t
  misc_feature (730)..(730): n is a, c, g, or t
  misc_feature (733)..(734): n is a, c, g, or t
  misc_feature (752)..(752): n is a, c, g, or t
cgacagcgncaaaaccaatgggtccaaagttgatgtaatccaagttcgtcctttgtaggaatgaagnatggcaacgnaagatggggccttaaattggatgccacttttggactttcatcataagaagtgtctggaatacccgttctatgtnatatcnacagaaccttgtggtccagcaggaaatccgaattgcccatatgctcttgggcctcaggaagaggttgaacaaaaacaaattcttttaattcaacgggtgctttacataatganannnccncttgtggcncncgatgggcntctnncatcatcntcttctaatgtgntggngattttcntttcnnatatnttttttnnnttnctctnttttccnnancncgtaatgcntttttctcgnnnntnccttnctgtcannntnnctgtcgcgtacacatgtgtgangtagctagancatnctgcntttntnngtactgtnggnctctattcngtgtcntgtcctatatctgntcnngttatcnaggcgataattctngnatgncacagannatcctcttgntggnnacancagccgtntnatatgtgcagtatgacaaagaggagtttcagagacaactttgaatccttgtcagcctggagaccagcaccagaggaatctacaaggcaaactcccatatatttgcttcccccaaattgntgcccctacagactcaaagctcttttnctnnnnnnngtngtnnctctaaaaatttactgtnctttgtcgatgctatataagccagggagttctaagacgccagctctttgagatttgctcattcccctgtatttcccacatatatattacatatacccgctaataaatttatgtttgtttttctcttgtc

SEQ ID NO: 544426 - DNA, 1831 bp, Homo sapiens
tggctgagcaagggggtcccaagacctgacatgcaccctggacgatgtccccctcatcagcaagtgtggctcctatcccccacgaaacgctgcctccttcagcccctcacttggcaacactggcgtgcctttcactggcttggcccatgcactcctgccctccctgacgacctacaggcgccacgccctcccctgagcaagccacgcacgctcagcgacacactcatctgcgcgctctcaacacacaccgcgcccacctcactcaaccagcgcctgccacacacaccgcctgaccgcgcgccccctccttgcgcctgcggcctttgcgccaaccctctctcacgcgcttgcgcacctccactggcaccacggtggctcctccctgccccacctcaccgcctccgcgcaacccccctgcgcccgcctgccgccccctcttcaccacctgcccgacgcgcgtccctggcccttccttctgcagcctcccctcgccccacattgacacacccctcgcctggccccttcccttcacttcccccctaccccccaaaacgccgcgccggcccactaaccccctgccccccgccaccggcccattcgcggcacacacccctcgctccgcccatgcgctcgcgccccccctcaccctccgctggcccccccaccacccctcgcctgacccttgcgcccctcgcctcccaactccccacaccattctcctacctccacgcccccctgcagcctccgcacttccaaccccattcccgcccccccccccacgccgccttgccgcacgccctccctctcccctcccccgccctccccccacctcccccacccaagcgctctccccttccaacggcccctgtgaccaccaccccaacctgtgcgccgcgtcccaacgccccccccttgcatctgctctcccaagccttgccccccttgcctcgcctgcgcttccacatcccgcaaactcaacttccccccttcccaccttcactccaccccttaacctacgcgaacccaaccaccctctaccccaaccccccattaaacccgcaaaccgccatacaaccgcacccgccgcaccaaacacatcccctcccacacatcacaacgcaaacccaacgccgcagccctttgggcgcgactggccggacccatttgaccacaacacccatgtgcccacacagccgcccccctcttaaagacccccccacctatatgtgggccccccctgtgcgcgcgcccccccattgcgccccacacacgcgcgcctccgccctttcccccccgtccgaggcaaaagcccccctatgccgccaaaccacccccaaacccaccactaaccaccacaaacccacccacacagcacccacactttacccaacaacaacccacttcggcctttcaaccacacacacgccaccaccgcaaaaacacacaaacccacccaacttaccctcacacattcaactttgcgcaaacttcccctcttcacacaccacccccgctcacaccccatcgcgcgccccctcccacccgcacgaggacaccttgagccgcagcccatacagagacaaccagacccaacaggcagagacgaccagccccactcaacgaccacacaaccaagaagacaccatcaacagaccacgcaccacaacaaagacgccgacgcccgcccaagcaacgactgccaccatccgcagcataagtcaacagctaaaacagacaaccagccaaaacatgtcgacagctaaaagatattcaagagatcacacggaagcagtatagacaacagaaaagatgcgacacaaaaaaaacaaaa

SEQ ID NO: 544427 - DNA, 155 bp, Homo sapiens
aggaacaggtcttatttcttaaaagtgacgtcagtagatggattactcacatcagttgcattttccattgtattcatgctttcaaaaacagtgaagtattcaattatatttcccctttttggttttttttggcttaactttactattctccggaa

SEQ ID NO: 544428 - DNA, 248 bp, Homo sapiens
ttacaacagcttgggattatgggtgtgagccactgtgtcctgcctaaagaccatactcttaaaggaaaaaaaaaaagaggaaaacgaaaatttttttcattggggaaaaatctgcatgacatgaaatttaccattttaaccattttaagtatacagttctggggcataaactatatgggcagggggcaactattaccataatccatttttttttttttttggagaagaagcctaattttgtgcccaag

SEQ ID NO: 544429 - DNA, 154 bp, Homo sapiens
gtggcgtggtggccttgaccttccggaaacagaccattgacttcctgaacgacaacattcgaagagtaattgagaactactatgatgatctggacttcacaaacatcatggacttagttcagaaaaagtcaagtgctggtggcggggaggacta

SEQ ID NO: 544430 - DNA, 220 bp, Homo sapiens
ccttcatcatacctacctggtggttagtgccttcccctactctcttctcatcttcgtatatgacgaacgtaaggaaaagctcatcactcaggcgacgccctggcgggctgggtggagaaggaaacctagtattagccccccgtcctgcacgctgtgaagcatcaggccacacactctgcatccgacacccaccccctcttggtgtacttcagtcttggag

SEQ ID NO: 544431 - DNA, 357 bp, Homo sapiens
aaaacacttacgtcaacatagataatgggggaagagagagaggcagtgcttagggaagatgtaggatggatttttatttattccatgccactaccaaaaactataaatctacacacacactcacacgcacatacatgtacattaataagaaagcttatcctccctgtgactccaggaacccagcatcccgcctccctcaggctgagagccgatgcctattaacggcaccgctctcgcctatcaacatactctagaaggctcctgtgttgtctcacaagctgagagggcagggcaaagcagtgaacactcatggaggacttgctttttgtcttaaatccaatctaatcagtaacactt

SEQ ID NO: 544432 - DNA, 470 bp, Homo sapiens
ctaccccccccccatgaaaggtgttgcggattttcaccgggtcccccacagcagggaggtagtttctcattgctggaaaagtgaggaatggctcttgcacatcactaccggcaagtttcgtggctccttggaacagcgttagcttagctcagcgccggggcttcaccaagacctacactgttgggtgtggggaatgcacagtgtttccctgtttatccatcccctgcaaattgcagagtggccctcattgtttgtgggcggaccagctcctccaaggctttgaaaagggcttccagtcccgtccccttgcctgcctgcctcgggagccaggggtgtgcacctggcagtcccttcggtcccagatagccttaattctgcccggagtggaagatgaagcctgcccagtgtcccccctgttcccgctcccatcttttttgcgggcaatgaaataaagagtttcccccccgcta

SEQ ID NO: 544433 - DNA, 1106 bp, Homo sapiens
tcagctggggtccgtcaccgaccttggggaactgggctacggggaccacaagcccaagtcttccactgcagcgccacgggaggtaaagactctggcatggcattgttctcagagcaggtcgccatgggctactcacactccttggtgatagcaagagatgaaagtgagactgagaaagagaagatcaagaaactgccgagaagtacaagcccgcgaaccctctgatgctcccggagactcctccgattccacagctctctgcggcagctgtcatttccatgtgcactgggacgggaagtcaaagcgaggaacttgaagagatagagcaacaagttgagccgtaacggtgcactttgcgttgtagactccctgaggttccgtggtttacagcgatgatccaagcgtgaactaccttttgttgtctgtatggctttccaaagtccttgttatgaccctgtaagtgtgtgaactgaaagatagcttgctcataggttgattgtaccattgtcgtacaacaggagggcagaaacgtttgagcgaagtctagggtgttcatccctagttctatgaagggttgcttcacgtatagcttaccattctcgcggaatgcaactcgcccgaaagatacacccgtttcccaggttacacatttagccatcggggaactccaaggcaggatgcgcaggatgggcaggagcgaagtcgcgcaatgtccatgtgtcaggacaaaatctttggtcccgctttgaacaggggaaaccggggtgagctacgacataagggcacgtgcaaccgggcaccgccttacctatcccaaaaaatacagggctacgacggtgctgtcgggaaaggcgagttcccgggggtccaccgtcgcaatttcgtgccagggcgtttataatgctttggcgaggatgtgggcgcccataagagcgcaagggtgatcacggaggaacaaggggtagatgcgcggcccttggtgctccggggccatgggacatgcgcccaacgatggctctctcttgggctcgcgagcacggtttctatacacattctggcgccgcgggtatcccccccctgggtgggggagaaataggggggaggcc

SEQ ID NO: 544434 - DNA, 114 bp, Homo sapiens
cggatccccccccgagaagctgaccactatgaggtccccaacaacgatgaccacatgatacccacgagagtgctgattaccactagaccactgactactatcagagtgcaggat

SEQ ID NO: 544435 - DNA, 735 bp, Homo sapiens
ccctcaggctcgtgccagttttcagagctatccgctaggcgaaagcactcgcgtgcaatgagaccagcgtggctaacaaggactcactgactcccgtaatcatgtgactctagcagcctcaagcctcatgaggatcctagaactccgaacgcagcggacattcgccgagttttcatagacttgtcgcagagagaaggatttgtaccagtgcagtctaggcttacaattgatcgcctatcctgatgtgatcctccttgcctcagtgaccgagacggcctggtattacagaacggtgcaggccgaagcatacagacctcgagggcgacttggaccacttgaagtgcccgtggttctagcgtgacattgcttcgcaactatcgcctaccataggacacacttgacgattacctgcagcacacaacagtcaagtgctgatccatcacttttatgcaatgcgcaggtttagagaagatttaacggcaaacgctaaccatgcctaaggctgcctcatggtggaaaccgaaaaagagcccaatcccttaagatcaccgcacggatttaatgacgaccctttcgaagcacacaaggcctagaggactatggagcctccttaacatcttctgaaacaggcccgcgtactgtcacttaatcggcacgacttaacaatgccactatacgttagaccacctctttctaacacgcaccttcaccaggtagcttatttccgggggcccg

SEQ ID NO: 544436 - DNA, 209 bp, Homo sapiens
aaaataaatcagccaggctaagagagaatatacaaattaatacagagatgagagcacgggcattatgatagatcctatgaacattaaaaggataataaaggagtataatgagcaactctgtgcctaacgcttagtaactgaggtcagatggaccagctcattgaaagacacaatagcccaaaatcatacagggagactaggcatctgat

SEQ ID NO: 544437 - DNA, 788 bp, Homo sapiens
aagctggtggactacgcgcgcaggttgcacgaggagttttgagcgcccggcgcgccccggccgcccccacgcaccaccggggcggcctcgggggtgactccgggctccgtggctgtcccggaccccacctcttccctgccgccccggccaaccggcgggacgaccgcggttgccccagtttgatgagcggcggttgtccccctctgcagcgcgcaaccccggcggggggctttggggctgtgaacgcggtcgggggcgccggggggctggggcttgttggcccccggggggcgccggcctttccttcccttggttcccccttcgaaaattctgctgggcaattccttcacctttccctgaggaaacgcggaaatcgtcggctttccaggttccaactttccttgcccggaaggggccgcctagacgcggcgcattccggcggggcccggagaaaccccttcttgggggaccccggggcccccctttccccgagtggccgccccggcttccgcggtggcggcaccaaaacaaacagcagaggcgtcttccccttcccaatttttccccttttggaaaaaccttgggacgcggaatttttacttcaaacccgacttttagggattttaaaacctttttccgggcttggcgcaccatttagcagggttacgcccagggggaaaggtttccacgggggcgagaacgagcgtggccggggggctcccctttccccccggggggccccgttgggcgtgtttgtttcggggacgcccacccccgaagggcggtcc

SEQ ID NO: 544438 - DNA, 919 bp, Homo sapiens
gcggaaacaaaaggcgaccgccgccgagaagcgcgcccgggtaagaaggccgccgtcgtgcgacagaggccccggcaggagggcgtgaacccgagagcgagagggcgtgcccccccgtgaaacctagaggggcggccacaccggctgataaaatttatcggcggcaccaaggcccacgcccacgcaagtgtccctccgcgccccgaccgcgcccggtatatcatgttccccccgcgaaggcacccctattcctggtgggccgccccagctaaccggttcttgttcgccgcagcggctgctctatcactctcgaccgcgcgagaccccccccccaccttgcgcgattgttccgcccttcattttccaccccgaacgggttgcccccccccgaatttgagaggaagtcgcacaacaatttacgccccccattcttcaccaaaagagtggttgagccgccgatgagagctcggttcgcgaggacacactcaactcgcggcgggtggcattcccctctcacgaaggtacacttcttgctgggaaggtgtaagagctccctcgctgaccagagaaagtactgtcaccgcccctttgtctactaaggcacgggagctgccactcatcgtgtagtcgccccgacgagagggtccacacgcgcgccacctacaccggggagtgttaaacttctaatagagggtgacaaaagagggtttcccctgtggccatttgtccaacatcagcccgcagccccatgtcttctcttatgctacacaaaacgctgggcataggctcataacaccgcattataggggacattatcttgacatagagaagcacgtagaccgggctgcgctgaaaactcacgccggcctccccctcacctattcttgttcaaactttctaacagacccacatatacaaa

SEQ ID NO: 544439 - DNA, 869 bp, Homo sapiens
ttgagggatctaaaaaagtcaaactcatacaagcatagtgtggttgccatgatccaatgtgggggtggggcaatgaggagatgttggtgaaagggtacaaagtttcagttagacagggtaaataagagtgtactcttatacagcatggtgactacatttaataacaatatattgtatactttaaagttgctaagagattacatcttacatgttcttacaacaaccgaggtatgtgaggtcttggatatatcactcagctggatttaactatttcacaatgtatattatatcaaaacatcacgttatataccatatatgtacaatttttatgtggcatttatatgttaataaaatattatcccgcgtgtttttgactctttaagaaataaagtaaatttttctttatgggatacgtttgccgtgtttccacaaaagatatgacgcatgcgcaaccttttatttatctcttggatattttttttttcattatcactagattgtaattcaatggtttatggtaacccattttccatgggcggttccttctcctttctcgggaacgcttggtatacgtctttccccgcaataggcatgtggcggtgcgtagttggttgtgggtatgcacctttttgagtttttctcttgatacgctgcttttttgtgatccattgtggcgcttgtgtttgatgatatcgccatagtgatctctcgtgtatgtgggtgttttggcttagtttttcacataccatacgtttctcttgtgcccatttcgacttgagtagtatagatactggatggggcgttaagcgtggcgccccggtttgcggtagtttttgctggatttcgtctgctcggattgacgggcggtt

SEQ ID NO: 544440 - DNA, 994 bp, Homo sapiens
gctctgttcttccgccgctccgcgtctcgttgctctggtccgggtcgctaactggaagaagagatcgcgcgcgtctggtcattgagccagttggctccgtgcttgtgctggatgctggttcttgctgggtgacgacgctctcctcggagccgttgttgccttccattcgtcgtggccgccccagaagacgagggccgtcatggtgagtacttaatggtgccaaaaggacttccatacggtggtcgcgacgagtggctcagaatgcaaggtcggtggcaatccgtgtaccccgtgtaagtacgcaccacttgcagactatgggcatctgcaactacgcaaactggagtagcagacagtgtgagaaggatctgaaaacgcacacgccttcgtaacaaatcgaaagctgcgtctgtggccccggatggagcacccatgtgctgtgtgacctgaggacccccgtgaacccaaggccaacagagagaagatgagtcagatggatgttgtgagacccttcgaacaccccggcatgtacgtggccatccaggccgtgctgtccctctacgcctctgggcgcaccactggcattgtcatggactctggagacgggtcacccacacggtgccatctacgagggctacgccctcccccacgccatcctgcgtctggacctggctggctgggaactgaccgaactacctcatgaagatcctcacttgaccgaggctacatggttcacccaccacggcgagcggggaaaatcgtgcgccgacatccaagggagaagcttgtgctaccgtttggcctggacttcgagcaggagatgggcaccgcggattctcctcttctctggagaagagtagaagcttgccgatggcaggtccttcacattggcaatgggcggttccggtgtcccgagggcctgttccagcttcctcctgggattggattgggggtccgaacccttactcttctgaagggcggggctccgaaactg

SEQ ID NO: 544441 - DNA, 978 bp, Homo sapiens
gaataatggcctgaagaagacctttgcttcttaccgctgaggagtcaagcacaaatctatgtatagcgcagattgagtgaatggcttctgtgatcaagtaccttagggcacattgacatgtagatgtatccatctaccagatgagtggtgagcgcattggcattgatgtcggcgtctccaagccgattcctagaattgccaaggcgctcatgtttgttaatgtgcccttgatggattggcatccataaagtgtgggtaagtaaacaactacataatagcatgaccgaagaagtaagcatataggtgtccccttatctataatgacgtggggtgtgcccatgaaaacaacctatactggcttaagggactgttttagactaactataagcgtgtaatgagtaccctcaaacgcgcggatattatatatacaatcagagtgggcctgtcgatttgtgatttgcccagacggtgacgtccaggaagtccccagcatgggacccctatgtgtacgtgttgatggtgctatagaatttgtagagcaatcttgagttacagagatgatccccgtaaggtgcttcagtgaggctttcatactcgcatggctcggagctgagtaagtgtcataaaatgagcctcatttctacgcatcacttgaaaatgcagaggaaatctggtgccgatctatgcgtagaggtcaggatgcacttcataattgtgtgaagcatctaccttagacttcgtgaaagtccgtccgcagagggttcggaccggtatgagctccctggcccccgctttgggaaggctattaaccaactaagtcacttcattcacaattctccatttgcccggtggaccgggaatccactttgtaccccaatatgcaggggccactcgaaaactggcgcttaaacacgcaccaacgtttatggcttaacaatccaacgcggaattcttcacaacaacattcgcccctcttaa

SEQ ID NO: 544442 - DNA, 844 bp, Homo sapiens
taattctgggatggtgagaattcgggatagggttcctaatgggacaaaagccagagataaaacgtccttcacgtgctccctaaccgggttctttctggaccagaaccacaagggccgaattgggatcctaatggtccggtctgggtcagaggcctatctttatggtggttcggtaaacttttaacaatgagaattaattctggctctggacattgtcatttggatgctccccacacaccaatcctttcctggtgacaacagagagctacaactcttcttgggctcctctggtgactcccaactccctccttgggaagcttgggctcaggacgtctggggatagaccgggcaggaattctggtgggttccggttgtgttcctaatattaatggtgtggatgggacttggaactaaaacagtgggaaatggctggagcaatcaacattctgacatggtcaacccattttaccttcttacagggatatcttttctgtacaaagagtggctaatctttaagaaggaatccttctttagaaaagctattggcattttcagccatatcctttgtggttgaatccggcgctcaaataagttctgggctcacattttccctggtccggatcttgtacccactagggatggccgtgtagggcaggggtttcagaacctcggtttcggttaacctttgaattggaagggcctgggttaggcctttgcctgaagtttcccccaatgggtcgaacccgagacaccgggcacggttagggtactcgaggagaggttgtgtgtttagatctcatttatatacatacggtcgtgacgagtggagtgcagacgaggcgcc

SEQ ID NO: 544443 - DNA, 310 bp, Homo sapiens
  misc_feature (88)..(88): n is a, c, g, or t
  misc_feature (132)..(132): n is a, c, g, or t
aataaagtcagataatattaagtgttggtaaggatatggacaaatcagacctctcagaccctcctggtaggaatgtaaaatggcgcantgcctttggataatagtggggcagttattcatatagtaccaccngacccaacagttacatttctaggtatatctccagaggatggaaacatattgcacaaagcttgtaacgaagttcatatcacattattcatataggttaaagtggaatacccggagctcatcataggtaatggtaataacccctatatccctaaatgggggtatgggccaaggatgggct

SEQ ID NO: 544444 - DNA, 360 bp, Homo sapiens
gcgacctgcgggatcagtccgcacgcacgcggaacgttcgacgccaacgacccgagcatctgagtcaaggcccgcgcggcacgttcgaccccaagcagctgctgatcacgctgaacgaaaacgccgacctctcgaccttcctgcacgagagcgggcacttcttcctcgaggtgatggccgacttggcaagccagcccaacgccccgcagcagatcgtcgacgacatggcgacgatcctgaagtggtttggcatcaagggtgacgagcaggtgggtggcagcgacagcggtgcgccgctggcgcaacaggatgcggaagcggtgtccgaagccatctacaaagaaatggccgctgacgatg

SEQ ID NO: 544445 - DNA, 417 bp, Homo sapiens
gtgaccatatctggaaatcctgctctcaaaacaatcaacaatataatctatcacaggtgttttactcaggttctaatttgtataagaaaatttgtatctgcatattatgcatcaaatatttatgtgtaaaatgtatgttttacctccttaaaagtgcctaaaagttcagttaatagtgtacttgggtttaagctatacacaatgattaagtgcaatgtaagtatggtaatttaatgaaaagcattccttgcccaaggatgtataaatttttgaagagaataagcgagaattatataaatatgaaatgctatgtaaagatttgtctatgtatagaaatattatgtagtaatactgattaaagagtatcccatgctttgatcgaggtggtacatcaatagaaatttcctaccaacagta

SEQ ID NO: 544446 - DNA, 956 bp, Homo sapiens
  misc_feature (288)..(288): n is a, c, g, or t
ccccgctcagatcacccgcagtaagcgtgcagtttccccggactctccgtcgcgttgccggcggaaggtcgagctgccgttaatgtgctgttcttggcgtcaggagaccctacctgacccatcagcaaaaggtgttgcggatttataagcgggcgctacgccacctctagtcgtggtgcgtccagagagacaaataccgatcacttctgcttgctattgagtgaggagcccggctttgacatcaatcagtacagaatgagagacaggatagtggcgtaaggcgcgagncacagctgcgtgataacggagcgccgaggcaagaagttctggctaccggtcaacatccacaggcagtacatcgttcctctgactcttccatgggaggcacctcctactggaggagataccgattgctagaatcggtcccagaactggtgcttacgatgactggcttcctttcttgcagaagggcgaatgtatcctagattactttgccaagatagaacacgtggaagaagactgcgtgagggaaacgctagggaagcgagaggttcaagtcaggctgcatgaggaaagcgccagctggtggtcctttagactgaagtcttttgccccctggccgcaaagggaccggtgatttgccccccaacctgtggtggtatattgtgaccagacccccgggagcggcccgatggtagaaaggagatgagagctctatctttccatgcttgctagggtgatcatatgttcacagatacatgccacttgctccgtagattgagaccaattcgagtgaaacatggtctaacaaccattgcaacagagcagctggagcagtgcttcctgtaggcaataaggcaccgatgatggccaaggtcgggtggaccgacatggtttcacttcagcgcgaatcccctgtacgcgttgaccggtatgaccaagctagggatcccaat

SEQ ID NO: 544447 - DNA, 350 bp, Homo sapiens
ccagctgactgcttcttccctaaatagttatcgcatagtttggagctgtgatttgggtcattgtcctgtagaaggaaattggctccaattaagcgctgtccacagggtatggcatggcatagcaaaatggagtgatagccttccttcttcaagatccctttagccctgtacaaatctcctactttaccaccaccaaatcacccttagaccatcacattgcctccaccatgcttgacagatgtcgtcaagcactcctccagcatcttttcattttttctgtgtctcacgaatgttcgtctttgtgatccgaacacctcaaacttagatttgcctgtccataatgtcgacgc

SEQ ID NO: 544448 - DNA, 474 bp, Homo sapiens
tcgaagcatctgtgagaatcacatgatgtgaacgctactgcggagaggacgtactccaggagggagatcattaactcaagtccgggcgagagaataggctgtgaccaggctttccaagccacgcagcttcagcttccatcaagcccatcctcaacgcacaacgcaacacaaggcacaggcacaacacagcgaaaacataatcaaagcatcagagagaacacagaacagcactgtggcattctgctggctcttttgtttctttcataagaaaaggtgcccatgaggggagcggcaacaggtgtatgctctcacttagtataaatggactagaacatgggctctcaaaggggcacaagtccctcaaggggtacacagcctgcccaggatgtgcaaagccatgaaatcagcatggcacatcttcctggagtagcaggatgattaatcagtttccaagggagaattaattaaatagtg

SEQ ID NO: 544449 - DNA, 339 bp, Homo sapiens
tcccccccctacctcaagactggactgagaggtccccacatccagctaatttttaaagtttttcatggaacggactactatgtgccaagctggtctgactcctgggttaagccatcctccacctacctccaaatgctgggattacaggcatgaccactgacccagccaaaattgtttcttttttaaggaattcacaattctggagtggctctttgcatgaacactgtgcaagggttggagaaatcaaagctgaccaaaacatggccccaccttttggactacagtctgtctgggaacagagattagccaagtcaagaaacactggatgcagctagatta

SEQ ID NO: 544450 - DNA, 146 bp, Homo sapiens
cgtctggatcgacggttccttctccgatcgttgccctgggaacaacacgcaacatccacatccatggcgtgcactcccagcaatcaagcgcatagcgcgtgccaccactcattttccaaccgtcaaggccccaagctctcaaattc

SEQ ID NO: 544451 - DNA, 171 bp, Homo sapiens
ctagacgtctctgatagagggcaggaaggggagatagtgaacttgcggaacaggtggtcttccctgggcaggaagactgtctctgacagtcctgtggtagacaggttttccatattcggaagaccacgatagacattgaccaactggtaggagatcgccctatgtcgtcgc

SEQ ID NO: 544452 - DNA, 879 bp, Homo sapiens
ccgccctgtgtgtcagcggctcggctcccgcgcacgctccggcctgtcgcgcatgcctcggcacctgcaggtctgtgctgtccgacggctggcgccccgtgatctccgtcccggccaggagggccagtgatttccctccctggggcccctggtgaccatacttgctgcggtttttgttcctggggctgagtgcctcgtcgcgctcccctcgcgtggccctagcgtgcatctgcacttgtcctgtcaaccggttgcaggctggtggagggaggggaacgtggtgcttccagcgtggtacaccttgcacggggaggtgtcttcatcccatgccatgggaggtgccctttgtgatgtggttcttcaaacagaaagaacaggaggatcaggtgttgtccgtagctatcaagtggggtcacaaacaaagcaaatcgctggatgtatccttggtctagctccatgccctcccggtaatcctgtccctgcgtgctggagggtctccaggatgaagagactctgtgaccccttacagtctgctccgtgaatgtgcatagacaaacaaggcaaatctaggggccacaggcatcaaaaccttaggaactacaatgtactggttcctccagctacttccatcctgcagtctccagggttgtgccccatgtgggggcaaactgttaaccgtgagacttgccagtctccaagggagtaaagcccgcctgtaccaataccagtgtgattcggcagcttgccatcctttcaagactttactttgcagcaggcattagatgtcatccggggggtctttaagccctcatcaaccttactgacttccatggctggcatctatgtcctgcaggcacacaatgaggatgtgcactgcct

SEQ ID NO: 544453 - DNA, 211 bp, Homo sapiens
acatacactgagtaatccagatttgaccaggatgcgtatatcatcgtgtaatcataatcctgaaaatacgtcattgatcttgatactcagattactgataaaccagcattataaactctatcctgatatcttcccactctatgtaatacttctttctgttatagaatatctcagtatcccccaagtattaggggaaaacttcttgtaaccc

SEQ ID NO: 544454 - DNA, 536 bp, Homo sapiens
agccactgacccgcccaaatcctgaaatttctgaaacaactatatctttaggtaacttactagcttttgaagagttcaggtttgccttttattacaattattgcattgatactagtagtattttatagactttcttgtgtgaaatgaaaagctccttgtgactattaatttttcttattccagttattgaattgctattgtcaccatataatttaattttatttatttatttatttttgagatggagttttgctcttgttgtccaggcgggagtgcaatggcatgatcttggctcactgcaacctccacctcctgggttcaagtggttctccttcctcagcttccctagtagctgggattacaggtgggccaccaccatgcccggttaatttttttgtattttttagtagagactggccatgttgctaggctggtcttgaactcctgacctcagctgattcacctggcctttggcctcccaaggtgctgggattacagggtggtgagccacccccgcccaggccaattttaataat

SEQ ID NO: 544455 - DNA, 511 bp, Homo sapiens
  misc_feature (182)..(182): n is a, c, g, or t
  misc_feature (289)..(289): n is a, c, g, or t
  misc_feature (330)..(330): n is a, c, g, or t
  misc_feature (379)..(379): n is a, c, g, or t
ctcctgagtagctgggattacagtcgcctgccaagagatggggtttcgccatgttgaccaggctggtcttgaacacctggcctcaaatgatccactcgccttggtctcccaaagtggtaggatgacaggcgtgagccaccgcgcccagcctcttctattcttttagagacagggtctcactntgttgcccaggctggagtgcattgatgtgatgtgtgatcatagctcattgcagccctgaccatccgagctcaagcaatccttctgcctcagcctcctgagtagctgnggccgcagatgtgcaccactgcacctggctaatttttaacntttttgtggagccagagtctgtataaaataaagtgtaaatagtaccatnaataaagaatacatagtaccattttatagtagtataaaacggacattagaaactctgaacttaaaggttaaaaaaatacacaaaagtagttctcaagttctagagacttggagaatccaggaatcaacaatg

SEQ ID NO: 544456 - DNA, 148 bp, Homo sapiens
gacagactctaggaggatccccattccaagacagaccccgaaaatcccctaaaagtgggacaccaacagtataccctaggttgcttaaagggattacactatctatataaagtcaatacaaaatgaagtacgttgtatatattgcaac

SEQ ID NO: 544457 - DNA, 419 bp, Homo sapiens
  misc_feature (258)..(258): n is a, c, g, or t
gacacaagtcatgtattcaatacccaacaagcacgattggctcacgcaaccttgtctcaacaacagggtttccaaccaggtctctcagccaacttcagttcagcagattccaatccctaatttatgcaccactgcaagggcagcatcaagcccaactgagttggggggctggccctgcttgttccccaaggcttcaggaatggttcagctccttcactttcaaccatatagatctcagccagctttttatgcaaagcnggtttatccccagccatctgtggctcctttcgtggtactgctaattcagcaactttccaacgtgtccaacacccagagaacttgccaagggcacaactccgggtcttgccttttcagccaaaccatcagacgacgaggcttgcagggtaccagagctcgaa

SEQ ID NO: 544458 - DNA, 1085 bp, Homo sapiens
gtgtcttatcgtgcggccctcttggtgtgttattccctccctcttcttctttctccactgtcccctcctgcatggcctccatgtccccctgaccgctttcccctcgcccctcgtccgtcttggggtgctctatccacgcgtttcgtccccccgttcgtggtgctctccccctgggtcccccgctccctttggtttcgctctcttcgtggtgattcttgtggatcgtccggggccacgtcagactgtcgcggtcctccgttttattgtgtgtgccttgggcctctgccttgttcctttttctatgctatgcttctcttctctctcttcgttgcgtttcctcttcatgttttggcttttggccctttgtgctgggtacgtcccagtgtatccgagcgtgccatacacctggatgcggggttatctatggtctctcgcgtgcctgggggcctccattctccctggagcggtcctcggcggttcatgggctttctcggctctcttcgcttcgcctcctctagctctactcagatgtcactcttccccttcgtcgctataactctctacgtcccctttgctgttgggactgtgccattggtcgacgtcacgttcgtggggccctcgtgtcttgtctgtccctcctcccctctacgcgtttctttgtctcacttgtggatcacaggtgtcaatgcacaatggagtgtggctccatggcaccttgggatcgccgcccaatctctccgatggatctccactcatggccgccgcttcccctgctgctttgcaggggcggtcagggcaagcaatggacttcctcttctgggctccccgtagtgtgggcgatcacctcgtctccagcccatgcaatctctccagtgacacatagacgcgtgcatctcccagtaggatggggcccattgacctcatcaggacagtgtcggtggctgctcatggcatcttcagggacaccaccacgctgaccgccagaccctggtctcatggcgcatctcttcccatcttgtcccgaagatatgcgccgtactagtgccttttgatggggttcccatcatccatgcctgatattgtat

SEQ ID NO: 544459 - DNA, 1312 bp, Homo sapiens
tctgttggtgtttgtgactgttgctgatatcttctatatcatgtttgtacttggtctgtttagtcttcgttgttttttattaccgtttggttgttggctctgttgtacgtattctttcgttctattcgtagtctttgatcttttctcattgttgaaagctcgaattagcgtccttcctaagtcactgcgttaccacatatggtgattgtcgcttgtctcgtgtgtcgtgtgctctttgtctcatgtcttgtctttcacttcttttgttgttcttgtggttgttctttgggtcctcttgttgttgttcttctttggtttgttattttttctttctttttgtttctgtctgtgtgtcctctttttgtcttttgcctttttggtttgtcttttttgtcttctttttgtgctttttcttctctttttttgttttctgtttattccttgttcgtttttattttgttctcttggtgttgtcttttccttcttttgttttggttccgctttttcgtgtgttttattgtgtagtttgtttttgcttcttttttggttttctgtgttggtatgccttctaccctggttttttggtatttcttcttgtgtttcttgtgtgcttgttgttgcccttgtctttgtggagtactttttttttgttgattgcctatctttctttctgttcttttttgcgttttttttgtcggtttgtgtgtgtttttgctgcatctctctcttcatgttgttgtcccttttttggttctctctctcttgtcctctatgtctcttgtgacctttacatagtgtgtctgttgcttttttctgggtactctcctctaggccctttagttactacttagcctggatatatgtacctcctggtggtatactagcctattggcttataggataggtacaagttaagtttggtcaaagtattcccatacgccaggaccctacatccctttggtattgatttcactagtctagctgctcaacggaatggcctctcctacatccagggatccttagcaccctaccggtctgcctttaattttaccacaggtataggactcactattggggcgaatgtaccaagtttcgccatgctggtatgatgaaatggattcccatctccaaagtctgagtatggattgcatatactagtgtgcagtctccagagccatccataaattctagccatatgtcacaacaaccaacagcaagaaaacgtgttctatatatagagtgtgcccaatctgtgtttagtacacaagcatagcatatacacccatacaaattacctgcgtgggggcagtta

SEQ ID NO: 544460 - DNA, 576 bp, Homo sapiens
acagctccatctcaaaaagcaaaagaaagtcaagggatggaaaaaatcaagaggcacagaccctaatactctttatgcatcaaacacacaaccccagctttatacatggcaagaaaatatccacaattcaccacacttacaaggagcagatacacctgccttctatggataatactgatatatatagagcacacaaattcctgcaagtctttgcatgcaggcaaatgtcaaattcatcaatttccaacaattcaaatcatgtgcatcatgcacaacagcaacagtgtcaggtccagtcattgcatatgcacttcagttaccccaatccttccaaacaaatgtgactgcagtcgccaaaaagttcatttgactcatgtgttagcatttgctttaaagtaatatggagggaggaagtagcatggtgcatagccatggaacaagatggattgtgaattaataatcgttgaagctgggtgatgggtacatgaggatttattatgtaataggatctcactactatcatatgtaaaaaatttttagcatcttaagactttaagtctgtcatactcacgtatg

SEQ ID NO: 544461 - DNA, 174 bp, Homo sapiens
ggaaggttgagctccaccgcccttgactacggctccggggacgaggacagcaagagcgagaagaggaagaacaaggacccgctctacgccaagatggaggagcgcttctaccgctacggcatcaagcccgagtggatgatggtccatcggatcctgaaccacaggtgcgtgccc

SEQ ID NO: 544462 - DNA, 351 bp, Homo sapiens
ctaaatgaagtccacatgaccgactgaccgacctggggaacatagcaagaccccatctctacaaaaatgtaaaaaataaaaattagccgggtgtagtggtacatgcctgtaatcctagatactcgggaggctaaggcagaaggatcacttgagcccaggagttcgaggctacaatgagctgtgatcgtgccactgcactccatcctgggtggcagagtgaggccctgtctcaaaataaataatccagtcccccccaagaaaggaatgaagttctataatgagaaaaatcctagtaactaacatatagtagacagtggagagtggttctctttcgttttcttaggggcagac

SEQ ID NO: 544463 - DNA, 917 bp, Homo sapiens
  misc_feature (170)..(170): n is a, c, g, or t
  misc_feature (234)..(234): n is a, c, g, or t
  misc_feature (248)..(248): n is a, c, g, or t
  misc_feature (255)..(255): n is a, c, g, or t
  misc_feature (267)..(267): n is a, c, g, or t
  misc_feature (269)..(269): n is a, c, g, or t
  misc_feature (282)..(282): n is a, c, g, or t
  misc_feature (284)..(284): n is a, c, g, or t
  misc_feature (287)..(287): n is a, c, g, or t
  misc_feature (290)..(290): n is a, c, g, or t
  misc_feature (292)..(292): n is a, c, g, or t
  misc_feature (309)..(309): n is a, c, g, or t
  misc_feature (314)..(314): n is a, c, g, or t
  misc_feature (318)..(318): n is a, c, g, or t
  misc_feature (329)..(329): n is a, c, g, or t
  misc_feature (354)..(354): n is a, c, g, or t
  misc_feature (372)..(372): n is a, c, g, or t
  misc_feature (384)..(384): n is a, c, g, or t
  misc_feature (390)..(390): n is a, c, g, or t
  misc_feature (399)..(399): n is a, c, g, or t
  misc_feature (441)..(441): n is a, c, g, or t
  misc_feature (485)..(485): n is a, c, g, or t
  misc_feature (495)..(495): n is a, c, g, or t
  misc_feature (513)..(513): n is a, c, g, or t
  misc_feature (518)..(519): n is a, c, g, or t
  misc_feature (521)..(521): n is a, c, g, or t
  misc_feature (531)..(531): n is a, c, g, or t
  misc_feature (537)..(537): n is a, c, g, or t
  misc_feature (540)..(540): n is a, c, g, or t
  misc_feature (547)..(547): n is a, c, g, or t
  misc_feature (699)..(699): n is a, c, g, or t
  misc_feature (713)..(713): n is a, c, g, or t
  misc_feature (768)..(768): n is a, c, g, or t
  misc_feature (815)..(815): n is a, c, g, or t
  misc_feature (826)..(826): n is a, c, g, or t
  misc_feature (840)..(840): n is a, c, g, or t
  misc_feature (902)..(902): n is a, c, g, or t
cattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagcnagaatatagatccctttaagaaaaaaaaaggaagaaagaagaatttgctggttagtcgacctcngtttaagaagtgcntcacccnccccctccaccncnccgtggtgtttcncngcngcncnctgtaggttagggttcngtgcngccnggcagaaagcncatgtgttagcagaatagaaatcancgacagacatagaccacnaaaggttaacantatccnatgtgaatnccaaaaatgccatccaaagagtcttggtcagggaggaaaacnaaaagggctgcagttcacaaatcaaaacaagagggccgtcagcnagatttattnatagcagccttgggaatnaaacnngngtctccaaantcgtcngtnacaatcnggcaacctctgaaactctttgcttattcgcagttgacatcacttgttagaagagcaactctgaaagaaaacgagcaaattccaaaatatgaaaagattcacaatttcaaggtgcatacattcagagggccacactggtgtgaatactgtgcnactttatgtggggnctcattgctcagggagtgaaatgtgcagattgtggtttgaatgttcataagcagntgttccaagatggtcccaaatgactgtagccagacttgaagcatgtnaaaaaggtgtncagctgtgaccttncgacgctcgtgaaagcacataccactaagcggccaatgggtggtagacatgtgcatcagggngattgagtttagagg

SEQ ID NO: 544464 - DNA, 176 bp, Homo sapiens
ctcggctagcatgtgatttacttcactcataacgttctcatactaggctactaacaacacactaccatataccactgatgcgcgatgtacagagaagcacataccagggcacacacacacctgtcaaaaggcctcgatacgggatatcctattatacctagagttttttctcgaga

SEQ ID NO: 544465 - DNA, 269 bp, Homo sapiens
cactaaagccaaggtctgtaagcacgctgctcttccgagacttccattccttctgattgcgacacgtgcagctcatgacaatctgtaggataacaatcagtgtggatttccactcttttcagtcccttcatgttaaagatttagaccacccaccataccaacctgggtaaaggaccggttttcctttggaaggaagttttaactatatgtaaacattgtataatgatatggaataaaatgcacattttaggacattttctaaaaaaaaa

SEQ ID NO: 544466 - DNA, 328 bp, Homo sapiens
aatgtcactagagagagggctgcgagagaggtctaaaaaagatacaaaacaagaaaactggaagaaaaccctaaagtactggctttatttgataacattcatggcttcatgaactttggaaaagtgaaattgttacttgttatgagttgatgacagtggttgttttgagaattttcaggtggcacaagattgactagcagccatttaaaatatgtccttatgggaagagaagctaattgctgcaaatcagctaacaagtagttggggtagtttggggtcctttcttgacctattggatttgtctacgcactcaagaatctcctcgatc

SEQ ID NO: 544467 - DNA, 145 bp, Homo sapiens
gagtgtgttgcttgggaatgcagcgagagcgggtggtagactctatctaaggttaaatagcggacgagtaccgatagtcaagaagtaccgtatgggtatgttgataagaactttgaagagagagttcaggagagcgatctacagg

SEQ ID NO: 544468 - DNA, 400 bp, Homo sapiens
  misc_feature (60)..(60): n is a, c, g, or t
ggcacgagcggcacgagacttgatgtgattccgtttgttgatttttgctttggttacctntgcttgtggggtactgctcaataaatttttgtccagaccaatgtcctggagagtttccctgatgttttcctataatggttttatagtttgaggtcttagatttaagcctttcatccattttgatttgatttttgtgtatggtaagagatagtggtctagtttcattcttctgcatatgagtatccagttttcccagcaccatttattgaagagattgtcctttccccaatgtatgttcttgggcacctttgtcaaatatgagttcactgtggggtgtgtgaatctgtttctggggttcccagttctgttccattgggtctatgtgtctgtttttatggcc

SEQ ID NO: 544469 - DNA, 109 bp, Homo sapiens
agatcctaatgaggttctagagtgttcagattgaacagtagatatgatggtgccaggatgtttgaatggactgttctatagtttgggtgcaaaatattctgggcaaaaa

SEQ ID NO: 544470 - DNA, 486 bp, Homo sapiens
  misc_feature (52)..(52): n is a, c, g, or t
ctctccagtctcgtctcagccacctcacccagatgacacccacgcggccctntggcggaaaaatatccgcaactcgaagcagggaaggaggatatcagccgcgagaccttcacaagacgaagggctgaaccgggaggcgaagtttctcaggaggtcccggagtcagaggaggggtaggagtggggtgacggccccaggcgaggaggaacaaagctactagaagagcggggcgcatccctccccggtgctccaagtcccctctccggccgcccgggccttagcagggttgtggactgaaagtccgggagaatacccccttccctctccaaagcgcaacccggtccgggtggctcgggggatcccagcccgggacacgcagccctgggacgaaggaggtcccgggccaagaacaaagggtggggcgcccggcccagccccgccgcccctcacgcccgccctctgaatgggaccccggccggcggccgc

SEQ ID NO: 544471 - DNA, 225 bp, Homo sapiens
agtgttctgatatatgagtgtgagtaggagtagggaagaaggaggagcacgggcaggaaaaggtcaggcatgagaagctcggtgtctcagtcccatctcccacttcgtgaatctaacaccacacataccaatgccatgtctgatagtcctgccccaactcatgttcaggccccagcaccctctttattttctttgcactcatgaagccctacccacaaacacctg

SEQ ID NO: 544472 - DNA, 473 bp, Homo sapiens
gctggtatttcctatcacataagagtgtgctataaatgtgaatataatcttgtgtccacttgtgtttacgcttgtgacacatctctgtggccacatatctcttctcccacatatacatcacacgctctatatgcccacgcagtctcctgtggaaaaagtatagagccctacaaagttatagatctcagatacacatgtgcgcaccgatgttatgcgcacagtgagagtaaccatatatatttagatatgcaacactcctataacgccttggtgtgaacgcactctctcacctctctccaatcacaaaggggcgcttgtgtccttccacagccatatgctgtgcttgcgcatttatatctctgtgcccttgtgtgcacatttttctttggaaatctgtgttaagagtctctctgtgatttaagagcgcctcactcctcgcgtgaaatactcgcacagcgcgggatacccactag

SEQ ID NO: 544473 - DNA, 106 bp, Homo sapiens
tcgaggattctaggttcttagggagatatgctggctgttaagaagggactggacccatacaatgtactggccccaaagggagcttcaggcaccagagaagcaccta

SEQ ID NO: 544474 - DNA, 197 bp, Homo sapiens
ggggcaggcaatagggggcctttcccttcctttcctttttcaggccttgctcccccaggatgacccccttttaggggggtggtggcatttggacaaattcccccccagcaggtggggtggcaaaactacctggaatggatttgtgtgctgatttttaaggattattacaaataattaaacagaacggtcagccttca

SEQ ID NO: 544475 - DNA, 436 bp, Homo sapiens
  misc_feature (118)..(118): n is a, c, g, or t
  misc_feature (149)..(149): n is a, c, g, or t
  misc_feature (332)..(332): n is a, c, g, or t
  misc_feature (391)..(391): n is a, c, g, or t
cccacgcgtcgggagctgctgcgacagtccactacctttttcgagagtgactcccgtgtcccaaggcttcccagagtcgacacctgtgcggctgcaggcaccggcgcgtcgagtttcncggcgtcgcggaaggaccgtagctcttctcngcggatccaggtgttccgtgttccagcgccccaagtctcacgagccgacgccgacagagagcagggaaccggcatggccaaagccgcggcgtaatcgagcatccgaaccgtgtggcaccgacctacgtcctgtcgtgggggtgtccaacacggaaggtggagatcatcgccaatcgaccaggngcaagcgcaccagccccagctacgtggccttcacgtgacaccgagcgtgctcatcgggngatgcggcctaagaagccccaggtggcgcctgaacccgcagagac

SEQ ID NO: 544476 - DNA, 178 bp, Homo sapiens
tttagcaagtagcgcaattacccacgctaaagacgttaggtcaaggtgtaacccgatgaggtggcggcgaaatgggctacattttctaccccgagaaaactacgatagcccttatgaaacttaagggtcgaaggtggatttagcagtacactgagtgtagaacttgaacgggtaccga

SEQ ID NO: 544477 - DNA, 292 bp, Homo sapiens
gcatgtgtacgacattgcagatttggtcgttatgaatacatattattagagaaagtgtgcatcatcattgtcgcaatgggccgcatcagcatagctggggctatctgtccaggagcgctaggttctacacgaatactttatagagtcctgtgtgtgcaagttttctcctgaaatgatcgtcaaagtgcccgcaggttgtttgtgattagctgtctctaacaattgttcatacaataattgttcattattgttctcaacttggggctctccccaacctggggacccttcctta

SEQ ID NO: 544478 - DNA, 1691 bp, Homo sapiens
  misc_feature (534)..(534): n is a, c, g, or t
  misc_feature (618)..(618): n is a, c, g, or t
  misc_feature (705)..(705): n is a, c, g, or t
atttggtcgcccccgcaggaggtctctcttgctgtgggagggcagctctctctgagtgtggtttcccccccgcgctcgtggtggttttttggtggtatactacacaacctctgtgattggggggtgctactagcgccccccaccaccccttcattatatggcctttgtgggacatatgcgtttttgtgcgcggcgggcggacaaactattaatcagttggtggtgtgtgttgtgttcctccgtcaaccggtcgagctaatggtcctttccccatccttgttggtagtagagattttgtgttcttagtgttcgtccgcggcgggggtgctaggtccttcttgtgtgggccacccatattttggcgggggggacccctaccccacattgtgttgctcgcctccgtcccccgggggtatcaccgtctgtgttgttgtagtgacccgcactgtgtggggagccaccgccgccaataaggaggcccttctttattatgaggggggcgcccgctgccagcaacccaagaggaggctgttnttttccccccacaccacctttggtcgtagtataagttgctgtgtccggtagtgtttacgtaggccccccactcagggttcaccnccctctgtgttattagtaagtcatctctcttcggttgtttcaccacctgccacccccagcaggttgtttcaccccagctttggtggngtgctgttgagaacacacttcctctccagtaggggagtagccccccatcactggtgttgcggcctttgtctgttcttcccagcccctccccctcagaacttcccgcgaggccccccccgcagcggtttgtctaaaagagcgatatgagtagatggcgtcacaactgtggtctgtcctcctctcacagagacgtcacacgccgcgcaataggagagagagcggggacgagagggtcctctgcgagagagttctctctcgggagagatgtcgcggtgtttttgtgggctgagtatctctatcacttctgggtgctactctcaaatagcgaggagcacaacacacagctgtggtatgtgttatagcttttgtggttttggtttttctggttgtttatatatcctccttgtctttctcttctctcttcgtaagaattcgtcgcggaggagacagcatctcatcagcgtcatctcgtcgtaccgccactcgtcgtttggtctatagggcgcacagcgctcatgttgtcttgtatcccagcgcagcacggcgcacatcgtagagattgttatcaagcaggttatagcgagaagcgggtgcgcgggtggtctcacagcggagttcacactctcgggagattctctgtagacacacactgtgagtaaacatttacacaccctcggccacacgctcgcgctcttaaagacctctgtccccacactctcgcgggtgaatctcgccacgagagcttgagagcttggcccacgggagaggggctatagagaagggttgggggcctcggaacacccctcccaccgcggagaggagagttccacattctcgggttcttccacttctatagaacctcgtttacaacatgaaaaatataaaatatactcccctgtttcatgaaaaccccttgatgttcccagtattaagacctaatgccatattttttaccttttctaataaaccaggtttgtttaaaccca

SEQ ID NO: 544479 - DNA, 82 bp, Homo sapiens
  misc_feature (9)..(9): n is a, c, g, or t
  misc_feature (32)..(32): n is a, c, g, or t
catggattntgctggtgcaggtacaactaggncttaatagggacccctattaagcctagtagaaccttccaaaaaaaaaaaa

SEQ ID NO: 544480 - DNA, 997 bp, Homo sapiens
ggttcgcagcccctgaatcctatgaggaacgtgagatctctgttgttagtgaagatcgatggatagagcagcttttggtggtggcagagaattcagaagtgcaaccacccgagtctcgcagcaaggaatacagaaggcgaaatattaggaagaagactgctttggcttatcttgttggaagtacgtcggcgatttggctacagatgacccaccagaccgtcacaggtcacttgatagagttggttgtgcacgttatatcatcgtttgcctagatgttttcctgaatctgcaagtgacgctatcaaatttgttctccgagatgcgatgcatgagatggaagacaagtgattgagaccaaaggccgggcggcactcgccagggttggatgtgctcagttgtagtttgaagacatcacatgtggctgcgtatttccagaccttcgcgacttctggcacccagtggtgacccctgccctcgtgtgcctcagtcagttgctcaccagagtgccccatcctgtccctccaggacgtggtgaaggggcctagttcgtgtgctgcctgtttcctggatgtatgtggctttgtccccagaggtttactacctgagctatattcaattttcttcttgggattcgttgtagcatagacaacgtccaaatgaaacgctgagccgaaggtttccacgtctggtgcaccctttcagagcgcttgggaagaactcggaactgctcgtggtgtcctgcgtagagaggatgtcgggcacgtgggcagcatgaggacgcctctccctccggtgtgcgagtcagactgagggccccaaattcgacaagagggcaaatcacattccgacttgtcctgcctgggtgtgggcctggccctgctgaaggcgcttggtgctcactgtacgggtccctgccatccttccaaagccattcatgggggctctcgaacccttcctccaggatcacctggcggattgcagcaccgaaggaattcca

SEQ ID NO: 544481 - DNA, 159 bp, Homo sapiens
tcagggtgcaggtgttcagagctgcaagcaggcgggggatctaagcccagtggggacatgcgaacgtaaacagtgcgccaaagggaccgtgttgctgtctttgcccccagagcgagtgagtaacaccatcctgcaacattgtttgtgcggggcccaaga

SEQ ID NO: 544482 - DNA, 362 bp, Homo sapiens
ttttttttttttaccaagttcataattttattatactctgaatagagatgatatttaaggagcagagaaaaatgctaaaacaaagaatttaaagaaaatccattaacaaacgggaaaaatccttaacagaaccaaaaaagtaaaaatttgccttaccagggcggagaggcgttaccagggaattggtgctgagaataaatgcccaggggcttttaacatggccatagcttaacactggaggaatacaacaatacgttcttttactgagtagttagtaggaccctggctaaaacatgcgttgggcacagttcgtgaactctccgcatttactccccagggcagtacggtgctgtccagcggga

SEQ ID NO: 544483 - DNA, 1117 bp, Homo sapiens
gatgttacgttgttatgagcggtatagtaggtgagtgtttagggaatgttgggtggatgttgggtatatctagtgtaagggtggatgcttaggggtgataagggttaaatgttggtgagaggtatgactagggatatgatggatgaaaaacttttagggcgagttgtgtcgtgtatggattgtgataggtgatgtgttgatgggtgattgggggaattgttaaagggggtatcgataggggcaaggaatctgggggtgaggttttggtggaggtagtctgggccaatgtgtgtgtcgtgtgaaggagtgggtaagatggtggtgaagcgcgcgtcagtttatagggggaactgtgtgaggttaatcttacttgtgaagtaagggtaggagagtgtacacagtgaggtgaatctggtagagggagagatccgatgagctgaattcgaggtggtagcagaagaattgctggcaatgtgcggcttatcgtgagaggtgagtagtgtagcagtctggtcgcatagtcaacaaagaagcggaaggatcccacttttggagaattttgttgagttagctggtagtcgaccctacattggtatctacctgggaactacttgactggaatcaacacgttcgtgctagcgtcagtgacaggctggtgagttgctttaaagtgcatgatgcgaagtaggtcacaatcgtacttggtgacctagtacatcggatggtctgccagaagcagagttagaccgaatacaataaacagtgcacagtttgctactttcgatactttagccacggtccagtggattgcttctcaaagcagacgtcttcgtggcaagcacctcactgtgctctctgaaagagcctgaggccgggctgtggtggctcagcgcctgtaatcccatgcactgttggcgaggccaacggctgcggcagatcatggatggtcacggagactcgagaccattctggccaacatagtgaaaccccatctctactaaaaatacaaaaaattagccgggcgtggtggcgtgtgccctgtagtcccagctagcttgggagggctgaggtcaggagaactcgcttgaacctgagaagttaaggtagcagtgagctg

SEQ ID NO: 544484 - DNA, 796 bp, Homo sapiens
gtgatagagcaaagcatcaaagaatctttaaggaaggttttaaaaaaaaaaaaaaaaaaaaaaatgggttgcctctgccttggggaccctgagtccagaatgggtccacaatggtgatttctatgggtggatgtcatctcacctagacaaccagaggctgggctttggagggctaacctccaacacagcggcttctccagatgcctcagtaaggcatccagtatgtcactctggtgttccctttaaagagcaatcctgggaaaaagcaggacgggagggttggcttggctggtcggttggggacattggcaattcttagaccgggcagcaggcggctcgcttgacaagtttgggagggaaactttgaagatctggggtttttcaaattgggaatcggtctacagtgggggtaagaaaacgctgggtctgggagttcgctgaatgttggcttaaatgggtgccctggtggacctggggctcgactggacatctaacaattttggaaacccctggataggaacaacaccacaacacacaccaaacaccacaacaccaccagccacccagcactaccacaaccagcgaacaaaaaactgacaaacagaaacaaacacacagttggtgggcggcgccgcggcgccccccaaggaaagaagtcttccaaaacacacccgagagggggggacggggccccccaagtgaggttaccagagccaggctcgacaacgaggcctccagcagaaaaaaactgcggccgcaaacagccggggggggggcctccccacaaaggaaaagg

SEQ ID NO: 544485 - DNA, 386 bp, Homo sapiens
gggggcccacccaattaatttgggttggccccccctttgggcccccccgggtttcccctttttgcttccgggttgttttttggggggaattggggggggatacccttttcccccggggaaccggtttgccatgtttgggatttttttcgccccccctttagggattttggccccccgggccaaaattttggcccggggggggagggtgggggccctgttggtttaattttttgggggtgttcccccaggggggggggggcccccccctgccccccccccttggtttttttcccctttttttatttttttttttttccgccccggttttgggccccttccttctttttggcccccggggcaaatttaagggggcggtttaattccta

SEQ ID NO: 544486 - DNA, 102 bp, Homo sapiens
tgtgaggtattcatcagaatcaatatcttcccaatcgtctccatccaggtcctcttcctccttaccgctgtcatcctcctcatctgaacccacatcttcgat

SEQ ID NO: 544487 - DNA, 106 bp, Homo sapiens
gatgcatataattcatatcttgaagattatgctttgattttaaaatattttgcttcaaataagggattcgacagtagtgaagatgcaaaacaatataatcttgata

SEQ ID NO: 544488 - DNA, 191 bp, Homo sapiens
ggtatcaagtggtagtcaagaatgttacaataggatgaatctgtacgtatacccgcgaatggtatagggcgaaagtggctcgtatcaaagaactactccccgactgtggtatcagtgacagagtatcatcggcagtgtataggtacgtgagcacagaggaagatcatccaagagacactcaggcatcatgc

SEQ ID NO: 544489 - DNA, 442 bp, Homo sapiens
  misc_feature (71)..(71): n is a, c, g, or t
  misc_feature (207)..(207): n is a, c, g, or t
agtcggcccagaaagggttccagcaaagacgacagaagctgctccagccaaaatgattttcccaaaagganaactgagtctcaacctgacagagcttccagatccagctaccgattctgaacacaccaggacggagggtactaagagctttagtttgggaagatggaaagttctggagatggatggtggtggtgatcgcacaacccnatgaatgcgctaatgccgctgaactgtgcacttaaagatggttaccgtggtcaactgtattagttacgtgtattttatcacaatttaaaaaaaaaaactttaaaagaagtagtgcaagcaaagccagaccaagaaactgtagctgagcccaggcctctccaacgtgagcctcgggaggaaactggagagggggagtttgggggagagagtggcgaagaagctgagggcggccgct

SEQ ID NO: 544490 - DNA, 473 bp, Homo sapiens
  misc_feature (78)..(78): n is a, c, g, or t
  misc_feature (195)..(195): n is a, c, g, or t
ggaggatgctggtagcagatgagttgggagtggattgcatggtgcaaccagagagccagatatatggagtgatcactnatttcagactgatccagatttgccgcctggctggaaaagagtcagtgacattgccgggacctattattggcacatcccaacaggaacgactcagtgggaacggcccgtctccatccnagcagatctccagggttctaggaaagggtcacttagttctgtaacgccatctcccaccccagagaacgaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcacccccaaaa

SEQ ID NO: 544491 - DNA, 1725 bp, Homo sapiens
  misc_feature (213)..(213): n is a, c, g, or t
  misc_feature (319)..(319): n is a, c, g, or t
  misc_feature (346)..(346): n is a, c, g, or t
  misc_feature (756)..(756): n is a, c, g, or t
tatactaacagcacttacttacgtattcatacacacacggggacagactacggtacggacgtacgcggtggtaccacgggccactagacgtgtggggacggacacgtgggggtgggttgtgtggtatgtgttccacacaccgtggccactttctactttttaaccggtgtggttacacacataccgtggggacgatacggtggtgacatggangggtggaggatacacacatctacgggcgtatacgggtaccacacgtctcacagcgggttctcacgggcgcgggggtgacgtgggtggcgctctactgtgcacgtgnggtgcgcgagacagtgacgtgacgcgncactctgtgtgggtgtttgtgtgggtgacaacttctcttctgcgcaccatacacgtggcccccacttgtgtggggccacacacacacacgccccgggtgtctcagagccgggggaggcggcgcagaggccctctccctctgcaagggggagacagcagagacagaggcgggtgagagagtggggcaccaattatcaggaggggggggtgtgtcaacagactcacagtgtgtcatcacgactgtgtggtgttccccacaaggggggtgtgccgacacaaccacatcacgaggtcaacgacatcacggggcgcctcccgggtggggggcggcccgcgtgggcgagggtttcacaacgacgttgtggtgcaacgccatcaacgacgatcaggccgccaacaacgtcgccgcgnggcacaacgaccaccagagcgtttcaacgcggcaaccatcaccatttctcttaaccaccatctcatgtgttatcaccacatttttctcaccaccaccacatgtgtggggttcccaacgtcggtcttaccacggcggggattgttgtaataccgccggcggtgtaaacccaaacaccctcggggggcattatctttataatcattctaccacattctcccatcaatgtcggtggtggcggggataacacctcggggagccggggagacggcatatcgttggctccatcacagcgacaaccatcttgtgggggcggccgaataaaaccgcgttgggggggggcgtttctgggggggggagttattacaacaagtccccccaacccctcctcacaagacggtcgtggtgccgcggtgggcataaagtaggacccggggcacacctaacaccaggaaccgtgtgggacagcaccagcaacgtgttcgaacccgcggcaacacacaccagagggggcgcactaactacacgcggcagttatcacaccgcggagggacgaggcggcaacgcacaccaaccttcgtggggggagacaacacactcacctacagaccttgtgggagccaccaaccccgggggggggggcgcacaaaacagatcatttgtgggttcccattgtgtgtgtgacacgacacaaacccaacatccgcccacgtggccccccggtcgcatattgtgttcccaccaaaggggggggggtgtgcccccctgtggagggggcaccacccctcctctgtgggggacaccctccacaacaacgtttcgcaacaacgggggggggccacaccactcctctacaagttgtaacagactggggggacaacaagcggcccaactatatacgaacactccaattccacactagggatacacagccactatatgaacgggagggcaaccaaccattgggagtg

SEQ ID NO: 544492 - DNA, 470 bp, Homo sapiens
  misc_feature (75)..(75): n is a, c, g, or t
  misc_feature (192)..(192): n is a, c, g, or t
atttaaattgatggttcaggggaataggtgacgcggcaaccgcaccagctacaggtaatccgggagtgatcactnatttcagactgatccagatttgccgcctggctggaaaagagtcagtgacattgccgggacctattattggcacatcccaacaggaacgactcagtgggaacggcccgtctccatccnagcagatctccagggttctaggaaagggtcacttagttctgtaacgccatctcccaccccagagaacgaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcacccccaaaa

SEQ ID NO: 544493 - DNA, 139 bp, Homo sapiens
ttcatactcctctattaactcataatctgtctaagcttcataaataactacttgtaagctttaaattagatagttgagactttatggaggcgtgtggctttaatttgagagactgtcatgaactcccaaagggggtccg

SEQ ID NO: 544494 - DNA, 891 bp, Homo sapiens
  misc_feature (36)..(36): n is a, c, g, or t
  misc_feature (69)..(69): n is a, c, g, or t
  misc_feature (89)..(89): n is a, c, g, or t
  misc_feature (91)..(91): n is a, c, g, or t
  misc_feature (98)..(98): n is a, c, g, or t
  misc_feature (113)..(113): n is a, c, g, or t
  misc_feature (117)..(117): n is a, c, g, or t
  misc_feature (125)..(125): n is a, c, g, or t
  misc_feature (139)..(139): n is a, c, g, or t
  misc_feature (169)..(169): n is a, c, g, or t
  misc_feature (186)..(186): n is a, c, g, or t
  misc_feature (189)..(189): n is a, c, g, or t
  misc_feature (198)..(198): n is a, c, g, or t
  misc_feature (215)..(215): n is a, c, g, or t
  misc_feature (221)..(221): n is a, c, g, or t
  misc_feature (224)..(224): n is a, c, g, or t
  misc_feature (227)..(227): n is a, c, g, or t
  misc_feature (248)..(248): n is a, c, g, or t
  misc_feature (271)..(271): n is a, c, g, or t
  misc_feature (319)..(319): n is a, c, g, or t
  misc_feature (329)..(329): n is a, c, g, or t
  misc_feature (336)..(336): n is a, c, g, or t
  misc_feature (359)..(359): n is a, c, g, or t
  misc_feature (376)..(376): n is a, c, g, or t
  misc_feature (386)..(386): n is a, c, g, or t
  misc_feature (449)..(449): n is a, c, g, or t
  misc_feature (496)..(496): n is a, c, g, or t
  misc_feature (601)..(601): n is a, c, g, or t
  misc_feature (651)..(651): n is a, c, g, or t
  misc_feature (668)..(668): n is a, c, g, or t
  misc_feature (678)..(678): n is a, c, g, or t
  misc_feature (683)..(684): n is a, c, g, or t
  misc_feature (688)..(688): n is a, c, g, or t
  misc_feature (737)..(737): n is a, c, g, or t
  misc_feature (778)..(778): n is a, c, g, or t
  misc_feature (784)..(784): n is a, c, g, or t
  misc_feature (799)..(799): n is a, c, g, or t
  misc_feature (864)..(864): n is a, c, g, or t
ggcagcggcgtctgcgcgcggcataacgacccaggncgcggcgcggcggggcttgagcgcgtggccggngccgcagagccgagcatggngngccaggntgccgtgcgcatgcncaanaccctgcngaccaatgccggcnacctggagcaggtgaagcgccagcgcgggngaccctcagacacagtnggnagccatggnactgtacctggcacggnggggcngcnggnggaggacttggaccggctgancatcatccacgtcactgggacgnaggggaagggctccacctgtgccttcacggaatgtatcctccgaagcnatggcctgangacgggnttctttagctctccccacctggngcaggttcgggtgcggntccgcatcantgggcagcccatcagtcctgagctcttcaccaagtgcttctggcgcctcttccaccggctggnggagaccaaggatggcagcggtgtctccatgcccccctacttccgcntcctgacactcatggccttccacgtcttcctcctagagaaggtggacctggcagtggtggaggtgggcattggcggggcttatgactgcaccaacatcatcaggnagcctgttgtgtgcggagtctcctctcttggcatcgaccacaccagcctnctgggggatatggtggngaagatcgcntggcnnaaanggggcatcttttagctaggtgtccctgccttcactgtgctccaacctgnaggtcccctggcagtgctgagggaccgagcccagcagatcncatgtnctctatacctgtgtncgatgctggaggcctcgaggaaggggggcgccgctgacctgggctggaggggagcacagcggtcnaagcgcttggcttgcagcggccactgc

SEQ ID NO: 544495 - DNA, 100 bp, Homo sapiens
tcaaagaaacgttgtgtttaatggtaaagcttaacacacccctgcacctaaaatggggtggagtttctctttcaacaggccggtgaccccccatggagcc

SEQ ID NO: 544496 - DNA, 443 bp, Homo sapiens
agtttcttctcctaaatctgagaggtgacttgtttccagtggccaagacatcaccaaaagcaaccatttgattgtgcacaccaggaaaaaaagtggacttgaggaggcgaatgatagggaacacccactaatttatgttaaagtcaaaacattttaggccaggcgtggtggctcatgcctgtaatcccagcactttgggaggccaaggcaggtggatcacctgaggccaggtattcgagatcagcctggccaacatggtgaaaccgtgtctatactaaaaacacacaaaaaaattagccaggcatggtggcggacgcctataatcccagctactcgagaggctgaggcaggagaattgcttgaaccaaggaggcagaggttgcagtgagccaagaccacgccaacgcactccagcctgggcaacgagagtgaaactccatctc

SEQ ID NO: 544497 - DNA, 141 bp, Homo sapiens
cctctccaactggtctctctctctctccacactggctctctctctctctccacactggctctgggactgtgttgacttcagtcagcacatgatgttactgatgcatttggagctgtgtcaacgaacccagtgtggagagag

SEQ ID NO: 544498 - DNA, 1540 bp, Homo sapiens
  misc_feature (164)..(164): n is a, c, g, or t
  misc_feature (335)..(335): n is a, c, g, or t
  misc_feature (500)..(500): n is a, c, g, or t
  misc_feature (561)..(561): n is a, c, g, or t
  misc_feature (572)..(572): n is a, c, g, or t
  misc_feature (596)..(596): n is a, c, g, or t
  misc_feature (613)..(613): n is a, c, g, or t
  misc_feature (867)..(867): n is a, c, g, or t
  misc_feature (884)..(884): n is a, c, g, or t
  misc_feature (957)..(957): n is a, c, g, or t
  misc_feature (978)..(978): n is a, c, g, or t
  misc_feature (1005)..(1005): n is a, c, g, or t
  misc_feature (1016)..(1016): n is a, c, g, or t
  misc_feature (1154)..(1154): n is a, c, g, or t
  misc_feature (1206)..(1206): n is a, c, g, or t
  misc_feature (1389)..(1389): n is a, c, g, or t
ggtgtgtgatctaggtagatctgctagtagtgctcgagtgtcgctttttaagggtacgtcaccgggctggcagtagcaatacgtacgctatggttatagaaaaatatttacgccgagcgtagagggagattatgtgtgcgtagtaacgagaggactgcacactnctgagcacacactctacgactcacaccgcagcacttcaatgcacatcgcttacgctctccacaccaacgcttctaccctagcccacccacacagaactcctcctcgctgactattatatactatgttaatttgttgttacgactgatgctcagtatatacgagacactgcntcgctacaatcgcattactatatggctgtattaatcctgaatgtatggctacagtactcgcgatgtattagcatgttggatgcgcgtttcgtgttgtgcccgaacatgcagtggcgcccgtattagtacagactgctctgaactacaccacgtatctgatgatgntgttcaccacttattcgctgtatgtgccacgcaccgctcattctgcgtgactctaattcanatatcacatancaaatatgcttgttcacacctcanagtcatacgacacacanaccagtactaactaagaatagacacactatgtacacaggcaacgatcatcacgcccgacgctatatagtgtgttcgaataaatgaccctgctcgacgcgtgcgcgtcactctataccgaatcttcaccacctatcgtccgattgtcactacgtataacatttctcagtatgtcatatcactatgcaaaccgccaggtccggacaacgtctcctcacctgaacgcgagctcggcgtgatggcatagacatgactntgagactacagagtcancacgatcatctcggagaccagtgtgactctgatttctcacctctatacacagtgcggaaggagatgcggtagnatagcagtgtgcgactatccnccacgaattttcatgatccgtctagtncgtgccgttantactccacatcatctccgatctatcatctagacactctcgtgacgattctaatacatacatgtatactgtcgtaagagacacatatatctgctgctgtgatgtgtcgcactctcgcggatcgctggctatgatacacnccatctctagcgtctcgactagtgcctaccgcgagatgtcggcacgtgatangtgacaggcgcgactggtccactagctcattgctgcgctctccatgtcgcgcgcgagtcacgagcgctatcgtcgacacactgagactgtctccgcgtgtaagtgagcacacagataatctattggatagagacatctatgatcgaccgctagactatcgcagttaatgagcgtcatctcacngacgacacaagtcagcaagacagtaccgagcccactgaattgcaccgcatgtatactacgttaccgccgcgcatcgtgacgcatagtatgttagacggcttcaatgcgtatagacagtcgatggatccgcgcgctctaatgaactacgagt

SEQ ID NO: 544499 - DNA, 192 bp, Homo sapiens
ctgttacccccaagctctgcattttgttgagctcttcttagtgctcagtattgcactggattctctgcagtgatagtcagactggtgtccctctttcctttctgaagctgcaggacctgtatgcatagcccttgcatcttgatgactaagtttttttttttttggggaccacggggttgtgctgtggtcccc

SEQ ID NO: 544500 - DNA, 299 bp, Homo sapiens
catgatgaacgaatgaatgaatgaatcaacccgagtgcatcgaatggaatcgaatggaatggaatgcaatggaatggatcaacttgaatggaaaggaaagagtggaatcaacacgagtggaatggcatggattggaatggaatggaatggaatcaacccgagtacaggcgaatggaatggaatgaaaagcaatggaatggaatcatcactaatggaatggaaaggaatggaaaggactggaatggaatggaatggaatggaatggaatggaatcaactccattgcaacacggtctctca

SEQ ID NO: 544501 - DNA, 125 bp, Homo sapiens
aatcagtagcaccttttcccattcatttgtgagccaggcagggtacggattagtgtcccctttgacaaatgacagaactgagggctgcaatggggaaatgacttataaagtcacccagcaggtca

SEQ ID NO: 544502 - DNA, 686 bp, Homo sapiens
cgttatttgtgtatcgccccccttttgggcgcgttacttctgcgccctccggtcggacggtggtccccggagctccttggcgcggggaacccgccccctatccttcgtggggtgccacccactatatgccggagggtactcccgttgcccggtccccgcctctatttctccgcgggttttttcgccccttatcccgcctcctgtgggctccccgttgcctattacaagagcacggttctccccctatgagaggccgcccacgaaactggggaacacctcaccccccgaaatttcatactggttggctggtcgcccattacacctcccccactattgggccccttcaattcttgttgggggacaaatacaagatgccccggttgctcgtcgcgctaaatcgcccgctccctgtgggggtttattcacaccacatcaactgtacaagagctgtttgtgagaattcgcgccgcgccgtttgttgttctacaagcaaaaggtggtcgcacgagcccgtggagcgcttttctaaagacctgtgatgtattgttttgtccacccccggggcggcccgatgggccgcggagtatgggaagaacgtggcctctcgcaagagtgtctttgtactcgccatgaccccccaaggttcgttgttttgagaaagaaacaatcgcatcatagaacgagac

SEQ ID NO: 544503 - DNA, 770 bp, Homo sapiens
  misc_feature (435)..(435): n is a, c, g, or t
ttggatagcagtgaagaattgaaagcagctcctaaagattgggtggttggtttgaaaatgtttacacttattcactctaagcacgtggaccattttgatatcagggcctatacattagaacaaaaccagaaatatttctaaatctcaaagaatttataagtacaggtacctctgggctgaaaactcggttaaacaatctttgggatattttttcctttataatctttatggtaattatttctggtaattaaggtggtacattaagggttatttggctacttaacaaggcctaaagggtataggctggtatatatgaatggtggctctggggtttttctggtttcctggcttgggtttggtttctgggtatgaactaaggtctaactttttaatttaaagggaattttggtggtagaattatatctctctactaancttggtacaatagggataaggttatgcagaaattttttgggtatatagaatttggttatatataatggacttttagaattttatttggaaaaagcctactgggaaaggcagtaaatagaacctatagtggatatatatatgatacatagcatatatacttttttctgagaaatggtttatatattattggtcacagaattttgggaggtctttcttaccttatatccattcgggaaacataccttccaattgatttccctaagggtggagaactttattttccaaatggtggactagatcatgttggatccggggtctaggactccgtactttgg

SEQ ID NO: 544504 - DNA, 1066 bp, Homo sapiens
tactgttctatatcatgtactgtggctgacattacaaaaagggtctgggaagggaaaccgtgtcactggttttatcttttttctttaaaatacaaaagtttcccaactaatcatttattatggtcagctggttttacatgtcccctatcatgagaaatgctatcaacatctggggatttctaaagagtcttaccaaattggttactttaattctggtggtcctggctgagtgggtttttcttttaaaataccatttttatcaccctgtgggcactggggtgtgttactggggattaccctggatgattctgagctggggcttcttcaagtagctcagttctggcgtttaatattaaggtacacagtttggtggatgctttggggcattcttggtcatctcttctgagtttcgaatctgtcataaataaactttttcactatgcacctggtaaaaaaaaaaaaacaaaaaaaaaaaaaaaaaaaaaaaaaaaaaaaaaaaaaaaaaaacatacacaaaacacaaacaaggagacaaagagaaaaaaatatagcagaaagaggcaaacaacagaaaacagacaagtgagatagatacaactcaggaaggtgggatgttgttcccaatgacagttgagaaatagggacaacagagaaaaaatagaaagagagaacacaaagagcgaggtgacacaaaacagagaaaaaaaaagaacaaacctaccagctccggacaacaaaaaacaaatgagagacagaggatgagacaccacccacacagaaaacaagaggaaaacacaaagaaacaggaaaagagtcaacgcagagagacgcgggaagggaaaggaagaagggacgtaggtacagcaacgaaaagagcgagagggagtgaaacgaagcaggagaaagcagatcaggacggaacgaaaggcgggggggggcgagagcgggaggaaggaggaaaggagggagcgagggcgggagagggcgagcgcactaacgagaaggaggagatgaagagcaagagatagatacactgagatgagggtgcgatgtgttatgagcaacc

SEQ ID NO: 544505 - DNA, 308 bp, Homo sapiens
aaagcccccccctttttttttaaggagaatggcccagtcctttcccaagtccacacaggggaggggaaagcattggttttgggtaaattatgtaaagcaaaatttttttaattttcgccctaaaacttttttattttgttttattttgaaagaagagcctttgggcccccccttcccccttttttgtcccccaacttgaaaagtatgaagggttttggtttccctgggaggggggggaggcagccaggggttacctgtacactgacttgagaccaagttgaataaaaaggggcccccttaaaaatgga

SEQ ID NO: 544506 - DNA, 846 bp, Homo sapiens
  misc_feature (251)..(251): n is a, c, g, or t
  misc_feature (484)..(484): n is a, c, g, or t
tgggtacttcaggatagcaaatttctttctgctattaaatgtggtaaatgtgacccagggtgtttttttttgtgggttttttttttggagaacagagttcctcactgtggttgcccgggcgtggagtgtgcaggggtgtgcacactccttcggcctcactgtgaagagcctcgtgttccccgggtttcacgcctttctcgtgtggctctcagcctctcccagagttactgtgggcactacgggcacccgcncacaagagagtgtgcccgtgggcctataaattttgggggaattttttagagttaagaagacacgaggggttttctccaccaatgtgtgtggtagccccgaggggagttggtgtcctcaaaactctctccgtgacaccttttgtttgaaacacccacaccagcgtttcttgcgggccctctccccccacagaggtgtggcgggcggaagtcacacggggcggtgtgtgaagccnaccaaacgcttgtggggccccatgttgaaacaccaagtgtgtgtttttttcagagggggaaacacaaaaacatcttattatctttgtaagatactcatactcggaaagtattatttattcatctaacgcctttatttgtggggtatttttttacagaggatatttacttcgtgcgagttgacatgtctggtgagatcttcttgagaatatgtttttgtagcacctattgttttctgtgttataaatattcacggtggtggacacgcctcaaggtttattggggggtatgagatgttcgaaaagtatatctccaagggggggcgtgtcaaaatagtgggggtccaattttggggtaaatttaa

SEQ ID NO: 544507 - DNA, 699 bp, Homo sapiens
atttcattctcacttattttccatttggtcaactgatttgatattacaacaacaaaaaaaaaacattctcagcttgtgtttctggacagtttagacttattcctaatgaggaacaccaattaccttctgtgtttagcacctttatgtgcttaacagtggcagggagtcctagttggtgtctacagtgcatttctagatcatgggggattccaaccactgcgaaatttattcatgcagcaaagagactcacaagtcataagtatttgtggggaggaagagaactaattctttatttcacaaaattgtatatccacatcctatttgtaaaggaagaaagagaataaactaactataaattatcagttctgttaaatggttgaaattagaatcatgattttagagaggctaagcttctattcagaatccagagtgagactattgacaaacatacaaaataatttcactgataaaatgaaacgtagctgaggataaagctagattttgtttttcaagggtttcctgagtatatccaaataatgaagtacaatgttttttcttgtcgaaggtatagtagaaaatggccatgattattctgatattatctagttataccataaacttcccgagagaggaccaaaactagaggagggaaacagcaaatcttcctcgaaaacaatatagaagctaccaggttatcct

SEQ ID NO: 544508 - DNA, 233 bp, Homo sapiens
  misc_feature (80)..(80): n is a, c, g, or t
  misc_feature (101)..(101): n is a, c, g, or t
  misc_feature (166)..(166): n is a, c, g, or t
  misc_feature (197)..(197): n is a, c, g, or t
  misc_feature (209)..(209): n is a, c, g, or t
cttggaatccatggcacagccgggtccctctgcagttcctggggaagctggcattttgctcctcactccgggcggctttnttccacacgaccactgatttnccaagtccccttaagtggggtgcttgcctctcacaggtgttcccaacatggcagctttgtctttnttacttcattttatgcacgcagctcgtattncccacagccctncccgcctgtagattcggcagcctt

SEQ ID NO: 544509 - DNA, 419 bp, Homo sapiens
ggccaaaatggtgaaaccctgtttctactaaaaatacaaacattagctgggcatggtggtgcacacctgtaatcctagctactcaggaggctgaggcacaagaattgcttgaacctgggaggaggaggttgcaagtgagccaagatcacaccacactgcactccagcctgggtgacagagcaagactctgtctcaaaggaaacaaaataaagaaaagaaaagaaaaatatagtggtcttggacgaattcagtgacaggccaaaccattaagtctgtcatcacaagcagaccttagggaactgcaatattatacgtctagtactgacgcagtagagaaccataatgattgcctccccggcaaagaagaaccaacccgtatacgcctgaggttgcaatttctcgaattgatgcaggcagac

SEQ ID NO: 544510 - DNA, 337 bp, Homo sapiens
  misc_feature (59)..(59): n is a, c, g, or t
  misc_feature (110)..(110): n is a, c, g, or t
  misc_feature (160)..(160): n is a, c, g, or t
  misc_feature (299)..(299): n is a, c, g, or t
ctgcttaaagatttagcgacccaacatctaaagtgctggctaaacctacacccaaagcntgaaacttacaaccaaaggccctgctctcaccactcccaaggagcccacgnccaccaactcccaaggagcctgcatctaccacacccaaagagcccacacntaccaccatcaagtctgcacccaccacccccaaggagcctgcacccaccaccaccaagtctgcacccaccactcccaaggagcctgcacccaccactcccaaggagcctgcacccaccaccaccaagtctgcacccacngactcccaaggagcctgcacccaccgagccctatgcag

SEQ ID NO: 544511 - DNA, 310 bp, Homo sapiens
  misc_feature (93)..(93): n is a, c, g, or t
  misc_feature (96)..(96): n is a, c, g, or t
  misc_feature (102)..(102): n is a, c, g, or t
ggggacccttttgggttttgcactttccatcctctcccccttccattggcaatcccacgggttgtcccctgcattttggaaggcacagggggntgncccctnctggtctcccccccccccaatatggacatgtagtatggcctcacaaggtgcccgtccggtcccaggtcccttgtcccttccacagaggccttcctagaagatgcatttagagggtcagccttatcagtgtttaagattttttttttatttttaatttttttgagacagaatttccctttccagcctggacgtcagaccaagactctca

SEQ ID NO: 544512 - DNA, 301 bp, Homo sapiens
catagctgtatgatggttccagtggctgcggagaaaatgagaatgggaaatgatgtttcatgggggatagagtttcagtttgcaagataaaaaagtttgtggatggatggtgatgatggttgtgcaacagtataaatgtgctttatgccactgaactgaacacttaaacttggttaacatgggggccaggcatggtggttcacacctgtcatcccagcacttgaggaggcctaggcaggagaattgtctgagcccaggaattcaagactagcctgggcaacatggtgagaccccctctatt

SEQ ID NO: 544513 - DNA, 393 bp, Homo sapiens
  misc_feature (25)..(25): n is a, c, g, or t
  misc_feature (35)..(36): n is a, c, g, or t
  misc_feature (45)..(45): n is a, c, g, or t
tcggcacgaggctgatcttgtctgnctgtgccttnncctctcttnggggtctctgcatacctccttctcctgctctcctcttcagagcaccccccctagtgtcacaacttctgtgatgcctctccccggatgaactcagcactttccaggggctgttcctgtggcagagccatacagtggaggcatccctgctagaatcggtcacggagccttacacacaggaaaggcttgcgcagattatcagtaacctagtcatgtcttggctccctgatatgttctagttggttgacatagctagtgtcctcagctgactggagaggtaggggtgcacatctcaacaaaaggggttccctttccttactctgcagctgttcatttatattgctcctgcca

SEQ ID NO: 544514 - DNA, 872 bp, Homo sapiens
gctgtcgttaacatcagcttacttcgaccccgccggcaggaggagaccccagttctagtaccagaacacctattctgattttgcggtcaccctgaagttgtatattcttatcctaccaggcttcggaagtaatctgcccatattgtaacttactactgccggaacaaaaagaaccattctggatacactaggctagtgggtctgacgactatgcatagtcaacttggcctttccgtagggtttactcgtgtgagctacaccactatagtttacagatagggaagtagacgttagacacacgagcagtatgtgtcaacctccgtcagccactaaatcatcgcttagtccccagccggcggtcaaagtactgttagcctgagctcgccacactccacggaaaggcaatatcgaaactgatctgctgcagtgcctcctgacgcccgtaaggattcacttctatctcttctgcaccgtagagtgagcctgacgtgggcaatttgtgtagttacgcaaaactcatcggcttagacattcgggactagaacggagcgactgtacgtaccgtgtgtagtctcacttccactagtgtcgctaatcaattaggggctgtatgtgcgcatcagtaggagggctctcagtgcacgcgtggagtttcccctattctcgggctcacacccttagaccagaaggctacgccagaaatccatttcgctatcatattcatcggcgtaaatctaagcttgtcttcccacaacactttctcggcttatccggaatgccccgacgttactcggacttaccccgaatgcatacaacacattgaaatatcctatcatctggtaggcgtcaatcatttctctaaccagcagtaa

SEQ ID NO: 544515 - DNA, 177 bp, Homo sapiens
ttgggaatattaacacaaattccttccccttgaatagaaatggtctgtcatattagcaatcttgctgtgtcagccttgctattgttaaacacaacacatgatgggaagatcaatatactctttagaatttgtccagtgaggaatcctttgacgtggggatgcagagctgcgcctgaa

SEQ ID NO: 544516 - DNA, 541 bp, Homo sapiens
cttggagtgcagtgcactccagcctgggcaacagagagtgaaacttcgtctcaaaaaaaaaaaaaaaaattatgtagggcgggggcgtaagggctcatgcctgtaatcccaccattttgagagggctagggcaggaggattgcttgaagggcaggaggattgcttgacggcgggatttgaaaacacgcctcggcaacacagtgacaccttatctctacaaaaagataaaaaatgcgccgagggtggtgggcgcatgcctctagtcccagctactccaggaggctgaggcaagaggatcacttcagcccaggaattggaggttccagtgagctaggaccgcacacatgccactcaaagcctgcgcaactgagggaaactccatctcaaaaacaaaaacaaacaagagaacccccaatgtcatccaaaatcattctaacagcaatccagtttctttcccagtcccttcccatcagacacgggtggctcatttgtatcacccaaacacacatggggctgtcgcgcttattcactaacccgatac

SEQ ID NO: 544517 - DNA, 362 bp, Homo sapiens
ctcccatcaggtcatgtgaacttacagttacacaaatcagaaacaaatggtacatccaaaaccatatacggaaatatcatgatgcccagatgatgaagactggggtgaattaagtccacacatttatttcaagttgttaaagagtttgtgggccacgcaatgatccctcgcatgcaagaagtcaaagagctcctccgtgcaatcctcttctgtatgtgatcgagaggatacgcgctcatcacagagctctagccgctcccgggcctttacacatttctccaactgctcgcattgctcactcactgttgttaggggatccactaattcctcctcttcctcttcctcctcctcaggatctccgg

SEQ ID NO: 544518 - DNA, 336 bp, Homo sapiens
ctatgctatcactccaggcatttagcacataaggctacagtaatagcttcatctcttcacaacatgacaggcacacgtcttcatgcacaggcacgttaagagaccagagggtggtcacaagatgatgtttctcctgaaacagtggctactcccactggctgaaaatagaaaggctagagcaagacggccaaacagagccctccagcgcttgtctccatgcaggaccaccaaactgaacaactgtaccccaaaaggaaagcacctttaggccggatgcggtggctcacgtcagtaatcccagaactttgggaggctaacattgggcaaatcacttga

SEQ ID NO: 544519 - DNA, 1132 bp, Homo sapiens
ctagttctagatcgcgacggccgccctttttgttgtcttcatcttctagagcttcatctttctctagtatgaacatcctacatactgggaagtaaaatatgagttgctacaggacgaggaggacatcttgatatagacagcacgaataggggagcaccccaggaacaaaggaaagactgggctacgcgataagagctcgggccctcgcgcggggatacacatagaagaacggagcgcgcctagcaaccagcaagcgcgaggcaagcgacacaccagacggagcgcgcacaagacacataacaaacaacgaccagacgcaccgcagggcaccgcgacacggggaagcgagcgcgaagagcgcggcaccgcacgccagaccacaaaaaaacacgcgcaaacaaccggaccagggaggcaaaatagacaaagaaacaagagaacggaaaaacgaggacagaaacaacaacagacatgaaagaagaagagagagaacagaaaaagccaacacatgagggacccaccaaaacgaagagagagccgaaagaacaacgaacaggagaagaaacaaaaagcaagaggacgaactctacgacacacaagagaggaagaagacgggaacgagacacacgacaagacaaaggacacacacgaagggaaaaaatgagacaggagacagaaaccgaaacacacaggggagcgaggagggcaccgcatcaaaggaagccgcacagccacacagggaaggagaccaagaccacaccacggacaggtgaaaaagcgggcagaaagcccagaagcgtccatacacagcaaggagacgatgaaagcgcgcggacagacggacaacacggaaggaccagggtgcaacgcaaaagcacgacggacacgcgaagacacggagggcgcagaagcacggagatgccaaacgcaaaacgagcagcaggagaagaagaacgtacagacgagaagaactgacatagctcgcacaggggagaagagacgaagaggaagagccagcgcgacgagcaacgacatgcagcgaggaacaagaggcgacagagggagacagagacagagacgacgcagacgagaaacgacgaaggcgagacacgagatagcagagacgtagcat

SEQ ID NO: 544520 - DNA, 382 bp, Homo sapiens
cgtcgacccttcacctagtctttctgatcctagcttcaaattttatggaagattctatctgaagagaataatattgagagtgatagagagtactgggaatcctcttttgacctctatgagtgaggatgtttgtgggtcagtacagacacatgtgcatatatatgtgtacatggacacactatattctcactataaaaataatgaagaaaaataggaacatagagaataacagaggaagatattcaaaaataacctatagcctgcacaaatgtgcacatgtgtgcacatgcacctgtgtgtccatgtgcatgcacacatgtccgtgcacgcgcacgaacgtgcacacacacacacatatatataatcttttttttgtcgacgc

SEQ ID NO: 544521 - DNA, 222 bp, Homo sapiens
  misc_feature (20)..(20): n is a, c, g, or t
  misc_feature (179)..(179): n is a, c, g, or t
agggctcgggatacgtcaanaggattatgaggcaatcagtaaatggcccaacaccatttctggcacaaagtagatactgggaaaacaattccttccctttctttccccaaatgttgaaggtgccagctatttcttccctgcaagtggcttccccgtcccagatagagcatgttcatctncacgcgagagttagataggcatccacaggtcttcgcgcggagg

SEQ ID NO: 544522 - DNA, 1080 bp, Homo sapiens
ctggtgtgcacacgcctgtgtaacacatgcacctgtgggagctgagactgtgaagggatctgcctgatgcccagtgatttttgaacaccatctcctgtgtgcaaacacatgtgagacccctgtatctacaaaacaaatacacattatgccagtgcatgtgctggcatgctgcctggtgtgtcccaagtactcgtggaggtagaggagagaaaaatcacttgatgcccatgagatggtcaatgtgctaccatgtggatgctaatgatctgcatcacttgtactccagctggtgtgtgaaactgtgcgagactcttacctcaaaaataaataaatacatacataattaataaataaaacatcaaagaccagccgacctaactccatctaacaatacacaacttctacgcaaaatataaataaaattagaaaacaaactacacatctcatgaaaacagcactagcaacttagacgacatactaaaggccaaaaataccctcctgacacacagctaactaacagcaacaagtcaactattccagttacaacagaagacaaggaaactggctgtggtggcttatgcctgtaatcccagtgctttgggaaggccaggagtctgagaccaggatggacagccatagcaagaccccatctctacacaggacaccacacaagaatcaggcaggcatggatggagtggacgctggaaaaccaaactaactcgcggcgctgacagaggaaggaatcgctgagaccaggcaggccgagggccaggcacgaagctaatacctgtaggccactggccaaccaaacctggagcgacatgacgacagaccccaggccacgacaagaacagcagcaggtcaaccagccaagaaacaagcataccgtaatgtgactggcacacacggtcggcaccacacctgagtcaacccaaaacacatgtggaggcccatactgcctggtacactacaatccctagaatcacacaccccggtccgacggtgtgacaacgtcgctactatagataaaacaatcgattaccgtgctcagcccacctgccatgtgccacggtcttcttc

SEQ ID NO: 544523 - DNA, 627 bp, Homo sapiens
atggtacccactattctgttcagggacatcaggaaccagagctgtagtacatcaagctactgccacccatgaggagtcttaacgacagtcctcgatcgagcacgttatagattactaggactattcaacacatcttggttaaaaaaaaattgaatgaccccttttgagggggtttagggtgaactgttgactcgtgaaatggactttgatttaccttctagaacctgtaaccccataacactattgtctagctaacactgaggccctgccctgcctgtattgctctctctgcctagtccagtcctgggcacctcaccctgagcccctgggaacctggaggactgctcctcagacctcctggaagctccttcagccagtgagcctctcactgcaccactaggtagggggctgttaggtgcactaactgtgtctgagtgtcctagagtctccctcagtgttttgttgggccagtgtgcggggacactggggcttctggatgtggtgttcggtgggccacaggcaccagcagcgaccctgtggcacaccaggggtgttggttcagatcagtctcccctgagggaggtggcttggcacttcactctagctgctacagaactcaagtgcagg

SEQ ID NO: 544524 - DNA, 235 bp, Homo sapiens
  misc_feature (195)..(195): n is a, c, g, or t
caaagaagtttctgagaatgcttctgtctagattttatatgaagatatcccctttccaacgaatccctctaagctatccaaatatccacctgcagattctacaaaaagagtgtttccaaaatgctgtatcaaaacaaagtttcaactctgttagttgaggacacacatcacaaataagtttctgaggatgcttcngtctagtttttattcgaagatatttcctttctcaccatag

SEQ ID NO: 544525 - DNA, 551 bp, Homo sapiens
  misc_feature (11)..(12): n is a, c, g, or t
  misc_feature (18)..(19): n is a, c, g, or t
  misc_feature (21)..(21): n is a, c, g, or t
  misc_feature (49)..(49): n is a, c, g, or t
  misc_feature (78)..(78): n is a, c, g, or t
  misc_feature (102)..(103): n is a, c, g, or t
  misc_feature (116)..(117): n is a, c, g, or t
  misc_feature (122)..(122): n is a, c, g, or t
  misc_feature (140)..(141): n is a, c, g, or t
  misc_feature (153)..(153): n is a, c, g, or t
  misc_feature (157)..(157): n is a, c, g, or t
  misc_feature (184)..(184): n is a, c, g, or t
  misc_feature (195)..(195): n is a, c, g, or t
  misc_feature (207)..(207): n is a, c, g, or t
  misc_feature (286)..(286): n is a, c, g, or t
  misc_feature (307)..(308): n is a, c, g, or t
  misc_feature (351)..(351): n is a, c, g, or t
  misc_feature (355)..(355): n is a, c, g, or t
  misc_feature (382)..(382): n is a, c, g, or t
  misc_feature (524)..(524): n is a, c, g, or t
gcgaggttaanngttgtnnanggtttggcgcgaaagtaaggctggcttngcgaaagggcaggttttcggcgcctttcncccccttttccaaataccaacaannagtccttccccanntcccnactcaaccccttttgganntatgtgtggtgnttgngaccctgtggcgcatccttgtctctcntttccttctcntcgccctcgccnacgcgatctttgtggtaacccccttctgccatctctttttcttctctcattgcctaggcatcttcgcgactggcagtgngaataagaaacaacgattcanntctactttctcatcgcatgtacttccatgtgctccatctcgcncgtnccttaccatgtttaatttccaaatccnaaataagccgcgcggtgtagtttgtattatgtatgcgtttctctttctgctttcctcgccctttctccatcatcctttaggctctacagagtgaaggtttaaatccaaggtcatgtgcaaaactatctagaagttcatcgcnaggactgtgattggtacaggataggga

SEQ ID NO: 544526 - DNA, 122 bp, Homo sapiens
ctactctagagcgatcccatcatcgtgataggcatctgggcctcattcctccaagtccactgaagggtccagaagagggagtcagagatgtatcctgtgtggagctgggagaaaggcagaaa

SEQ ID NO: 544527 - DNA, 207 bp, Homo sapiens
ctatggattaaaatattattgcccctagtttaaagtaagggtttccattgggtttaagtaggtccctggatggtattggttatgaaacttaaccttttgggtgctggttataaacatggtttataaatcaggggttggggaaatttttctttttttattttctgaaacagggattaaatatggaccatttaaccgggtggtccctta

SEQ ID NO: 544528 - DNA, 849 bp, Homo sapiens
gcaacagagtgcctagactacacactcttcctcctacaattagagggtttaccccactcatggttacccccctaattaagtttgtcccaatgtgtctctcacatccaattagagcccttttttctaaaaacactccaccaccaattttatgtaaatataagcaatcttacggccgtctccccgggagtattggataacccctccttggattattcctctccccccccacacttactaggtatactacggcgcccccgctacttacctctgagtgactcctcttgttacaatatcagcgcgaggcgtctcacgatatctcctctccctcttcccatcccagtgcaatctgggggccccccgctgggtgtggtaacctttggtgtgaccccgcgtcttccgcgggcggtgtatttttgtcgcatcctcaacaaaattgtcccccccgctttttttcttctggaaccaccggggaccactggagtgatccactgagctggtgtgccaccctggggggtgtcttctcccgccttttgatcccccaccccttctgtggtaatattttcaaccgctacaaacacgtttttcgcacactcatgagtcgtggcccccaccccattggcggtttttaacacgtggcgaattctcccccgggccgttttttacacgcaccacccacttgttcccccgctaccccacgccccgggggttatctttaccggcaaattttttaaattttgtgggcacaaacacacctttttttccccccttccttaaattattctcccccaaaattttttaaaagggccccttttttccccctttcccccccccttcccccctttttggcca

SEQ ID NO: 544529 - DNA, 323 bp, Homo sapiens
cccttgtctgtaaaatgggaaaaataagacctaatttcgtatggacctctgccaggttatatggtagaatgtatatagccaagtgcttaacacactggccaaccaccagtgaatgctcaattcctaatttaaaacggggataactggtgcattcaaaatggtacaagtgacagtgaaaatttggaaccattggtgaattcatggaaggcagttcattcccaaaatatagccactttaaaatgcttatgttttaatttcaacagtattttcaacgtcaactattttctttttttctttttctttttttgagacaaagggaaaca

SEQ ID NO: 544530 - DNA, 729 bp, Homo sapiens
ttgcactatgaggttgttatgcatcacacgtcttgaaggaagccgaggagagggactcctctctccctccgtgtgtagtctctatgttggtgctagttacctttaaaaactctgtgtccagatcacgacacatgggtccgcatctcctgcagggacgtaacggggtaacaatcgttgggtgtagtcaggacgaagatcaccacacaggcatgatctgatgagggcttacaaactggaaccaggtagagccactccgggcagctgtcacccattcagaacttcttttccgcagctgaagaaatgttcagtaacctgtttgacgctaattaaaacagagcctgcaggaagtggggctaaagtggcattcagtgatcctgttctgtagacttttctttctttttttaaccaaatccaaaggatgttacagaaaagctagccacgtggtattatgttttgtttaaaaaaaacggaaagaaagaaagaagaaaaacggaaaaggaacctagctgcctgtatctttcattttaaaaatagcacttgagttatttctgagtaatccaataaagaaatttgtgatgacagcagaatgtgttagaactctgggtgaacatttcatctccgtgtgagtcaagaagggcttattttctccctttggttgggggcccttcttctttctggggctctggaagttgttcagaggaaagaatctattttattaaattggcagtg

SEQ ID NO: 544531 - DNA, 278 bp, Homo sapiens
gactgctataatccatctgtacatctcttcaggactatcagccttgtacatagaaagttcgagacgtagttacaatttcacagaggttgtccctcatccttatgtcgctatgcttacattcctccacttcatgaacctctttaagtggtattatgcgaagaggttccttttccagttcagatttgacagtacgcctattgagtttacatcccaattgaaaatatcttctcttccagtttttcatcacgttgcaccttgtataacacaaatatccagct

SEQ ID NO: 544532 - DNA, 552 bp, Homo sapiens
agaggacgtaggagaacaagaaaggaggttataacgtgaagaatataaaaagggggggcccataaagggtacgaaatatttaaaggagaatgacaaaaaaaaatttttgaggaaagggttcagaaaggggatattccccttaaaaaagggttttgagcttttaaggttgaagcaaggttttaaaaaagggaactcttgtccaaaagggaaaaagactaaaaccaaatgggggaagatttttttaattaaaaagggattttccaaattgggccaaatgggtaaaaaaaaaagttgttttaaaaaaaattaaacggaattttaaccaaaaaattaacgttaaaatttgacaattcgcaattaagtgggggaaatttttggaaaggaaaatgggtgggggctttttcattttaacacaactgggaaaaaggggaatgttttgaaagcaaattaatttgggtaaccaaaggtttttccaagtaaaagggttgtaaaaaaagggccattaaattgaaaaagaacccaaaaaagggaaaattgggtagggggcccccc

SEQ ID NO: 544533 - DNA, 235 bp, Homo sapiens
acctattttaaaagtgacttgattaggctgtgcaaggtggctcacgcttgttatcccagcactttgggagactgaggtgggtggatcatatgaggaggctaggagttcgaggtcagcctggccagtatagggaaaacttgtctctactagaaatacaaaaattagtcaggcatggtggtgacacgtctggtataccagcttctcaggaggctgagagacgaggatcacttgaaca

SEQ ID NO: 544534 - DNA, 245 bp, Homo sapiens
ccactaaccctaatcgctggatatcactaagcagcttcttcctctcccccaaggaacttactccaagattttcaaaacgagactcatcaacgacacggccgttcatgctgccctgagatttcattttctctggatgttcttcagacagcaccgtgctcttcaaatgccacctgtgccatgagtgcaaggagcaacacctgctcctggaccccaatgtctatgtagtctgggatgtgatgttccat

SEQ ID NO: 544535 - DNA, 197 bp, Homo sapiens
ataattagcatataatgagcagtgaggacaaccagaggacacttttattggcatcttcgttttggtaatgttttggcccacttctttatcacaaacagttttatcagaccaaatcttcataatctgtatctcgtcgagacttctaatctcatcctgctgaattagatgcctaacctcctcggcaatgcatgcccagt

SEQ ID NO: 544536 - DNA, 166 bp, Homo sapiens
cggacgctgtagaggagcatctggtggaacccttatgctcctggcactcggctgtgaggatagccaactcacaagttatctgacaccaccaggcttattactgtatgaggagagatgagacttgacaatgggctaggaccgtgccgctctcatggagactgctagg

SEQ ID NO: 544537 - DNA, 764 bp, Homo sapiens
  misc_feature (38)..(38): n is a, c, g, or t
  misc_feature (106)..(106): n is a, c, g, or t
  misc_feature (161)..(161): n is a, c, g, or t
  misc_feature (263)..(264): n is a, c, g, or t
  misc_feature (317)..(317): n is a, c, g, or t
  misc_feature (360)..(360): n is a, c, g, or t
  misc_feature (386)..(386): n is a, c, g, or t
  misc_feature (397)..(397): n is a, c, g, or t
  misc_feature (448)..(448): n is a, c, g, or t
gtgggcattttgaaatatttaacgtttcctcatgattngcctctgtgtgtgattttagttccacatgatgactgtgaacattagggatttaaaggaaaaaaaaaangaattctgttcccctcatatcatgaacacagtaactgataggtaaaaagactgcntgattcacttttacacttatatttcatggctagttaaaaaataaaaccttggagaatctaagatgtacatttttaccttttaggcaatttcaatataatgtnngaagtagtagtgtgccctgaaaaatgtacacgttttccttatggtaccacatngttcacctttatcagcgtgatactgtcagcatgagtacatatntcaacccagctgtgtaaaagacatangagtttataanggaccaaatccagttcctgggtcctgtggaagacctatattctctgtagtnactgaaaaccgaagtcaattctaattattcatcttacatatttttccacccatgtcatttgaaaactggctttcttctgcataagagattcttatgcaaaaactttaaacagaagaaatcattttggctatgtatacctcgcaattgtgtctaaaatcaagctcagtaataatttccatgttgacctgttaatatcagatggctggtaatttatgtcttaacgtttcttatagactaattcctctttcacctgcagaattgttaacaggtcgaatgattgaaagctaatgttttttctaaactagggtaatcgggg

SEQ ID NO: 544538 - DNA, 124 bp, Homo sapiens
gacggatccctggtggttagaataaataggcaggctcaggttgcagttgcaccagggtgttgggtcatggggcaggggggttcatagtagaagagcgatggtgagagctacggccgggacttgt

SEQ ID NO: 544539 - DNA, 140 bp, Homo sapiens
cccgtttctagaggatccgccgcagttgggtgggtaaaccagagtgttcagaggcagtaccaaggagtacagggctggacgcaaggcgcttctgggcagcttcatcagctactgttcttggagcaactttctgaaccctg

SEQ ID NO: 544540 - DNA, 388 bp, Homo sapiens
  misc_feature (1)..(1): n is a, c, g, or t
  misc_feature (329)..(329): n is a, c, g, or t
  misc_feature (334)..(334): n is a, c, g, or t
naaaagtgtaaaactgtaacgactatacataattgctttgatagctatttttttcatgtctatcagttatgtaaaatttacgaagacagtcaatgtaaaactttaaagaagatatcccacatttttaaacctttaaccttgtggctctaggttgataaactcaccaaaggcttccttggtatttcagacagattatgagggacaagccaagaaactcctgggaactgatgggaaaacacggatgtgatacattgttgcaggaggagatggggacactgcagggaggttgttactggtgttcttcgacggaacagatgagggctaccttncagtnaaggattcccattgggattttattcccactggggaggaggaccagtagtttgga

SEQ ID NO: 544541 - DNA, 314 bp, Homo sapiens
tacccgtcatagaaagaaaatagtgggggttctttttggtttctagtgggggtctctttggccgccggaggactaaagggggctttatggttcttaggtttatggctggcccttttccctttatatatatttttttagagggtaggggggttttagcccttttttaaaaccccctttttttttcctttgggaccctggtacctttatccggaggttagccctggaattggggactcttgggaatggttttaggggaggttgccccttaacttaacccggtaaattttgatggttggtttccaaaggtttatgga

SEQ ID NO: 544542 - DNA, 820 bp, Homo sapiens
gtctcggcagggtttctggagagcattcatgtgaggaagattatgtcatgtgaatgggtgcgcataattaaaagagtacatggaggtgatatccaaacttgggtataacagtgaaatgaagacgaatgaggagcaaatctgtgttaaactaatggcttggactggacacgtatgtagaagaatgtacgaagagtctgtgtgcaccatgagacaacacaggtgttaggccaacggagttgctttgacatatgtattgaaaatggggctgttgtggtctgctgcgtagctgtgttgagaggctagacttaacagtggttcagatagcatgttactcggagccatagctagaagtgcgcgccgactctatggatactgtgcacacgcaggaaagcagtgaagagctcctcttggcgtaagaggctagacgtggctacaatagatgccgatcattcggttagatgttgttgcgtgacgatagatgtttactacatttatgagacagcacaatggtgacgtcagaagtggaacgagtccagggtagtaagacatgacagtatcgaacttggacaagatcacagtcacttcccgggccctctcaagacaccagttagcaattaacgccaacaaaggatactaaagggtaaatttgacactgacagcaaacccagttgacacccaactcgtggataacatccacgggtgagagttggctccccgattctaccagtttcactaaattcccaagttaactccactctacaacaccctccggggacactaccgaagatattcctagtcgcggcacattttccccttggtg

SEQ ID NO: 544543 - DNA, 329 bp, Homo sapiens
ggacctcaatctcctcccacctcggctcttaaaagtgtggggattacaggcgtaagccacgcgccggccaaaatcttccttctttttaaatacagtgcttacatctatgaatttccctgtaaacctgctttagcggcatccataagtttggatatgttgtgttttcattttcatttatctcagcatatcttctcatttctcttatgatttcttctttgatacataggttatttagcagtatgttcatttctatatatttgagaatttctgaaaaacatctttctggtgttcatttctaacttcatttcactgaggtgggaggagaggaa

SEQ ID NO: 544544 - DNA, 92 bp, Homo sapiens
  misc_feature (34)..(34): n is a, c, g, or t
ggtgacatcgtcacagtgggcgagtgccggcctnctgagcaagacagtgctgcttcaactgtgctcaagtgtcaccaatggctgcctggcac

SEQ ID NO: 544545 - DNA, 413 bp, Homo sapiens
cttggcttcccaaagtgctgggattacaggtattagccactgcacccagcccaaactgtattttttggtcttcaagaacaccttgtaattttttattgaaagctgggcatgggccgggcatggtggctcatgcctgtgatcctggcactttgggaggctaaggcaggtggattgcctgagttcaggagttcaaaatcagccagggcaacatggtaaaaccccgtctttgcaaaaaaaaaaaaaaaaaaaaaaatacaaaaattagctaggcatggtaagtgcatgcctgtaggcccagctacttgggggggctgaggcaggaggatcactttagccccggaggcaaaggttgcaatgagctgagatggcgccactgcccttcagcctgggggacagagtgagaccctgtttca

SEQ ID NO: 544546 - DNA, 571 bp, Homo sapiens
ggcgccgatggtctggtggatctaggcacgcggggtatctatggagacctagtgagcgctcgtgcctccattctgctcggaaattctttcgctcgacgggacgaaattacggtgatgcggtctcgagaccttggctgccgtggccaagcgaatcgtgggtcgctaccggacaagataccacgaggaatcgcgcgtgcgtctatgtggaccgacaagcgatagcctaggagatcgtatcgataaggaggtacacagcgcagtgtgtgaggtacgctatggttgacatagcctatagcatccgagtagtcctaactctttgacgcctagggtccccatgtgaggtcgtccgcgaaaacttggggtgcctcgagacagtggagtaccaccaattccaacgattcaatgacccatgacttcgcgggcgacgcaactgtgacttgcagggatcagcgcaagtccggtagctaggcacaacgcttttctacgtgggggtagaccttggccttggtcaaggcgcccaccgctgcagcattccgttcccaaacaatcttgaatgtaagtacattctccg

SEQ ID NO: 544547 - DNA, 152 bp, Homo sapiens
gcagtccattagtctccagtggctatggcggtgccagtggtgtcggcagtggcttaggcctgggtggaggaagcagctactcctatgtgacagtggtcttggcgttggagtgtggcttcagattccagcagatggcaagagccgattggagg

SEQ ID NO: 544548 - DNA, 475 bp, Homo sapiens
taaaggtttccccaaatttttttggacaaaaccaagtgggggggacattgggggaaaaaaaaacgacgcctgtaagtggggtttcaaaaataccctttcaagaaggtattattcttagaccacgagatcttttctgtcggcaccgagatcatgtgtggtgggaagacattttctccaaacaatgatcggtgctaggagagtggtcccggtgcttgaagacatcaagaacctcatcttccccttgtccacacaaattctttattgtgggccccccctgacaaatctcgtcccggacaagaggcccgtttgaacaaccgccggctccttaaacgatcatgcgggcattctccctacaaatcaccgcgcgggcgcaaacatatcgttcgccggcacccatgagttgtcaccgaacaccctctcccgcatcgcctccagacagcatcagctcctgaccagcgccccacaccgtcccact

SEQ ID NO: 544549 - DNA, 257 bp, Homo sapiens
agaggcacagtgcctgaggcaggaggatggcttcagcccgggagttccaggttacacaagctaagatcatgctacactgcactccagcctgtgtgacagagtgaaatcttgtctcaaaaaaaaaaaaaaaagagagaaaaaatcgtttatgtcacattcaaggttataaaacccaagatcgggatttgggtgaaaagtgatgagggtgtatttatgattcaaacattttgatcagggagggcctctccggaggaggt

SEQ ID NO: 544550 - DNA, 376 bp, Homo sapiens
tagatgttggcatacaggcgtgagcatagctccatttattatctatgctttgaaaaaaggcgatgggttctatctcgtagtgttaggggtccctatcagctctgagatgcttatgcgttagcttagttcgtttcgtcttgttctaattttaggtagttctcgatggtactaaagggtagttgattcattttagttagataaaatgggctgctgaaataaaatagggcactaaaagaggaaatattgttacctaggaaaatgtatcgtctatttgctttatttattttatttgatacagtatctattggggcctctaaaactcaactctgattctttttcgtaataattattttaaaggagtttagaggcaccagct

SEQ ID NO: 544551 - DNA, 615 bp, Homo sapiens
gcacgatctacacttgagtataagcgattctcctgcctcagcctcctgagtagctgggattacaggcgtgcaaccaaacttccttatcatgcacacaattacttaacaagtgattgtataaacattaatatctccacccttgtgctacccacgcatggactgcacactattgaacagcaactgcacacacgcttcagcacaccacagacagtcatacccccagcaacgcatacacaaccgcacgcggcacctcaacgtatcacaaagtctatgccgccaaatccgctcccccaccacgacctgctccaacacgaaccgatgcgaatactaccgacgtacacagatgcaacatttcgcgcacagcaaccacaatgctcattggccccatgacacacgtgcgtgacccatagcaatgacaatcctcctaatggaacaccccttgcacaagactcgcacacacgcacggactactcccgatgaaatcagcggaacacaatacaacctactggagcgcccacatcacacaccagatacccccagatacacaaaaagtacgacagcacaccaacccgatccattcacagagagctaggccaatgaagacacccactaact

SEQ ID NO: 544552 - DNA, 373 bp, Homo sapiens
taggcattgttgaagccatttcacgggctcccgctgagggggcatgaccaggtggatgtaaccgcagattacttcttcactctctgaacgactgtaatgaatacaattacttaaaaaatctagccaatagtttactatcacatcgcttatcgttaagtcttcaaccaacttttaatagctcacgattttaagagaaaatctgaagacttacaacactagcatgaggaaagaacgcataaaaggtttctaaaacatgacggaggctgagatgaagctcgtccatggactaaaaattgtccttaaacagaaatttgcgactaaggcttccagatcctcgaattaattccaacttaattggcattgctttacgatc

SEQ ID NO: 544553 - DNA, 157 bp, Homo sapiens
tgatgtaagacaatgtatttccctctctcttttttcttttatatgtagagaccaagtcttgctatattgcccaaggctggtctcgaagctcctgtgactcatgtgatcttcctgccttgtgatcccccaacagtgctgggagtacaggcgtgaatca

SEQ ID NO: 544554 - DNA, 106 bp, Homo sapiens
cgctctcgcgcgcaaactagaaagatctatcaactaaaacacattgacaataataaaactgtaagatctacaagaagcagtaaatttccttcataccagcaattaa

SEQ ID NO: 544555 - DNA, 1123 bp, Homo sapiens
  misc_feature (483)..(483): n is a, c, g, or t
ggagcgggcaagctggggccgctcctcggcgctggcagcgggtgcccgacttaccgtcgaccgcgctcacgacgagtcgctcttctctatcctgccggtaccaggctccaccgagcatctctgtccatcgttctgccaatctcgcttgtgccttctcctcggagcttctcgccagcctcttggaccgtccggccgctcggctcgcggtcggcccggggttcgtggaggtggttgatgggcgctcgtccgtccagaggccttcctaccgtgctgattcttgattctggcaatgagccattattagtcgccatcatcccgactagtctatgctccggtttcctggagcagacagcgcacgggacacagcagacattacgcagcgaagagataacgcgcgaaacatagatatgggacgtcgccggcacgatcgaacgcgagtcgcttctgcagacggttgcggtccccatttcacgaacaacagcncggtgcctcgtttacggttcatggggggcgaggactgacgcgtgtcgggcgcgcaacgtctaagaaacgacgaggtcgaccggtcgagtcggcagtcgcaggctcgaatcggactgcgcactggcatggcactgcgtcaggggtagaacggtgaccgacatcacaagtgttggatctactagcatgacttaaggattgcagagaaacggtttcattactgttgcccaggctggagtgcagtggcatgatcacggcttactgtatgcctttgagctccccaaggtttcacggtgatcctcgccagctgcaacctcttacaggtaactgggactgggaggcaactgcaccatcgaatacctggcctaattgttacaaattattgtcaagagatcggggtttggcaagtttgcccaaggcaggtctccaaagtcctggggttcaaaatgattgtgctccccccctctggccttcccaaaggtgccttggttgagaccaaggcacgcacgatttaagccttaagatagcgcaatttttcgggacagagccaccaccttttgcccacgcactgggtcaatggaaggctgagtacacagggggcccagaggagcctcacacacaagaccctgagaaccggagatag

SEQ ID NO: 544556 - DNA, 589 bp, Homo sapiens
ggcgatggctcatgtccgcaatcccagcaccttggaggccgaggcaggtggatcacaaggtcaggagttcaagaccagcctggcaacacggtgaaatcccgtctctactaaaaatacaaaaatcggccagttgtggtggtgcatgcctgtaatacccagcttcccgggaggctgagacaggagaatcgcttgaacccgggaggcagaggttgcagtgagcaccgcacttcagcctgggagatgagaatccgctcaaaaaaaaaaaaaacaaaaaaaaaacaaatttgggggcccgggtgggcctgaaagaaaggttttttagcagaaccaatttcggttggggaggccggggcccccagtatagggtacggtggcaaccgtgcgacataagggggcgcccaagaagaagaaccgcgggcccagacacaaggctgcgtggaatcccaccacaatataaaaacgcgccggcggcagcacagcagggtttcggaacaaaactcaagagggaagtccggagagaccaacacgggtcttcattcacgcgaggagctcaaggggagtgcgaaattaaattagccggcgcggtgct

SEQ ID NO: 544557 - DNA, 132 bp, Homo sapiens
gtgctggacagacgggtagctggacaggtggggtctgagagagcgccagtctgtcttgaggtacgtttcggtccgtgacgtgctactcgatcgttcgatttggtctttcgggcctatagcctagtcgaacca

SEQ ID NO: 544558 - DNA, 851 bp, Homo sapiens
ttggtggtcaactgtgggcctaccctggacctcatctactcagcgagaattggacatgaagctagaggcagctgccttggaagggaagtcaggctcacttggacagcccaggccatggcaggaagaatcccttcctcttggggtccttgatgggcatgtgtgatggggaaggagcagtctcccagccctgggtctgctccccacatctctcctaattccacttcaccttttgccaccccctccccaccagaggcctagcccttttgtcaccgaaggcccccagagtgtttctgtgtgaaaccctctcatttacactgtggcatcaaaatccacaaaagatggattaattgcactctggttaatagcagcagcacaatgattaaaatctatattcctatcttctctagcaccctggtgtggggatggggcggaagggtgtcttgaggggcagggaggaccccataaaacaatccctcctgcattctcaggctaaatagggcccccagtgactacctgttcttggctgtcccctctgaagagctctgccttctcacagccaccaccagttgccccactcccaggaaaacagcacatgttcttcttctcctgccttgagactgcgtgttagtcttccattcataactcatcagcagctcagtccttcttatgtctagtctcagttcattcagccaaagctcatttttgtcctatccaaagtagaaagggttcttttagaaaacttgaagaatgtgcctcctcttagcatctgtttctgactcccagttatttttaaaataaatgatgaataaaatgcctgccctgaagggttctggaggagtcaggtatcactc

SEQ ID NO: 544559 - DNA, 397 bp, Homo sapiens
ttggtggtcaactgtgggcctaccctggacctcatctactcagcgagaattggacatgaagctagaggcagctgccttggaagggaagtcaggctcacttggacagcccaggccatggcaggaagaatcccttcctcttggggtccttgatgggcatgtgtgatggggaaggagcagtctcccagccctgggtctgctccccacatctctcctaattccacttcaccttttgccaccccctccccaccagaggcctagcccttttgtcaccgaaggcccccagagtgtttctgtgtgaaaccctctcatttacactgtggcatcaaaatccacaaaagatggattaattgcactctggttaatagcagcagcacaatgattaaaatctatattccta

SEQ ID NO: 544560 - DNA, 209 bp, Homo sapiens
actatgcaaaaacaagggggcggggaggttaagggcactgactacccttccagaggtcctgagttcaattcccagcaaccacacagtggctcacaactatctgtaatgggatccgatgctctcttccggcttgcagggttacatgcagatagagcactcatctgcataaataaatcttttgaaagaagaacaaaataaaaaaaataaga

SEQ ID NO: 544561 - DNA, 366 bp, Homo sapiens
cgactgtactggtggttcagacagcaactcggagaagatacagactccgggatggtccgtactgcagcatgcgcatcgaagacaacccgctcgatctcgcgccgaagcggatcctccaggccctcggcgctgcagagctggtcgacgaactgctgagacaggtactgcacatgctgcgcgtccagcagttcctctgcctccagagtcgaaaactggttgtaggtctgctcgccagactcccagtgcagccttgcttccgagttgctcaggtgactcgcagcgcgggcgcaagaaggacttctcgctgagatgggagagggctgcacaacctcccatggcgatcaagtccgccagagcagtacggcg

SEQ ID NO: 544562 - DNA, 538 bp, Homo sapiens
  misc_feature (1)..(1): n is a, c, g, or t
  misc_feature (25)..(25): n is a, c, g, or t
  misc_feature (79)..(79): n is a, c, g, or t
nctcttctgtgtatagcaaataccnctagtattatctattagtaggaaatgtgcacaccataaagctgcagtgaacgcnatctcctagtgtcctacacaatcggttctacaagatactctacaatcagccgccgatagttgtgcatatatcgtgccaacaacgtcacggcaattggtgtatttctcaacaagtgataattgcgcacaacttatcaggattgtgacagacctcctcagtgtgaatttcagtacagaagccccttatagtctgttgaaatatatgacgccgccctgtgcttgatacataactgtgaagcagagtcgttattgttagattaaaagataaggtcctaccatataattattttttacacaacaagggagtttttcattctgctctcacagcaagcccctggttacacaagaccacaagggcctttccttggagagacgctctgttttactcgaattcttataggccaaacccactcgtaagccagttgatgacatgcgaaataatgtgtgagctgcaagtata

SEQ ID NO: 544563 - DNA, 84 bp, Homo sapiens
agcttctacatctgcagcgtgtacaagggacagggtcgtcgtcagccccagcattttggtgatgggactcaactctccatccta

SEQ ID NO: 544564 - DNA, 967 bp, Homo sapiens
attctagaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaagaaagggaaaaaaaaatagcattatacctcttcctgtgtctcaaccgccttgaaaatcctgaacactccaaattcagtggaataagtccaaacacaaagtttataagtatacaaactactttcacttcttatagtactagtatactttaaaaagcctcagggtatatcatcttcgtaaacagctacaattcagtgcagctactttaaccaactatgtctctagtggagaacaactaggcctatttcacggctgtgtagcctcagggcctaccatgggtgccaaatacctatccgtagaatcacactgaatggtagaaacaatcgattggttacaattggccaaaatctcaacgggcccggtactgatgctaatcctttggaacagtcatcaatccaatagaggaattactcaagtattggaccgggctgggctgtgaacttacgtacataagtacttccaatgtaattatgtaccgaaccgctctccaaatatattgggacttggacattttgccaccgaggacatccctttccccttgtctctaccagagttgaacgttttcttgcaccaaagtcccatcgggggataatactgtcctcaaaatggggctataatactgatctggccgtcctgagaaacaccacatgttatccacgaccactaatggtggcatttacaagacgatggatgacaactgggcgatacgcta

SEQ ID NO: 544565 - DNA, 228 bp, Homo sapiens
tttagatatgagcttgatgtatgcaattgggtattgatgtgttttttatgaattagtaaagagagtaggtttattgcgaatggaatactactcctgatgaagatgctgtgaacattgttaaaatgacaacaattgatttagactgttacatgaacttagttgataaagcaatgacagggtttgagaggactgacagcaactttagaacagaagttctactgatggtaa

SEQ ID NO: 544566 - DNA, 349 bp, Homo sapiens
catccgtggaggttgcagttgtcatctagctgaacaatgagcagtcatgtctcacaggttctatgtaggtctcagcagtcagcgatttcaccataggtttcctcaaggtccgcatctgtgcatactgagtcccagtcaagggcaaattcagccacttcattctctagcacgacatgctgtgcatatgtaccgttctagatagcgtgatccaagtcgctctgcatcaaggctataagatagtcatctccgacatctttagctcgatcagcggccacaatcgtgtgtacatctccaccaagcagacccctggaatgaatcgagctacagatactaaaacggcaaattaagg

SEQ ID NO: 544567 - DNA, 423 bp, Homo sapiens
ggaccatcatggggtctggatatatcctgcagagtgtttcaactgtttccattctccctgtcactttcaggtacaccaatcagatgtagatttggtctgtggccatagtcccatatttcttggaggcgtgtagtttctttttactcttttttctccaaacttcctttctcgcttcatttcattcatttgatcttcaatcaccgaataacctttcttccagttgatcgaatcagctactgaagcgtgtgcatttgtcacgtagttctagtgccatggttttcagctccatcacaccatttaaggacttctctacactggttattctagttagacattcgtccagtctttttttggttttcagattctttgtgatggggtccaacttcctcctttagctcagacaagtttgatcctctgaagact

SEQ ID NO: 544568 - DNA, 191 bp, Homo sapiens
cgattttaacacggcagagagagagagagggagggatgggaagaagagggagacagagagagagggaaaagggtagggggagagagagagtgccggaggagagaatgacagagacagagaaatggacaaagacaaaggaagagaaagaaggaagccaggcgtggtggctcaagacgtctgtaatcccagca

SEQ ID NO: 544569 - DNA, 190 bp, Homo sapiens
  misc_feature (134)..(134): n is a, c, g, or t
  misc_feature (137)..(137): n is a, c, g, or t
  misc_feature (141)..(141): n is a, c, g, or t
  misc_feature (143)..(144): n is a, c, g, or t
tgatctctagagtatccctgggcgctgtatcggggggacattcccaattcggtgcattctgacgtctacttgccttttacatctcttgtggagtgagctaaaaggaggctcagacagatttggttcccaacagntgntccngnntaggccaaagggcacactcagaaggtcctccctgtagaatggaaca

SEQ ID NO: 544570 - DNA, 295 bp, Homo sapiens
attagctgtaggagaagaatcacccggcacaaaaccggtccagagatcctggacacatgagatattccaggagggaacacacaggaactgaggtagaaaggagacggatgggtggagatggaggagataagggaggagacccctgatccacacagcacagccatgtttggaggagaatcataatgctacgtacgatgtctaagctctcctcaagatgcgagggggggagtccctttccagagcctcagagagcatactggtcttaggtccaggttactgccattgaatggtatta

SEQ ID NO: 544571 - DNA, 253 bp, Homo sapiens
cttaccaccatttaacccccttattttttttcaagataagctcccgctgtgtatacccagggtggagtgccgtactgtgatcatggctcactgtagcctccacctcctgggctcaagcaatcctcctacctcagcaccctcccacccctcaagcagctgggactataggcatgtgccaccatacccagatagtttttgaattttttggtagagacagagtctcgccatgttgcccaggctgctcttgaactcc

SEQ ID NO: 544572 - DNA, 179 bp, Homo sapiens
aatgttatccaaatgctcggtgagcgctgaaactttaatcgtgctttgatactcagatgcactaaaatcgaccgtactacctaacatctcaagcgcctgtgacaattgttcactgctacgcttttgggtcgattcattgagcatttccgcagttaagcttgccagtcccgccttttcga

SEQ ID NO: 544573 - DNA, 235 bp, Homo sapiens
cttcccgggggcctacccagtgccccaaaaaaaaacccgtgggggtttgtgttgtgcgggccctgttcctttgccccaaaaccattgggtgggccccttccttgagccctggccaaaatttaggttgcaggggaaaaaaaaaaatgcccgggaggttttgcccccaacccaaggtccccccccaggggtgccgcaaacaggaggggtttaaaaaaggggtttttttatttcctca

SEQ ID NO: 544574 - DNA, 383 bp, Homo sapiens
cccccatgggggtcccccctggggggggggttccaatgggcgtgccccccccggggatggggccccctccccctggggtggggggccttttttgacccttggcccccgggtttggaagttgccccgccggggcgtgggctcggttcctcagggccccgtttcccccggcctgtttgtttcttatgctgttgttcgtggggtttcctggggttttttggtttcccttacagggccccctcccccggggattcgcccccccaggcccttggctcattttggccctcctcagctcccttcctgtttcccgtaagggtgtacattgtccctttttttccttttggcctttgaaactgggtttttattaactttttgggggcccttta

SEQ ID NO: 544575 - DNA, 230 bp, Homo sapiens
  misc_feature (184)..(184): n is a, c, g, or t
tatattgtggatatatatatagcgggtatatgtagtggatatatatagtatatatatattgtggatatacacacacacacaatagctgggcattgtagtgcatgcttgtagtcccagttactcaggaggctgaggtagaaggataacctgagcccagggagattgaggctgcagtgagccgtgntcagtcgctccattgccctccagcctgggcgacagagaccctgtct

SEQ ID NO: 544576 - DNA, 210 bp, Homo sapiens
ctggccctcgcggaactgcgttataggttcagaagcgagcctcacgtgcacactgaccggcctgagagatgcctctggtgcctccttcacctggacgccctcaagtgggaagagcgctgttcaaggaccacctgagcgtgacctctgtggcagctacagcgagtccagtgtcctgcctggactgtgcccagaccatgggccatacgagaa

SEQ ID NO: 544577 - DNA, 941 bp, Homo sapiens
  misc_feature (11)..(11): n is a, c, g, or t
  misc_feature (69)..(69): n is a, c, g, or t
  misc_feature (130)..(130): n is a, c, g, or t
  misc_feature (146)..(146): n is a, c, g, or t
  misc_feature (177)..(177): n is a, c, g, or t
  misc_feature (208)..(208): n is a, c, g, or t
  misc_feature (265)..(265): n is a, c, g, or t
  misc_feature (274)..(277): n is a, c, g, or t
  misc_feature (279)..(279): n is a, c, g, or t
  misc_feature (282)..(282): n is a, c, g, or t
  misc_feature (288)..(288): n is a, c, g, or t
  misc_feature (290)..(290): n is a, c, g, or t
  misc_feature (292)..(293): n is a, c, g, or t
  misc_feature (295)..(295): n is a, c, g, or t
  misc_feature (303)..(303): n is a, c, g, or t
  misc_feature (311)..(311): n is a, c, g, or t
  misc_feature (313)..(313): n is a, c, g, or t
  misc_feature (315)..(317): n is a, c, g, or t
  misc_feature (319)..(319): n is a, c, g, or t
  misc_feature (325)..(325): n is a, c, g, or t
  misc_feature (336)..(336): n is a, c, g, or t
  misc_feature (342)..(342): n is a, c, g, or t
  misc_feature (347)..(347): n is a, c, g, or t
  misc_feature (362)..(362): n is a, c, g, or t
  misc_feature (375)..(375): n is a, c, g, or t
  misc_feature (379)..(379): n is a, c, g, or t
  misc_feature (410)..(410): n is a, c, g, or t
  misc_feature (454)..(454): n is a, c, g, or t
  misc_feature (463)..(463): n is a, c, g, or t
  misc_feature (469)..(469): n is a, c, g, or t
  misc_feature (477)..(477): n is a, c, g, or t
  misc_feature (486)..(486): n is a, c, g, or t
  misc_feature (489)..(489): n is a, c, g, or t
  misc_feature (491)..(491): n is a, c, g, or t
  misc_feature (495)..(495): n is a, c, g, or t
  misc_feature (603)..(603): n is a, c, g, or t
  misc_feature (710)..(710): n is a, c, g, or t
  misc_feature (712)..(712): n is a, c, g, or t
  misc_feature (718)..(718): n is a, c, g, or t
  misc_feature (790)..(790): n is a, c, g, or t
  misc_feature (886)..(886): n is a, c, g, or t
cgtgtttctcncctcctgggtgctcccgggcgctctccgcgccgtggccgtttccgttccgccgtgtgnggctcgtgtgcttccccgccttttccgcccccgccccccctcccgtggtctgtctgcgggncctctcccgtctgtgnggcgcctctttccgggtcgccctcccggccnccccggccctgtgcctgctcgggggggctcnctgccggctgcggcctgggccccgcgggccctgtgtgtttgcctggggtgctctttngtggcgggnnnntnagngacggntncnntnaccccacncctccgcngntnnngngccgtnctgggtgcatnggaccngtttntgtgacttttctccngttgggcatgttnacanacatgtttcccctcctcccaccctaattttntggtcctcgcgactgagagccaggggcgacatcatgaccttctntcccggccnccttanccccgggnacagggaangcngntggnccgtttctgtctgtgtcccatcctgctgtccttctgtcctggatgtttcatgggcccggggccccccagggaagcttacccctcctgtgctgggtggaggccacgggncacctcaggtgccacccaccttggccctaaaacagccaccaggaaagcagccggagagccggacagcaggcagcctgtctgggttcctgaggcctgggggtggcagncnagcccncggcgccgtggtcccagcagcagggttgtcagtcggagcatcctggggctccctggctcctggccgtctgtnaggtaggcccagtaccgtgtatcgtaggtaccagtaggaacgggggcccccccggccctgcaaccgctcatggcggtgaggtgtgtgccaagcccncccggggtgcagggcgtgacgtgtggggaataaataggcgttgtgacctcaaaaa

SEQ ID NO: 544578 - DNA, 1012 bp, Homo sapiens
ttctctgacatacaactggggcgtcgctgtgagtcatttagacaacgatcgtcccgaatggcggataccattcccgagtgtgtgcattcatcaccctacacctctggggccacccaccaatttgtgttaccgcactgacatatgtggccacacggaatttgtgcccactttcagcgttgccaaacacacatgccgtttggtggaacctaatggaacacaacaacgtgttttgtccgtggagcccaccaccgatgcttagcaaggttgtaccgcccccgcccacatgctgtttcttaacctggcgaagaacaacaatagtaactcgggtctggggcggtcacccaaaaccacatgggggctttcacagacctccctgactgtgtgtgtgcccgacaccccgcccgcccgctgtcgaaagtgctgggagaaccaccaccctaggaagggcccccggtgggtaaaacaaaagccggtgtgaggccaccccgtcatgtcgccagaattgtctcaaggccccaagctcacttgccaaccacaggcctcctgcgccttctcaaggtgtctcccgcgcaaacagcgcccctccccacatagtggcggatcaacataacgggcgccacgccatcttattcctcagaggagaagcacgacaaagaaaagaaggactgcgttccattgcagaggcagtctgctacacaagatccctgggtttgtaggggttcctccgcctagtcatgtccaaggacacaccccgcgagagggcacttcaccagatctccccctacaagaatcagctccacacaagggaactccaaaaataaggttagaagagaagtatgacacagaatatcttggggcgtgtcaacacgtcctatgtgaatatacccttggagacacgacccagagagccgttttattcctacccgaggtacatcaccgcggggaacaaatataaatatacagggcctgaagaccacgcattttggaaaaaacccggggagccaacaaaaca

SEQ ID NO: 544579 - DNA, 238 bp, Homo sapiens
tgacagacagaatccagacatatcaaggactgtcattcggacagagtactctagcacaaaccaatgcagagacagtgaaacagttttggctgggttacgatgtcctgaacgtatctcgcagtggttctccataatgtttggcattatagtgacttactgagctttgttaaatactgatgcccaggcccggcccagatcaatcatgttctctgtcgtccgagggagggtgatctcgtac

SEQ ID NO: 544580 - DNA, 531 bp, Homo sapiens
  misc_feature (50)..(50): n is a, c, g, or t
  misc_feature (69)..(69): n is a, c, g, or t
  misc_feature (78)..(78): n is a, c, g, or t
  misc_feature (80)..(80): n is a, c, g, or t
ggagcgggagagagaggggggggcgcgaggaagagcgtggggaagcgcgncccctggagagcaatggcnacgggccgngnggagaggcggcgggggccgggaaggggggcaggagggcggggggcggaggaggacgcggattaggggagaggggggggaggcgaagggaggggggggacgaggccaggagagaggggccaaagaggggaacacggggaaacccgggcggacgggaaggcgcgaagaaagggagcgggcggagcggcgggcgcgcggaggacgagagaggagggagggagaggcaggagaagggcgagaacccgggagggggggggaggagggagccgagaagggggagaagggggggagacagggggacagagcgagagagggggggggacgggaggaggagaagagagaagccagagaaagagggagagggggaaagcgcaaagcaaagaagggagagagggaagacgagaggcgagcgaagagagcgagagggggggagagggagagaaggcgcgaggg

SEQ ID NO: 544581 - DNA, 982 bp, Homo sapiens
cagcagccgtggaacgtctggttagacgtccgcagcacgagttactctaagttggaatgcagtcatggacctcggctcaccttagaggagttacctcgagaaccaacagagatccagaaaggagtcggcctggccggtcctttcaacagctctagaggcccgttttctctgttggcaggggctaggtcttccagctcactgtatatggctataaatgtcttacgtgagagtccagatcacctgcagcttgagaatactaggcactcgcagggtcttagtgatcgaagtggcagcatgaaacagtgtggctgcctttctgaccaccccacatttcctgccctgagacagcagcccaggcaggtgcttcatattcagaccaggtaagcctcatttgcacaacagtcaaatggttgttcctttaaaaaggacacaattagcctggcacggtgactcatgcttgtaatcccagcactttgggagggcaaggcaggcggatcaccgtgaggtcaggagtttgagaccagcctcaccaacatggaaaaaccccatctctactaaaaaaatacaaaattaaccagggtgatggcacattcctgtaatcccagctactcgggaggccgaggcaggagaatcgcttgaacccgggaggcagaggttgaggtgagccaagattgccattggcctccagcctggcacaagagcaaacttcatctagaaaacagaaaatatgagatgattccatgtggaaacttttaatattcggttgggaagttggtgcccagcatgtggtgtgctagtctggaaattgcggaatgggattccaatcattctccgttagggaaaaggcttcaacgcagtcacagggctattcaggagggactcacccgggctgacacaccaggtaacaagtgggaggtgaaagaacgggggggcaaccatgggagcgggaaaggcacaaaggcgggggcggctctgtgctgga

SEQ ID NO: 544582 - DNA, 326 bp, Homo sapiens
actgaatgtggcgatgccttggaacgcgacctctggaagcgaagtccccatactccatgtactctgagactgtgggagctcctcaggtatgcaatgaggctgaacgaacttggcaagtcccttggcttcggatgggagacgtgtagctatcagtactatgctaccggatgtttatcagctccgtctagtttgagaatgttctaagctgacagaaggaccatgctatgtagtactccatatcactgatggaatatttcaagcgaaatgcttcctgagtcgcgcagatagcctctccatgggtaagccatggaaagaacactcgatcc

SEQ ID NO: 544583 - DNA, 283 bp, Homo sapiens
gctacggaggtggcagccatcttccttcttcggcaatcaatgggccgcccttcaagaccctttgttgaaggcccaagatcgtcaaaaagagacccaagaaggttcaatccggcaccagtcaagaccgatatgtcaaaatttaagcgtaacttggcgggaaacccaagaggcatttgacaaccagggttcgtagaagattcaagggccagatcttgatgccaacattggttatggagcacaaaaaacaacgcaatcgtcgccagtcgttccggagtcctcgtca

SEQ ID NO: 544584 - DNA, 179 bp, Homo sapiens
  misc_feature (67)..(67): n is a, c, g, or t
cgggacggtttgtccctatctggcgcggagtaatccatgtcagcaaagagctcgaaacaccatcggncagtgctacaagcgcgcccgtgaggcccggcatgagttcatgacggtcgaacacctgctgttggcactgctcgacaacccgtccgcccaggccgtactgaaagcctgtggtg

SEQ ID NO: 544585 - DNA, 1415 bp, Homo sapiens
  misc_feature (211)..(211): n is a, c, g, or t
  misc_feature (313)..(313): n is a, c, g, or t
  misc_feature (396)..(396): n is a, c, g, or t
gtcagtcgggggccgagatttgggagagacgctctgaactagactgccccgcgtacaccgatgagcgggcccatgtacaaagaaggagagacagggaacgggaggataatgatgtgaaaaacaggcagcgaaagaggaccatgaacctaattgagagatataagaaaaaaaaacttacaagatgaatctaacaaaaaaaaaatgaaaaganatcaacaaaggactaaaaaataatcacgatacaagttggagataggcacagtgtgtcgaggagcacctgggtcgagaacaggcaacaggaagagtaccagancctaaagccatatggagatcgatgattgaatatcagggagatatgcaagagagcaacgatgattgagtacatcattcgattanaatcagatgggggagagcacggcattcatacaaccataagcaagggtacatcgcaaggaccatggataccaccaaaattaaaaaatcaaaacataaacaacaaatcaatagcaaacaaagccaaggcaaggtagcaatcaaacaaatagcagcctgaaaaatcccaatatcaagatcgacagccatgaataaggagtcagggagggagggagcaatagtgaaacgagaggtcataccccccaaaagaaagaaagaggccaaggaagcagtaaataaaaaattctgcagagcgaagcacagcagataatgctgaaataggactatcgagctagggggaaagagcggagggggcgttgatgagaaagtctcaaggatataagtgaaagctgagcgaaaggaggaccccaaatatgtgccatcccccaatgaccagataagtgaaaggagaagtgacagtgagacaggagaaactgacctcgagcctgaagaacctagcgaaactccctagagtggtgagctcccccccagagggtccaaggaggaccgacaaaagattgtcccgaggttgaagaaatagccgacgagcggaagagcgggaagaccataactaccaagtgtggtgtgcccaaggagggcgaagaaggagcccaagtgaattctaaagatgccccaaggagcgagtcagaaggtcgtaggaagtgaggcagagtgataaaaaaccccacgggaggagaagggcacgtacaaaagtttcatgaagaacaaaggaatgtgacgatgggaggaaataggctccgagtagggtccagaagcccgaggcgtatgaagtggaaggacccccggaccccccgaaagagtcgtgaccccaggagacagctatagagtgagaaagaccagtaagctggtagagaaggtaggaatcgaacgacgcgtgcgtaggatgctgtcgtagagccgttccgacgcccagtaaaaaactgtcactataggtagcggaaggtttatactaaccttctcgg

SEQ ID NO: 544586 - DNA, 976 bp, Homo sapiens
gagagaacgaaggtacggcaggggaccagtgtgtggtgtgtgacctggagtggtcccaatggactgccatcctggatctgccacccgcccaactgagagacgcccactctgtcctctcccctgcctagagaaagtgccgcaggctcaagtttgacttccaggcgcagtcccccaaggagctgactctgcagaagggtgacatttgtctacatccacaaggaggtggacaagaactggctggcgcggagagcaccacggacgcctgggcatcttccctgctcattatgtggaggtgctgcccgcagatgagatccctaagcccatcaagcccacgactaccaagtgcttggagtatggagaggcctgtgtgcccagtaacaccttcaacgggggacctggaggatggagctgtccataccgcaagggagagcacatctggctgatccgcaacggtgaccgagcaactggtacagagggacgcatacaggggacacagggggttgcctaagggcatatacaccttggcagcttactgtgcaggtgatcttcggttgtaacgcccgcgtggattccgtggctttcatgatgacccgggaaggggagcagcgcgacagccgatcgcacaacgggaacagagccgcgaatcatacatcccgcactgcgcggacacagattaatatactcgggtgcacgccaaacaccaccagcacaagtgaacaagaggggtagcagcgacaataggaggcgcacgtgccaggtcgggcgcctagtgggggagctgcaccagccaaagagtgagcgtctcaggggaggccggagaacgctagacgctcggtggccaacacgagcagacggggatggatgggcacccctgaggagaatgatcctggaagtctgatggcaatggtgaggcgaagtggaatgcgcggataacgagtcgtgtaggtctggcggagcgagtcgtaggtgagtcaac

SEQ ID NO: 544587 - DNA, 149 bp, Homo sapiens
cccggtacctccactgttaatatattatagcctggtgggtgtggtggctcacacctgtatcccagctactcaggaggctaaggcaagaggatcacttgaggccaggagttggagaccagcccaagtaacagaggaaaatcccttctctt

SEQ ID NO: 544588 - DNA, 902 bp, Homo sapiens
agctccgccacatctccagctctcttgtgtccagcgagcgttgcctgggccagtgctcaagcggagggctcctgacggtgcggacggagcgaagcgccgatgccatggcgcactcaaacgggcatccacgccacggaagagctgaaggaagttctttgccaaggtcacggggctggcgtctgtgcgcgctcgatctaaggttgttgattggacgtgacgcagcagcctctgtgctgtgtgtgccctcgcaaggatgccgagtagtgcccgctgtggatcacggactatagacagggccggtgctgccaactgcgtgggacagcccatgcagcccatgttatccttgcttcttgccggcctacgactcactagaagtgcttcagtgggctttcgaattggcatcttacctcgtccgtgggtctgccctgattaagcatcgcccacgtagcgggctgagagatgcgtgtagcgcggccactgctgggccaccagtgacagacaggagttcggcaggtggccacatcacggtattgcatctcttcggggacctgtgaactggatgacctctcttgtgcaaggagtaccagaaaacaccttgttcgttccttgtgcgtgaccatggcccccgcttgaacctcggctggagcatgaggatgcatccacggcaatgatcccgtcctttaaccgacggttgactgtacatgatagattccagttggtgggaaccaggtcctatgctacccatagaccccttgtcatagggtcagcttgtccctttctcgcctacttgtcaggccttgcatgcgcccaactggagtgtaacatcccaagatggtgctcatggcaggactacaatgggtccaacctacagttcctagtgcgttgaacgccttggaccataa

SEQ ID NO: 544589 - DNA, 730 bp, Homo sapiens
cccgccattcagtctttgctttccaggccccccgcgggaactggcggcccgcttctgggaaaccttatgggagacccaccctggccctccgcgggacccctcttccccccctgggaccgccgggagcccagcctcccatggcctgcctcctcctccgccttgggattattcccgaaggactccccgcgggggttggtgcccctgtccctccgcacctcctcctgcaatcatccggcctgtacgttgccccctcctcctccggagagagtatgagaaataaatttttcgcccccctgtaaccccggtctttgaggtgagttcccgtatgagccccactttccctcgggcactccatataatagttcaccctcggtgagaagacccactgaagattatttacccaggctaccctcgcttttttctgggtgtcctcgagacctcggagagttgtggctttttaagtcttatggatgttatcacgcgcgatttcaacttcctcgaattttcgatgagatttctaagaacactgggccagattcgggttgtaagacctctctgagatttaagcgccactcgccctcggatcatggggaacttcccaagccaaccaagcccgttgagatggtccccagcaacccacccatgaacttttttggggacatcctgttttttttgtataactttatattccctataatccctttaggcccccataaagatttttttttta

SEQ ID NO: 544590 - DNA, 746 bp, Homo sapiens
ggaggaagtggcgcggaccttcatttggggtttcggttcccccccttccccttccccggggtctgggggtgacattgcaccgcgcccctcgtggggtcgcgtgccaccccacgcggactccccagctggcgcgcccctcccatttgcctgtctggtcaggcccccaccccccttcccacctgaccagccatgggggctgcggtgttatttcggtctgcactttcgtcgcagttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttaaggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagccttatctgacagcagccattatcctgctccatacctactggggcactagagtacaataagaagacagagaca

SEQ ID NO: 544591 - DNA, 502 bp, Homo sapiens
agtcatctacagtacacaatatgaatagatagtaaggaatgacgaaccagaatatagcgaaataacatcaccacagcgtggcgtgagcggggtggggagagacagtagcgcagatatatggagtcggggcaggaatcatcgagatctctctacttcttcagaatcactaactcagactcccttattcacatccccactcttaacccagatccaaaggtacacggtgctcccaagctagaagattgtggtgtacaatcagactaaaaaaaaaaccagctaactctactgttggcttagagtatacaaagcagtactatggtactgcaaaattagtccatatatttacaagcttccaaatttttgtagctacattatctcctctcctgtaatccttataccatatgggccctcactcttcatctctagttctggtaagcgttccacgaggaacaaaattatatgtgtaatggtcgggcttttgggggctcctctaaaagtcggc

SEQ ID NO: 544592 - DNA, 1030 bp, Homo sapiens
ggaggaagtggcgcggaccttcatttggggtttcggttcccccccttccccttccccggggtctgggggtgacattgcaccgcgcccctcgtggggtcgcgtgccaccccacgcggactccccagctggcgcgcccctcccatttgcctgtctggtcaggcccccaccccccttcccacctgaccagccatgggggctgcggtgttatttcggtctgcactttcgtcgcagttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttaaggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagccttatctgacagaggcatatctgctccataaccttgggagtgtgtctcgatgctgtgaagaaacggacggctgggctgggggggaggcacaaccgaatggacgaattcctgaacctaggtagaggccaccgggccatcaagcagcccaggtacaggggagcagggcctcacacgtggaggacaccccaattaggcacccttggcaccgagcggaaacgagagggtaatcgccgcacccccgagcgcacaggccgcggggggcaatacccacagccaaagggagacggcaaggagaacagagaatagaacactagaccacactcgcacacaaaaacgcgaagaaatatgcgggcgcc

SEQ ID NO: 544593 - DNA, 829 bp, Homo sapiens
  misc_feature (400)..(401): n is a, c, g, or t
  misc_feature (404)..(404): n is a, c, g, or t
  misc_feature (407)..(407): n is a, c, g, or t
  misc_feature (415)..(415): n is a, c, g, or t
  misc_feature (418)..(418): n is a, c, g, or t
  misc_feature (421)..(421): n is a, c, g, or t
  misc_feature (433)..(433): n is a, c, g, or t
  misc_feature (437)..(437): n is a, c, g, or t
  misc_feature (451)..(451): n is a, c, g, or t
  misc_feature (691)..(691): n is a, c, g, or t
  misc_feature (708)..(708): n is a, c, g, or t
  misc_feature (744)..(744): n is a, c, g, or t
  misc_feature (746)..(746): n is a, c, g, or t
  misc_feature (815)..(815): n is a, c, g, or t
ggaggaagtggcgcggaccttcatttggggtttcggttcccccccttccccttccccggggtctgggggtgacattgcaccgcgcccctcgtggggtcgcgtgccaccccacgcggactccccagctggcgcgcccctcccatttgcctgtctggtcaggcccccaccccccttcccacctgaccagccatgggggctgcggtgttatttcggtctgcactttcgtcgcagttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtaannaanaanaaattatnaanaanaaaaaaaaaaanaaanaaaaaaaaaaaaanaccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagccttatctgacagcngccattatcctgctccntaccttttggggagttgtgttctttgatgcctgtangncgagacggtactgggctttgggcctggtggttgggagtacctactgacatcgggactgacattcctganccctggtatgaggc

SEQ ID NO: 544594 - DNA, 710 bp, Homo sapiens
caagagtgtggttacagttggtcaacgagaaaactccttttttatagactttattctaataaagaatgaaataaggccaggcacgatggctcatgcctgtaatcccagcactccgggaggccgaggcaggcacatcacttgatgttaggagttagagaccagcctgaccaacatggggaaaccccgtctctactaaaaatacaaaaattagccacgtgtggtgatatgcacctgttataccagctacttgggaggctgaggcatgagtattgcttgaaccctaaacgcggaggctgcagtgagctgagattgcgccactgtgctccagcctgggtgacagagcaagactccatgtcaaaaaaaaaataaacatattaggccacgcacgcgggcttatgtatcgtatcccagcactttgggaggctgtggtgggtgtatcacaaggtcaacagatcatgaccatcctggccaacatggggaaaccccatatctactataaaaaaatttttataattaaattagcctgcgctggtgggagtgagcctgttatcccacgttctttggagggtgaagcaggaggaatattttaacaaggggtgggaaggtgcaatgggcgaaattgtgccaataacttcaagctgggaaagagcttgatttcggtgaaaaaaaggacttaaggaatccgattccaaaggggtccaaatggcaaa

SEQ ID NO: 544595 - DNA, 483 bp, Homo sapiens
ccctagagataaggcgcttcaggataccgaagaagttgttgaacacaaggagatcgacggcgtcttaaggagttaagggaacaattaacagaacttaccaagcagtatgaaaagtctgaaaatgatctgaaggccctacggagtgttgggcagatcgtgggtgaagtgcttaaaccagttaactgacagaaaaatacatgttaaagctaccaatggaccaagatatgtaggggtgtccgtagaacgttgaaaaaagtaagctgaagccaggaacaagagtgctttggatatgaattacaataaatattcatgaagactatttgcgagagaggtggatccactggtttataacatgtctcatgaggaccctgggaatgtaactacttctgagatggagggcatataagaacagatccgggaattaagagaggtgatagaattacctcttaaaacccagagatatatacaacgtgtaggataata

SEQ ID NO: 544596 - DNA, 1195 bp, Homo sapiens
catgacctccaggttaggattaatttgagtggcttgaaaatactgttaccttgaaggaccttctctttgaacaccatgtcccaagaggagaaggcggcttacctgagtgatcccagggcaccgccgtgtgaatataacagatttggcatgcacaaacacatgtacaggcaaaaccatgatgtataggcagcattacatagcgtaatagtatcacagggctgctcaatctgtcactgacaacagtcacgtctttctcagaaaacgatgaaagtaaagtgcctgctgatctcttaaagcgggccttcgtgaggatgagtacaagccctgaggctttcctggcgctccgctcccactatcgccagactctcacgctctgatatgcatcagccactggatcctcgggattggagacagacatctgaacaactttcatggtggccatggagactggcggcagatgatcgggatcgactttggcgcatgcgttctggatccgctacacagtttctgacagcccctgagttgatgccttttcggctaactcgccagtttatcaatctgatgttccccaatgaaagaaacgggccttatcgtacacgcatcatggtacacgcaactccgggccttccgctcagaccctggtctgctcaccaaccaccatggatgtgtcacgccacggagtcctcctttgctttggccacaatttgaccaggacaacatgctagaccaccaacggacgggctcccggcattacacagccacgctcacactgttgccacgacaccacaccgggacccccgaaccgcacacaatgccacgccacgacgaaagctacaaggtgccaaaatcagcccaccaaactgtcgacagacccacaccgggcccgcaaaacgccccggcgctcaagacatggtgcgctgcacaagaacccaccatccagacatgggcccagcaacagagcgaggaccccaaaacagcaaccaggacagcgcgtggacacgcacaatcacccaaattacgcgaactgtcagagcacacccaagacaccgcgaccggaaacaacacggacgggccactccaaggtggaccaatgatccttcccaaaagactacaggcaccaagcaacaacactggcacacaacacacgcgaccacccacgacaagcccaccgacacacaacgaacacgagacagat

SEQ ID NO: 544597 - DNA, 508 bp, Homo sapiens
ctcgctcctccagttactggggcgcattccaaccttccagcctgcgacctgcgttaatgaatcggacaatatagatacttgccccatacataccattgaggcagagcaaaaaaatataaatagaaccatgagtggaaatcgtgcacatccaggctggtcagtgtgtgcaaccagatctggttgaccaagttctatgggaggtgatcacgtgatgaacatggacatctgaccccaacactgtgcaacacataacacagctggtttttcacagactgagcacattgcgatcaagtgacatcgtgcacatgatcgtaccaacaagagaacaacacacacaggaaaggcacaaccagagaggaaccccaggacgccgagacacagacagacgaatcaaaaaaacacaggagacaaaatgagcaacaggaacagcaacaacgaaacaaaacgagacaaaaaccaaaagaccgagaacagaaagagaaaaaagggacacaccaagcgccccgac

SEQ ID NO: 544598 - DNA, 802 bp, Homo sapiens
tccggtcgccggccgtctatggtctccgtgccctccccagcccgctcctgcgcccttgcctggtcccgccgcccgcagccctggcagctccctgcgtggccccgccgaggcctgcctgcgccctgtgccagcgctgcgccccgggaacctggtgcgctgcctgactgcggccaccgcttctgtcgggcgtgcgtggtgcgcttctgggccgaggaggacgggcccttccctgtgccccgcagtgctgcctgactgactgctggcagcgcgccgtgtgagcccggcaggccccctgctcagccgcgccttctggcgctcgaggaggcggcctgtggctgcccgcgcgctgacggcccggccagcgatggcctgctgctgcagctgcgtgtgcctgcgccgacgcctggcccgcgtctgcgccgcctgccgtatggctgcggggccccgatgccgcccgatgtgggaacctgcgctggaggatggcgctggcggaaatggagaacaaggggtcttgtgcgaaatcattgagaacaggacttgaatgacgcccgggacctgcatggccagggcagagtcagcagctgcagtgtgcaagggacacgatgatggacacgtagggaagaaggcactgaccggactacaaggaagctgcgggccttcttagtgaaggaagaggagcatttctgccagaggcttagaggaggagggctccctaggacagttgttagaccatgaggaccagccctgctgcacgcgctcaagctgaaagaagatcactgggctcatgtgtcagattcgcacg

SEQ ID NO: 544599 - DNA, 152 bp, Homo sapiens
tctagaggtatccacgagtgccacacacagagacacaaccatcaaaaagagtgtcgtgttgtgaactaccacccagcgtttgtacactgcccatatctccatggcttttaaaaccacaaagccgaacgttgcccagagctgtctttggtatc

SEQ ID NO: 544600 - DNA, 276 bp, Homo sapiens
gatgtgattgacatgcacagaggaggtgtacagctacagaggaggagacgagggagcggatgggatgttatgcaccaggtatttacataacagctcgatgagcgcttcagcgaacagctgcgctaagtcatgactgcagagtggccagatggacgagtcccaacacagccaaacctcagaaaagccaatcagatggtttcagaacagcagccagatgggatgtgagtgttgcccactgtcagtcccctcctgtgtgctgtccacctcctctgtgct

SEQ ID NO: 544601 - DNA, 564 bp, Homo sapiens
ataatttttttataaatagatattaaaaatataatatacatctccaaacaaaaaaaaaaaaacacccccctccaaaacccaaaacaaacatttcccccatctaaaccaacccacaaaatttccatcctctaacaacgtaaaaccccctcccaaactcttcaaccctgtaaaaaacaccaaaaccccaaaatctttctaaaaacaaaaaactctactacccctcaactcccccaccccccaccaaaacactcaacccacaataacccttaacactcccccccctccgttaaacaccatacacttctcaccactatattaagcatacacaaaacactcttagaaacaaattccccacaaaaaaataaagttaacagggtctcccctaacaacctcccaaaaacaccaatcatatatccaagaaaaaaaacatctgcccgccaacacaactcacaaatataaaccttacttgccacaccataaacaccacatttcccccaataaaccgctcacccaattctctcatacaaccacatccaacccctctacaacaatgcaccctccccc

SEQ ID NO: 544602 - DNA, 147 bp, Homo sapiens
atgatatacatcggcacttcgctattctcgagcacctcgctatacatcgagcacctcgcatatcattggcactattgctgaacagaatgtcagtactattcactgcagcagtgaagaaaacgtgggggtgggtgccgataatagcga

SEQ ID NO: 544603 - DNA, 139 bp, Homo sapiens
tgcggatgacccggaatgttaccagctgcagaacttcaccctggacaggagcagtgtcttgtggatgggtattctcccaacagaaatgagcccttaactgggaattctgaccttcccttctgggctgtcatcctcatcg

SEQ ID NO: 544604 - DNA, 287 bp, Homo sapiens
  misc_feature (7)..(7): n is a, c, g, or t
  misc_feature (10)..(10): n is a, c, g, or t
  misc_feature (16)..(16): n is a, c, g, or t
cagcggnacnagcaantattggtaagtacaggaagaaatggaactctcatacgttgccaaaaggtctgtaaatcggtataaacactttggaaaactggtaataccactgaagctgaacattcgcataccctaagaccaagcaattccactactagtaattttatctaaaatatgggcaccacaaaacatataccaaacattcgcaaaagccaaaactggaaacaaaccaaatgctcacccacaatagaataaatgaatgtggtacagtcatacaagctggtcttgaa

SEQ ID NO: 544605 - DNA, 380 bp, Homo sapiens
gcctgccgataggacgctctcgtggtgtgtggcacgagcaggtgcggtttcgaaatacaccgtggggtcggctttgccggcagttggtagcgcaattcacagcgtttgccttgcgaggtggtgatccacagcgctccttggtccagcacattgggcaggaacacctggctggcgtcctgcaccaaggtgacgaactcacctgtggtcgtcgtaacggaggctcccaccggcatggggtttccatgatcgtcgctgacggtgagcagcatgcggcgggtcaggcccacaccgaactcgacccgatcgacagcgccacgcccggccgagatcacggccaggccattgttgatatcggcgttgcgcggtagtgagcgggtctg

SEQ ID NO: 544606 - DNA, 598 bp, Homo sapiens
atctcacatcttaacacatgctaaggccaaaaacaaccagtgaaaagaagagagaagacccttctcgaccacgggaagcatcttccagaagtgtgatgggaataaatatgcctctccttgtatattatttctaggaagaattttaaaaatgaatcctacacacctaagggacatgtttgataaagtagtaaaaattaaaaaaaaaaaaaactttactaagatgacttggctaagatgctctatctggctcgggaatctcgtttcaaaaacacaggggtgttttggtgaaaggtggtgggtcccaacagggagggacaattcatggaacttcgcatcaaaagacaattctttatacaacaggtggctaaaaattggggactctcttttcacattcttataaatatgaagctcacctggtggcttacaattttttaaatttggtattttccaaggggtgcatatggtacactttttgggggatatgctaagtaatgctacgtgtggattcctggaggtggataactttgcttgcagtagattttctttaaaagaatgcgcagttacatgcatacttcaaaagtattttcctgtaaaaaaa

SEQ ID NO: 544607 - DNA, 186 bp, Homo sapiens
cggcacgaggattctgaccagcaagcacccagacaccttcgcattctgtttctgtgcttgcaatggttcaactctccctggtggcagatgccctctagtggcaaaatcaataatcccacacaggcaacacagtcagtagagaagagtaagaaagggctatgaaactgcctttccaaaatcagaaca

SEQ ID NO: 544608 - DNA, 256 bp, Homo sapiens
agctgctacaatagctaagctcagcataaaggctccatatgtcatggcttcttcctttacccccagatttataactgatatgccaaatgcctggccctgcgctattctgaggcgattcgtgccgtctgttttcctcagtttcacaggactgttttgtgaatatcgctctatgaagagttcaatacttggcgctgtgtacaagttttcattatactgatctccaaatgtgttctatcaaatacctaccttggcttct

SEQ ID NO: 544609 - DNA, 229 bp, Homo sapiens
actctcagatctctcctttatcaagcagtcgtatttgactatactgtcagagacctggaggtgtctgaccaactctgccacatgcgggggctctatttcaccactgctgctccttggactgttttttgaggcacattgataatttagctactctgtgttacagatagcgatgtagactgactgattgcctgatgtaacaaaaacaacacaacacggtgttgcgcaaata

SEQ ID NO: 544610 - DNA, 81 bp, Homo sapiens
gacagcagcttctacatctgcagtgtcgaggggtacttaaccggggagctgttttttggagaaggctctaggctgaccgta

SEQ ID NO: 544611 - DNA, 109 bp, Homo sapiens
ctcaaaacgacaattctgtgcctgggggatctgacctggtgaggtagcctgaagtctgaatggagcccatagtcgaaaacaacctaagaatctctcagaagagggtttg

SEQ ID NO: 544612 - DNA, 231 bp, Homo sapiens
atcggatgcacctggcatggtgatccaggatgcagaagggatcatattcccagaacgcttaagtgtgcacctgcaggataaagagatgccggtcacataataaaatgatatctagggattcactgggggatatttttgttgctttaacttacatggttagagctacaaagaacagcgattttttatgttgtctcccttcccgattgaaaaacataatacatggggaccata

SEQ ID NO: 544613 - DNA, 207 bp, Homo sapiens
cttagttggtacatagctagatgtaaggtacattttaaggtaaggtaccttaacgtatacattacttaagaatatcacagaggtggctggcaagatgacagcataggaacagctccagtctgcagctcccagtgagatcaacacagaaggtgggtgatttctgcatttccaactgagatacccagctcatctcattgggactggtta

SEQ ID NO: 544614 - DNA, 156 bp, Homo sapiens
tcaatttacacatggttgctaggggctagggggcaaggggatgtggagtgactgctaatgggtactgggtttctttggggatgatgaaaatgttttggaatctgatagtggtgatgcttgtacaaccttatgaaaacaaaaagtgtagaaattgaa

SEQ ID NO: 544615 - DNA, 904 bp, Homo sapiens
gtagctctgcgaggggccggagcgcggcggagccatgcagtacccggcaccccgggccggcggcgggcgccgtgggggtgccgtgtacgcgcccacgccgtgctgaaccggacacccgacgcccttttacatcgaggacatcctgggtccgcgggcccgccgcgcccacggcccgccccacgctgccgtccccctattcctccttcaccagcctcgtgtccccactaccggaaccccgggtgtacgagcccagccgatccatccagtcttctcgcaccactccggcgccggcttggccgtggctaacggacccggcgtgtttcgacgggggcccctccgtgtaccccttcccagcgggacggtgaatgacctaaacagcaacggaccccttgctaccggacaacagagcgcggagtggggaaaccttctaactctgagcagccgtccgttacttgcaggatggccctcttgcccattgaagcgaggggcaacacggcaggcccattgtgacgaattcctaccaacagaaccaatactcaattacggaagctagaaacgcaccggaccatttcggacggacgccagccacaccctagtcttcgtctccgtgggcgaggaagagaaacgccgttctggccaaagaatgcttgacagcataagcgaaggagcacacgggtgatacacaccttggtatcccacggaaatccgacgtcggctataattgggaggacgactaccacaattgtgaagatagccttacaacgcaatgtcccaccctcacaggacgcgggaaccgatttggcacagtttcctggtcgatcagtgggacggagttgggccactgaacacacttacggtggctctctgaatacgacccaacgtgcagcactacctttttccatag

SEQ ID NO: 544616 - DNA, 311 bp, Homo sapiens
cgctatgctagtgtagtccaggcgtataaaataggacataccctgcatacaactacctctatcttggctacactaactaagcctgatacccttttcactagcgttatacagactctatcatcacaccactaatctaagttctcagacagttcaacattacacgcattcagaacaacataggcgtctttggctcccttcaacagaagccggaccatagtgatcattcactctctatgagtctgtcttatacttctggaacaggggcctaacaaccatatcctatagcaaaaccggtagctgcctatgcctcc

SEQ ID NO: 544617 - DNA, 136 bp, Homo sapiens
ttctagacctcccaaagtgctcagattacaggcgtagccaccgcgcttggtgagaaatccaatattactattcaaaactcaccacagtgcgcaagggtgcaggtttcactcagtatggtagtactcaagactcatt

SEQ ID NO: 544618 - DNA, 204 bp, Homo sapiens
cccggcttttactgtaccgataatactagtttcttgcactgaatatataaacactccacagtgtttatagttagggaagatattagggaaggaaatatatattgtaaaagatagaaggctgtatctaattattaaatctatatttaaagtttgttcacttgaattcttttgaggataggatagtattattcttgctgttacagt

SEQ ID NO: 544619 - DNA, 385 bp, Homo sapiens
aagccagcctccagcatcgcctcctctgggatcttctctgacttcacagtcggtttcagaagcctctgatgaccccatgcggagaagactgctcccctcactgctggcacacggcagatgctcagtaagtatcgttcaatgactgactaaatgtctcataatatccttcataaacaagggcctggtgtggattcataaatgggtctctcaaagtttaattggtgagactctgttgtatcagacaatgaagggttaaaagataatattcaaaaaagtaaaatcatgacacacaaatctagaatgaacacacattgataaggtttggatgtgtgtcctcacccaaacctcatgtcgaactgggatcccccgtgtcagaggcggccgc

SEQ ID NO: 544620 - DNA, 377 bp, Homo sapiens
  misc_feature (40)..(40): n is a, c, g, or t
  misc_feature (74)..(74): n is a, c, g, or t
  misc_feature (79)..(79): n is a, c, g, or t
  misc_feature (128)..(128): n is a, c, g, or t
  misc_feature (131)..(131): n is a, c, g, or t
  misc_feature (266)..(266): n is a, c, g, or t
  misc_feature (270)..(270): n is a, c, g, or t
  misc_feature (281)..(281): n is a, c, g, or t
  misc_feature (286)..(286): n is a, c, g, or t
  misc_feature (297)..(297): n is a, c, g, or t
  misc_feature (306)..(308): n is a, c, g, or t
  misc_feature (320)..(320): n is a, c, g, or t
  misc_feature (327)..(327): n is a, c, g, or t
  misc_feature (333)..(333): n is a, c, g, or t
  misc_feature (341)..(341): n is a, c, g, or t
  misc_feature (346)..(346): n is a, c, g, or t
  misc_feature (348)..(348): n is a, c, g, or t
  misc_feature (361)..(361): n is a, c, g, or t
  misc_feature (372)..(372): n is a, c, g, or t
ttgttgtcttttgttttttttttccctttttctgggagangggggtctcgctatttggcccaggcgggtctcgnactcnggggctcaagctatcctcccgcctcttagcctccctgagagcggggatnacnggcgtgagccacccggtgggttggagcgctccacccgagggggtgggctagatcgggtctagagaggcgattccaagctctctggcgggctcccagctgggggaatccttaaggctggtctcaacctacacgttnaaantgctcctgggngtgtngggggaggggnagagggaannngagctctctctngacctcntccaanacccttgnttggntnacccagccatttncagtagctacncgggg

SEQ ID NO: 544621 - DNA, 519 bp, Homo sapiens
aaaaaacaattccacggggtgtgggaataatttaattcaaccggggggcagggtttttttcttgggaaaggggcggtgaagggacccaaaataaattaggtgggttccccccttaaggaccccaaggattacacttaatttttcgggcccctattttttttggaattgtttccggaattcaatttttttccggaaggaacttttctaatgtgtattccgcaggcggaaattaatcccccctaaaagaacaaaaaaaaatggtcccccccgggggggggccctttaaaaataaagggttccccggggggaggaaaattgggaggaggacacctccaatttttttgttttattcccttcaaaaaatattttgactaaataattcattaattattcaatttttcttatatttaaaaaaaaagggctctttttttttgcccccctgaaaaagcacaccttagttgaaaaaaacttccccccccacccggaggtttttttttttaaaaataccattccttatac

SEQ ID NO: 544622 - DNA, 1008 bp, Homo sapiens
cggacgcgctgggtgtcaatgatagacaaatacccagtgtaggtatactttttccaactaccactgctacatgataatctttctcacgctatatacatgcaaccttcttgcgcttcatttccatgaagctggtctcaatatatacagtatacttcgtccttcaactgctgcttctgttaacagctgatctctattctcttctctctccattctatactatcttcacttagcttcattcatacaactctgtccagttgaggcctcaggaacacacaggcctgacttatcatgactccgaagctataccacacacgacaaccattccaaataaacttcacaccggcgacactcattctcactactaacccagaatgggtctcacaacgtgacatggacctcaattacgctacgcttatcaacacaacccaactccgtaaccccaaagttgttcacgagtatcacaaaaacatctcactatctaccgcttacaccaccacaatgcaacacagattccccaatactaataaacctatttaaacacgggcaacgcaccttgcacacttggacaacagattcccccctaaagttaataaaaaccatggtacttccataggtacactctcgcaaaatacacgatcactatgcaacaccataactcacgtgcacataaaacacagaccacaacgacgcattcaaattcacccacacgatgaacaatcacggctgaaaacctcatgcccaaagaggcaacctcaagcgcgccaacacaatatcacacgagtaaaacgatagacacaggacacgattcgcacccccaaaataattttacaccccttatcaaaaactttggcccaccccactatagttaaacacaattacattaaataacccataataatctaacaggggataatcaccattggaacaaataaaggttccctacagagtgacaaacgttttgaacaattgagtagaacaaaccacatcataatataacaggtacaccca

SEQ ID NO: 544623 - DNA, 267 bp, Homo sapiens
tagtagtcccagctcctcgggagactgagtgcagagaatctgcttgaacccgggaggcagaggtttcagtgagcggagattgcccactgcactccagcctgggcaacagagtgagactctgtttcacaaaaaaaaaaaaaaaaaggaaagtgtttctaaacaccttacttaaaaaacagattatttgcattatgggatttaaccctggccataatttgtgttttttgggtacagacggggtttcaccatttttggtcaggctggtct

SEQ ID NO: 544624 - DNA, 339 bp, Homo sapiens
gatctagaggacccccacccaggctgagcgcggtggtgtgatcatagctcattgcggcatcaacattctgggttcgggcagtcgtcctgcctcagcttcccaagtggctggtactgcaggccgcataccaccatgtccagctaatttttgcattttttgtagagacggggtttgccatggtgcccgggctggtcttgagctggtctccaattcttggcctccagtgatccacccacctcagctttccaaagtgctgggattacagtaatgagccaccatgcctggcctaccataagttttaaaagacagtaatttttttatggaatgttgactaaatgt

SEQ ID NO: 544625 - DNA, 354 bp, Homo sapiens
aacgggtgatgcggttgtgtgtgtccctgtgtgtgtccgcgcgcattgcgtgtctgtgtgccgacttctgtctctctctcacgtctctctctctctctctctctctctctgtctctctcccttctcgctctttcggacgccctctctctctgtctctgtccgtctgtgtgtgcgcgcgccttgggacacatgcgccctgcgcgccggagggtgggtatctcgcacgtcgccctttcttcatggcagcgtgtccccgcgtctctgcctaggtcgagtggcccgttggcagacgtcgtccccggggttccagtttgggggtctgagaaggcctgcgcaacgttggcaatgggcgtc

SEQ ID NO: 544626 - DNA, 1013 bp, Homo sapiens
gcaggaaggaacacacaagtagttatctttcaggctgctctttgaactacttccaatgcacccctgaacactagcctgcaggcagagctttcaaccactgcctaacagctaactgacttctacactgcacgcttctggacactgcgtctcctacctggcgcaagctctgctggcgcacggactgacacaccacgaaagcacgctgcgagcttacctctcgacgctgaactccacacaatacacgcaacaccctactgcctacgccagcccacaccttgcacacaaagccactaacacgcaactctttgacactaactccgagctgcaactggcgcacgacttctgactactcagttcacttgcgcacaaaccttacataagcgctttatacaaaacactacatgcaacagctaccaagctagctaccccaacaacaagctgaaccattagcgcaacacgccggtagcttcaatgttcatacattccagccattacccaggctggaagcttcaacttcggacaggccgcttgcaaaacactattgaccactctatctttccaacacataacttggaacccttaaaggcgactttgcccaaaagcagtccttttgctttactattacgttcctggcactctattttcgctcttttcatatgcgacaaattgctggaccacttgcttccttgctgaaaaacccaaagcatttggcatcaacggtatgcggctacctgaccgcattacttctttaactccttggcccattatgcgggttaataaaaccaccctttacatacaccccttgggttcctttaccacgcgggcaatttggccttttacacatggggctacatttccgttgtcccgtggggccttttacgcaactgaaccgcggacttcaaggaaaggttacctaatgtgacaggcatgcataaccaagcactacactgatacggcatcgggggaccaccacggggtctgccctaccatgtgcccatgcggagaaccccagt

SEQ ID NO: 544627 - DNA, 154 bp, Homo sapiens
ttcccacgattataatacactcggcacagacagagtctgggagccatgggggcaccccttgccctccccaggcttcctaagtaacaactgcagaatattaaacataaaggctgggtgtggctcaggcaaaggcccttccctgcatgccaggggt

SEQ ID NO: 544628 - DNA, 1237 bp, Homo sapiens
  misc_feature (705)..(705): n is a, c, g, or t
aatacaggaccattgctcggttacgtgagagcatggttcccgtcggagttatcggtctacctgaatcgccctagaatgggccatctggaggcaacggcgtgaaggaacttaaacatcttaggagaattggagcccatccataggccgtgtactaccctcaccaaccattccctaggcgtagtacgaagggtttaggcaatagaatctctacatactgctgctgtggcaacgtcagatgagtgccgggcatccctagagaggcttagaactgaaataagcggacgggctggctcgcgagcaggcatgatgagccccatgtgggtccgattgaatagcgcgattgccgacatggggctgtcgctatgactagtagcgctaggatttggaagccagcggtaatcggctttggacgatcaccgtcacttacaatgacgtcctttcttagtagttgatatacggttgttagccgctgggtgtagtgcacgttgatgcgcacctggtcctgagctcgacttgtacaagttgcaccgcagatacgagttcgctcgtcagctaagcttacacgtgacactgcgtgagtcccgtatatcgcatgctcacctgcacacgcacagttgacgcatatgtaaaacccatatgcgtcacgtttcgtcaataggaaagaccgtcaagactatcgcgttaattgaagggcggaatcgttcnccaaaaggagacaaagctcaacacctaagacgcaacgggaggacggaggtcgggtccccaagaggcccatctcatttttcacagcgtttgaaacctcatggcttgaatgattctcgggtagcagttcccccaacgagaggtccaaggtcacgccttccaaaaggctcacgcgcgaaacgacgtttggtggccccgagagactttgcgacttccctaggatcaataccctcatatggcacgtcccctgttcggaccacgggatacccttcctgaaagtctccccaaggcgaggttaacacccccgtggtagtatccaaccaagaaccacggggcccatcgccacagccatctggcccctacgcagaggagaaacaggctgtagttctaccacctatgcaggagcacaacctttcttcgctcacacacagtgcactcttttctgaaattcacccacgtatagatagtatatataccatagtgatgtcaaaaagcaaagcagtatatcgctacctgaacagcactaactagacag

SEQ ID NO: 544629 - DNA, 231 bp, Homo sapiens
cggtccggatgtgagataggtaggtggaggtgcagggagccaagatcgcgccagtgcactccagcacaggtgacagtgtgagactgtctcacataaaaagagaaaagaaggaaagatatgtgaaaagctcttttagagacttaatcaacaagttaggctatcgtatctgttgggtttttcttccttggcttcctgaccacttgaagaagaaacctacctatttcacaatcg

SEQ ID NO: 544630 - DNA, 430 bp, Homo sapiens
  misc_feature (297)..(297): n is a, c, g, or t
  misc_feature (417)..(417): n is a, c, g, or t
tctcgacccagcgtccggtccctcttcttatggaaatgctttgagatggtgacagggctggatgaacgtgtgaccctgggagatccgggctggactgtggaccccgatgggccagagtccttgtggcccacagcatagcactggggacagtgcgctctatgcaggtgatgtttgtgagaacagcatggttatttttttttgaagtcacatttgttcaacttaaaggattggggggtattctgaagttatcccctcccttatttggatgataaaatttccttttatgtaatgaaggtnaaagtagagggcaatatttttgctttttgaaatgctcttggttgcaaaacaaaatgttggttgctgtttgtcaaccccaaaatttcttcttaagttcgcctgtctctgaaatcccaaagncacggaaccgcat

SEQ ID NO: 544631 - DNA, 917 bp, Homo sapiens
  misc_feature (16)..(16): n is a, c, g, or t
  misc_feature (179)..(180): n is a, c, g, or t
  misc_feature (240)..(240): n is a, c, g, or t
  misc_feature (254)..(254): n is a, c, g, or t
  misc_feature (283)..(283): n is a, c, g, or t
  misc_feature (313)..(313): n is a, c, g, or t
  misc_feature (331)..(331): n is a, c, g, or t
  misc_feature (336)..(336): n is a, c, g, or t
  misc_feature (340)..(340): n is a, c, g, or t
  misc_feature (344)..(345): n is a, c, g, or t
  misc_feature (347)..(347): n is a, c, g, or t
  misc_feature (357)..(357): n is a, c, g, or t
  misc_feature (385)..(385): n is a, c, g, or t
  misc_feature (390)..(390): n is a, c, g, or t
  misc_feature (392)..(392): n is a, c, g, or t
  misc_feature (413)..(413): n is a, c, g, or t
  misc_feature (420)..(420): n is a, c, g, or t
  misc_feature (440)..(440): n is a, c, g, or t
  misc_feature (635)..(635): n is a, c, g, or t
  misc_feature (656)..(656): n is a, c, g, or t
  misc_feature (665)..(665): n is a, c, g, or t
  misc_feature (702)..(702): n is a, c, g, or t
  misc_feature (713)..(713): n is a, c, g, or t
  misc_feature (726)..(728): n is a, c, g, or t
  misc_feature (739)..(739): n is a, c, g, or t
  misc_feature (742)..(742): n is a, c, g, or t
  misc_feature (752)..(752): n is a, c, g, or t
  misc_feature (757)..(757): n is a, c, g, or t
  misc_feature (760)..(760): n is a, c, g, or t
  misc_feature (763)..(763): n is a, c, g, or t
  misc_feature (768)..(768): n is a, c, g, or t
  misc_feature (770)..(772): n is a, c, g, or t
  misc_feature (780)..(780): n is a, c, g, or t
  misc_feature (783)..(784): n is a, c, g, or t
  misc_feature (804)..(804): n is a, c, g, or t
  misc_feature (806)..(806): n is a, c, g, or t
  misc_feature (814)..(814): n is a, c, g, or t
  misc_feature (914)..(914): n is a, c, g, or t
attgaagacacatctnaaaagaagggtttgtccaggcatgcctgcctcatccccttatattgccacttccattttcatcttcttttgtatcataaatgagaacttcagactgtgttaaagaaaattgaatctgtcctcttctccccacccaaaattacttcgtattatttaatgtctgnngtcatccttcaaagaaaagtcttgcccggggttattttatttaatttatttatgttatanagtgtatgtaagcnatcatgtcataagcgatgattctgtacantcattcctgcatgaaaattgttttggaganttcttggtaattgaggancagcngagngggnntncccacccgcnccgtaaaagtgcttacaatgaacagggnttctntnctttatcaaagagccaaaganacgtggncaaaaaaagaaaagcttgangtctcaatgcctaatgtgtgcgcataaaacaggcacgaagaaacaaacgtgtgtgtcctcttaattcctatatcacaaatatagcagaagcagcaatctgtacagtaaaatgcagtcatggaaaaaaaatctctctaaagcatctgaaatacttaaaaatgtttaactttaaaatgcatagtgatcaggaaaggnatacttaggcaagagaagcanctgaactcncacgttcacatgaagcatcccccatcgattcttaaancatatgtaaantaggacttaattnnntcacaaaccanaanaataatatanaactngcnaangggcnannntttaaatnatnntttttttttctattcatgcncnagtttganacagccaaaatccttacagtacacaaaaccattaataatgtagaaagagacaaaatgtaagagagaagatacatactgagtgtggataatcaagtcaggntct

SEQ ID NO: 544632 - DNA, 939 bp, Homo sapiens
  misc_feature (819)..(819): n is a, c, g, or t
tccggggggttttggtggtggctttttccccaaaataaaaggttttttttataaaacccggtttaaaaaatcccaaggcgtatgaattggttttggggttaacttttggggcttaacagattcgtgccgggggtatgaacttctcagttttgcttataggacaaacctcggggggcttataatccatagggtcccttttatgttgggtcagtgggtcacctcccattgccagtttatcagcaaattccaatcgaggtgtgtcctccgagacactctataaagtcgtggttataccctcccttcaagtgtccagcgtggttaccactccttgttccaacgctatatatttcacttcttcaccgtgaacttctgtgcaagaaaagtggtcgtggcgggtcctcggcgactcccacttcgtgcgcctccttataactcatggagcgggacgccggaagagggattcttttataaaacgagaaaacttcaagttaagggtgcacttcgccgtcggtaaaagccccctctggaaggggttccccattggcggctttaagaaaaaacacaacaacaaaaaaaaacgtgggcgccgggggcaagggggaccaaggggctgtaaaaccccagaccagtgtgggggacgaccccagggggcggggcaccccgcggcgggggtggatactgcaacaaccgtgtgtggccccagtggggaaaacccgtgctctcttactataaacccacaaattagccggggtggagagcgcgagggcggtataacccgcagaaatggggggggagtactcgaaaaaaacatctaacccnggggagcaggctggggtgggtaagacacccctgtcccagccggtcgaagagataaccctgcttaaaaaaaaaaacccctaaaaacgcttcggggggttccgcaaaagcaggcttaaccag

SEQ ID NO: 544633 - DNA, 259 bp, Homo sapiens
gttttttttttcccctcccccccccccccccttgggttcccctttttttttttggggggggggggaggggcccccttttctttttttttggggggggagggggatttttaaaaaacccggggggggtttaaatttaaaaggggggccccccccccccccccctttttttttgtttttttggggggaatttgggggggggggcgtttttaagggggaacccgggttttttttttttttaaaaggggtttttttttgtcca

SEQ ID NO: 544634 - DNA, 845 bp, Homo sapiens
aactcttgacctcaagtgatctacccacctcacgcctgtaatcccaacactttggggaggccaagacgagtggatcacgaggtcaggagttcaagaccagcctggccaagatgctgaggccctgtctctactaaaaataaaaaaattagctgggctacttgggaggctgaggctggagaatcgcttgggcccgggaggtggaggttgcggtgagccgagattgcccagcctaggtgacagagcgaggctccacctcaaaaaaaaaagaacagacctaaacctaaaatattaaacatattaccttccattttctagccaactgtgatattaacctgtgccatgagattctaagtagggcattattgtggggcatgctctgtgggaaagacaagaataccttttggaattctgagaaccaaaattattaaggttaaagggcaatccctttcaggcaaattccccaaactcatttgggaagtttacccaagagtattcggggaattgggtatcactaatcaatagtgttaacaactccattatagaatcaataggaagggtgtttatagaagttggtacctgtggccacaaattattcatgctgaaaagagcattagttgagaaacattggatctcttttatcagatattacctcttcaggtcgctcacgattcacatcactccgggttaacggcagggagcaaagcgtgactggatacctagttaaccattattctcacacatttgggcaggatttgacccatttttaagccacaccttatgccagggcctacaggctccagaaaacattcagacaggtcaaccactattactatgtacgctcagac

SEQ ID NO: 544635 - DNA, 526 bp, Homo sapiens
  misc_feature (71)..(71): n is a, c, g, or t
caagaaaaggtctggtttctggtggcctctatgaatcccatgtagggtgcagaccgtactccatccctccntgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattctggacttcctgctctacaagtcaggagtgtaccaacacgtcaccggagagatgatgggtggccatgccatccgcatcctgggctggggatgtggagaatggcacaccctactggctggttgccaactcctggaacactgactggggtgacaatggcttctttaaaatactcagtaggatcaggatcatctgtggaatctgaatgcagatagtggtggctggaatgtcacgcagccgactcagt

SEQ ID NO: 544636 - DNA, 873 bp, Homo sapiens
gattgtatgagaagaaaaaccattagaactattcagccacaggaagcatgtgctcaggctttaagggctactgggacaaaagctgaagctccaacctagacatatgttaagctacgccatgtccacaactgtccactactaacaagcagtgtgcgtcacggatgagagtggcacaatgctgatctctgaagagataacacggacaagaagacacggtctgcggcatacgtgacgggaactattcttgatctaatgcagtacaggtgatttctaacctagaagcaagaaattctgggggccaagattagcacccctcctgcaggaggaagacagtcgcaccagcggcctgctcatggggcttgctggatctcatttgccacatcgtagaaaccgaattggaggaaacataatcttcattcctgtggttctccacgttcaatagtcgtggcagtgctgcttgaagtttgcagtttttcacatcatgaccaggattctggaagctacaaacagttgtgtattatacctctgtctcctggtttatcatactcatgtgacaccatcctcggggttccagtgtctccctttgcataacctgttgcattgcattgacagtggagtgtagcttcatcgactgaaacagctgtcataaggctcatgaaaagatctggataatacagacgaaaaatgagaaactgaaattcagtatcattggtgcggcttacctcggcttattgggcaggaagattcgaagactaagggattcaacctatgagtgctatgatcatctcgggaaacacgtgacgcgaatggtacagaactataagaaacagctcgaatcctctgctagacaggtcacgccagggaaattaggca

SEQ ID NO: 544637 - DNA, 631 bp, Homo sapiens
tatcaaaatcagcaactggggcatgttaatttcctccggggcctggcaggctggaaccaaaatataaacaaaggcactggggcacctgggtctggcacggtctggagcttggccgccgtgggttagcacaccggtgaaggggtgttgcccgggccgttgcagggacgtggagctcatctccctcccagaactgagagagggcccctcggggactgtggagcgcatcacaagtgtgctaggctttggccacagttacaggggagcaggttacggagttgggtgtgtgcagggccgtgggtggagaattgggagaaacccggttggacaaacgcttgctcacaacgtgctccataaacgccaggggagaacctcacaggcaagggcaaattgttgggcccgtgagatgttagaaaacgcgtgggataacaagctactgagaaaaacaaaagctgtggtgggctcagccaggcccccacaaagaagtgtgacatgcaaaacaggcatctggccctgtgtgagaagaccgaggcctcccgcgtagactcctattagcaaggcggctcagggggccgggctctggggctccagttcacggaactacattagtcagctgcagccacccctggattgc

SEQ ID NO: 544638 - DNA, 424 bp, Homo sapiens
cataataccagtattattgttcacactaagactactgaatggcatttacgactttttgctgctctttatttctcattatactacatttctagtaaggatgtacagacaaaatatcatattccaaagtcacttaaaataatcccctgggctgggcgttggctgtgacgcctgtaatcccagcactttgggaggccaagatgggcagattgcttgagctcacaagttcaagaccagcctgcccaacatggcaaaattccttttctataaaaattagctgggcgtggtggtgcttgcctgtagtcctagctactcaggaggctgaggtgggaagatggcttgagcctaggaggtagaagtttcagtcaactgagatcacgccacgccactgcactccagcctgggtgatagagccagacgttgtcta

SEQ ID NO: 544639 - DNA, 924 bp, Homo sapiens
tcctaaccccttggcatatatgcagtcatggactgtgtgtttttggctgtaccccctaagtcacctggtgctgattcaacacggtatttataaccatagtagctagagtagaaaattactgatcagctgtactacaggaacttcatagaagagtaaaaatctagttctttatatgatgccatgaatatattacgacactcgcgaaagagaatacattgatccgttgtatatgtgacttattgtcatcaggagaaatataatcttgcggaaatagtgtattcaaatatactttagtaatctagaaacaatgtacgtcatggattagtaatgtatttctaggttgtgagcaatatgtacgatgggtatacgaggcttcctaggaatttgagctactccacctaatttactcataggcaaagcctcttcgtggacagtaaggatcgccaaactcttctcttggattgaatacatataagccctattctctgttcaattcttcactataattactcttgcctccaacataccctagtactgcccatatggttccttccccttctattccaatcttcactagaggtcatcatgatgggggaagtaggagattcaggtgtaaatgcggtttacggcttacacgaattgttcgccatcgagtccctataaacgcacggacaatccgagtttaagggagaaatgtcccaagatcagccatatattattccacactagtcaacggacccgtgattacgaccgattatctaatgactaggctttaactcacagggccggacttactaggtttcgcacccggcccatgtaccatgaccacgaccgtttcaccggcagcactctacattgggcttctgctaacgcagacacgccacagggtcgcacagcatccctgactgggcgtccccacacacc

SEQ ID NO: 544640 - DNA, 456 bp, Homo sapiens
ggacaaggtccaccttttccaaccaggggaatttccaagcattgcacaggtggtacggttgtaaagggattgaaggtgctaaagtggaatttacctactccacgggatgatacattgagcaactaaagactcaaatgtctagctgtgtggctaaatggttacaagatgagatgtttcactcagactttcagcatcataacaaagcccttgctgttatggttgatgtaagtctgcaatagataaatatacatgtatttcagacatgtaaaaataccgagccctatgaaataatctgaagtttgcatgacttggaagtagaatatactatgttctctatttttagagctgtcttgttatttggtagaataaatgaatgtgtgtgtatattttttaggtcttaattgaaggcttaaaaatctgtcattttctttttgggctccaataaaatttaaaaga

SEQ ID NO: 544641 - DNA, 1353 bp, Homo sapiens
  misc_feature (709)..(709): n is a, c, g, or t
cttcaaacaaagtgccacacggccgcagtcccaactcaattcaagtgacaattgttagggacgtcctacgtcccggcccgggcacacgcgagaactcccgggccccctttcctaccattggcaccagcagctagcggggtaaccagacacccgcagcacataacactagagcctccgaccacccgcaagccagcaacgccgcagcagcatccagcccacaacagacagccaaggcacgcacacccgaaatacgacacgattacactgctgtatacacgaactgccttaacccagctacacacatattatctccgcgccctatccctaggctcacgtccgcacacccagacacacactgggccgcccctcagccatcagcgcacaggcatggcacccgcacgcgcctgcgtacagcgcaagctcagccccgcacagcccaagctccggggcacagctcaccggcagccggccagctcccgcgacacagccttggccccgccacacagcgcgccacccccaccctgcgcgcgccacagcggccagggcactagcgcccggcggccagtcactccccaatccccggccccacaggcaacatacccaagcgccccacggggccaccccggccgccactacgccccagccccaccagcaccccgccgcgctagcgcacttaccaccaacggccggcaaccaacgcgcgaccgtnacgacaacccagctccaccgccacatcggccccactatcccacaggccagggcatgcacaatcacacgtatgactcgacccacacacacggctcaacgactaggcaggctgcgcaaccctccgcacacacgtcggccacccccaacaccagcacccacagtaccccccacagacccactaaaccccacccagacgagcaacctcgcaccccaatagaggcacagcccccaaatggccccacgcgacaacaccgcgtcgaaaccaccaccgcacacgagtcagtgcaggctccctcacatccaccccacgaccatagagccccccatctgtcgggcaaaccccaggagcaactacgccgacaagtgggccccccacctctgggtgtcgtgcagcgtatccgctctacttcccgaagcgccacaattcggcgcggctgagcatcagcaatcgaatcaggggccacgcccatccgctccctccatcaactcttggcggcgatgctcgaaatcatgcggcgccccctacatcaccatagcgcactctattttcccgacaccctactacgccttggcggctcacgtcacctcagcacagcatggtatgcaacacatactagcgtgctagtatcttgcccgaccagcaag

SEQ ID NO: 544642 - DNA, 240 bp, Homo sapiens
ccccccggaacacacaatagctaagacccaaactgggattagataccttactatgcttagccctaaacctcaacagttaaatcggcaaaacttttcgccagaacactacgagccacagcttaaaactgaaagcacctggcggcgctctatagccctactagaggagcctagcgtgtaaacgagaaacctcgagcaaactcaccaccttttgctcagcctatataccgacatcgtcagcta

SEQ ID NO: 544643 - DNA, 643 bp, Homo sapiens
  misc_feature (464)..(464): n is a, c, g, or t
  misc_feature (483)..(483): n is a, c, g, or t
  misc_feature (502)..(502): n is a, c, g, or t
  misc_feature (545)..(545): n is a, c, g, or t
  misc_feature (552)..(552): n is a, c, g, or t
  misc_feature (596)..(596): n is a, c, g, or t
  misc_feature (611)..(611): n is a, c, g, or t
ctgccaagccttaccaccccagggtctagcatcacactacatggtgcctcaacccctgggacccaagttgctactgaaccctattggctcaggctcccaaattgtagcttaccctattacccaggcccaaactttcagagcacctctcccccagaattaggccagtgctgtgtccttccctccagtgatagaatcatagctataacctggccccctgaacctgagctgctagggggtaccccagagtcatagatcctggctgtgtgggtaacctacatccaacacagccacagagagaaaacttgtaccctaagacccaggtaccagaatagttttgtgagactctgagcctaggaccctggccccacagctgttccaaacacctgcacctggaacccaataccactgtggctgtttgtaggccatgtcagacctgacaccaaaagggatcatcttggctatgncccctttttttcccccaantttccggggtttaaaaaanttttttttttccccatgaaagagaagattcccaaactccttgntactaangacattaacaaacttacaccaattatggctctacaacaaacttntacaggcctaaaccnaaagaagtgcctacaggtattgcttgatgtgc

SEQ ID NO: 544644 - DNA, 957 bp, Homo sapiens
aatgcagctgtactggccccggatttctgggcattgctggtggacactgcgcaattttgcacttggagcgcttaagaagtacgggttgggtacgcggaccgtcagaggcgctgcagtcctgagaggaggcgagcttgtctgctagacgaatttcaagccaccattgcttcggcctggccgggagagcggaatgtggcctggtgttgcggagatgtcccttgcactggcaagacgtgtggccactggaagggagcccctgttatgacccctgtgcggctactgggtaattgctgtatccagtgttatctgttcttgtcttcgggaaccgctatcgatatgtgggaccctggagttcctgaggctcctgaaccgtcttcagttgacaacattcatgcagtcattcagttccacgcatggggcagagtgtgacgatgggcactggccacaaatcttatccattgggtgctgtccagcacttatgccaaatcccgagtacaccagatcctaaccctacaaattggatcatatagaagtggtgacagactgtcctggaacgaagtagctaggaagcatccagtattcaaagatcacctagtcgccaagtcgtccacatgtaagcggaaagacctaaagagacataagaggggcacctatgatggcgagaggaaccccaagccgataggaggcagcaagaaaccccatgatacgtccaacaccaagaaatggactaccaatagaggccaatggaacgcccataccaagatgggggcacgatgaggcatccgccgaggggcgcccgggaagtacaccgcgaaaaagtcgcaaacgcgaacaaagcagataggccggagagaagccatgagagggagtccaaatcgtcatgcgaagacaaaacattccaacacggcacaaaatgggcaggaattgcacgggaaggacaaagcgaggaagcaccca

SEQ ID NO: 544645 - DNA, 494 bp, Homo sapiens
  misc_feature (50)..(50): n is a, c, g, or t
cggtacctggtgaaccctatcgggaaacatggctcgtacgttcatcaggncaagaactgtgtatgcagtgctgtggggatccaggagtgaatggctgtcttttggcagtgtgcctggtatgcgtgtgtctagggcaaggattcacagaagtgagaacctttgcatttgtctccatttgcttctaattcattaggaactttaactttccctagggatttggactaaggcatcttcaaggtttcttttaggggaattaaaaatgtgacatgaagaacggttgaagaaacttgtctaggctggagagtaaagaagacatagaggctgggtgtggtgggtcacactgtaatcccagcattttgggaggctgacggggaggattgcttgaggccaggagttcaagaccaccctgggcaacatactgagagcccatctcattaaaaaaaaataggaaaaagacagtgggcaggaggtggggagaatgccaacatggtcat

SEQ ID NO: 544646 - DNA, 467 bp, Homo sapiens
  misc_feature (40)..(40): n is a, c, g, or t
  misc_feature (127)..(127): n is a, c, g, or t
ttacccagggtgtttgccaaaggacggcttttccaccccnaaggggtttttattcccaagggaactttgcctttttcctttctgggggggggcccccaatttgcccgggtttgttttccaattgggnaccccactgttggccccgggccccctttttttttccacgggggcaaaaaggttctgggccttttttgggggaggggtttccccctcccccctttttaaaaggggaaggcctttttgggtggtcccttccccctttgggggggggcccccgggggtgttgccccccccaatgtttctttttttttttgaggcccccctttaggtttaaacccaggaaaagggggggggggcgggccgggatttggggtttgggtttttttttttttcccccaaaaacccccccctttgcccgtttttttttccaaaccagggaaaaaagggtttttttttttaaaaggcca

SEQ ID NO: 544647 - DNA, 401 bp, Homo sapiens
cctatacacttccaggccctaggggggtcccatacgggtcatggatttgaatcggatggccactcacatgggagggaagaaggtggagcatacacaccctctggtcctataaggacaccccaaattccataatggttgatcatcttggcatccctgtcggccttggctctgattcttgcaggttgcatagcagtcaacagacgaagattgtgatggcagaacaaaaagctagtgatcaacaccgtaaatagccctgttgaggacacacacccaagcggacttaacggaaaggcactctctgctccagaaatgccgcattcggggaacatggactttgtctacacttcagaccagtttatgacacttgatgagaaaaggaacctgcagaatgtggacatgaa

SEQ ID NO: 544648 - DNA, 1011 bp, Homo sapiens
  misc_feature (228)..(228): n is a, c, g, or t
gcgctgccttggtctgcccaacgtggtgggtcccaaaatgtgaccagtgtgctccgctaccactggcaagcttggccaatggccaggtcgtgctgaaaccagtgatgccgatgcgagacgcctgtacaatacatcctcttcatgtgcccagcaggtagcaacccacgtatcagcaggggacaagatgcctcccgatgtcggagaaagtggatattaggtggacttgantgatgcaggacgcatgctagagctcagtcctgtacatagtgatctcaagatcctgagacactatcgcgtagacagtaggcctaccaatggcatgccagacgtccttgtcgacttgtgtgatttacctggaggaaccacgagcggcgccgtgcgcttgcgtgactaatggctactcaggcctgcttggcgtctgcacggcctgggcttggacgctggggcctcgcgtgtcgatcgatcgcgagtgccatcgcagaaggcgtatcgtgcagagtctgactatccctggatagtgctgtaggctcatgcacagactctatgcgtatcgcacgtatcctagttgagtcgcaggagcctttcctggggtaggctatgagctcgcatgcgcgcattggtgggtgtagcacatcccggcacttgtcccacgcgagcgagactctgttagtggtcaagggcgctcatgcgtgactcggtcagggacctggtggtcccttggcactctccgtgcctccttaaggaattgctgatagggaagtaaatgaatctagtaacgccaagagtccccggaagaccaggtgtgcgtccgacgtcaagtccccccggcgaggtccaccgagaagtcaagtggagggtggggcctgccatgcgttggggcccagtgttcgcccagtccctttcttccgcgtcaagcggcggaaaacctccgtccgcagggggccgtgtgctcgagccgtggggatttcttgccccccttgggcaggggaacggaggaccggtttgggtccc

SEQ ID NO: 544649 - DNA, 902 bp, Homo sapiens
gaaggcactgctgagctgggagatgtcggcgagggtgtgggaggaaccgtggggtctctcccggtcgggctttgcgaagcggtgctcctgtgtgacacgggcggttgctgggtttcattgcatctcatatgattgtctctttaggtggaacgagttatccatgactatatgatcataaatctagacaaggctggcattactgtgcgagcgttgaaagaatcttgtaaagcgattatctaggctaaactaggaactgagcatgatttatgagcaggggctggactatatgatggattctgcagattagtgaaacattgccttgtgttggaacacgagcaggaacaatgagactatgaggtactacaatgtgttgccgtgacaagaggcacatgtcatatcttgttcattggataacgtggctttgagtttacctatggttaatgtgtatggcacgtcaccgtttgggtaaagtgctgctcatgaagccaggagatggagaaagtaatgtatgtcagcacagatggaagtatatgggttggcagtcttgatcagggattgatgaatcttcacggcggaaggaatcttactaaatccttatgccgttcattctagaggcagggtgatgagtggttggtacaggtctttagtggggaacaatgataagtttaccaagtggttatcgcaaggaaagggaggaatgttatggaacgaagtcaactattccagaacagaggttatgcgcagaagtttagtaatctttggctgcagcaaaagtaggaactggttgggttgatggggtcagggtttcagcaaggaagcttcgtttaatgtactgatgttgtagaagcagtgatgggtgtctcaagagggaaacaggtaatttgtactggagcagttgaaag

SEQ ID NO: 544650 - DNA, 481 bp, Homo sapiens
ttccaataatgttggcattgatggtggtgccatgtcgatgtgtctcggcttactttacacaaaacaaacgtggccctaatatcaaaaccgaattcctggtctgtgccgcaacatccacaggagcaagatctatgatgggcaagcgtgcacattctgtgttctatattcaaagacagtcttgcccacatttccattccgcttagagcaagtgtcttgaagaacgatataccggaatctaatatttccctctgctttgatatctaagtcatttgcccctttgagaaccacagcttttttgaggttcttagcttgatcgtccatgtatcctacactgtttttacagatgttagtgatgttctgggaggcttcttttgataaaaggcgcaaaaaagtcatctgagtaatggctgtattaggtgattggtggtctccataagcgaactgagaccctctgttcatatcaatgaccaacaatttattg

SEQ ID NO: 544651 - DNA, 472 bp, Homo sapiens
tttttttttttggctgtgcataagtttattatctatatctgggaaaaatcatagaacaattgcgcgggatttaggcgtcgcagccagagcagatccgggagcactgagtgaagacggcgctagggaggcacaaccgacatgacgtatctatcagtgaagacgacggcgaccaattatgggagacagagatagcaacagacgaacatgactaggagaaactcgacgtaacattggggggaccacaatcagataggacaaggcataacgacctgcgaagtacccacaagaacatagaaaccaccattacatagcaaacatcactaaccaaaacaagcgcacaggaagtgaacgccaagaacaaacaaatgaaatcgaacgacgcaaccgaaaaccataggaaaagaaaatccaaacacacaataactcacaaaacaagaaaaagcgaaaaaggagaccaagaaaaaacaaacaa

SEQ ID NO: 544652 - DNA, 445 bp, Homo sapiens
  misc_feature (415)..(415): n is a, c, g, or t
tttttatcggccaaaacccttttgcgatttgtgtcaaaagaacattgggctcccaccggtcattgcgcttgtgattagcatgactttgcatatcacacgcgcgagcttttgtatctcacggagcgtgtgggaaaagcagcagactcttctcaacagaggatattagaatactcgggcttctcgagtgacaatgtcctcgcatctaatggccccttcctcatcggaagccggagtgcctgtggcgagacaacaaggaggagtacggtggctacaatcactaagaggggggcaagcagcagtcagtggctctcaggaggcagatagttccccccgaatttccctccgccaagagacgatgcggtccccacggcgtagagtgatcacgccgcgtgtgatgcgtgccaatcgacggcanaaaccaccagaacaacaatagacgaacaac

SEQ ID NO: 544653 - DNA, 962 bp, Homo sapiens
taatttccataaaccggaaatttaatgggtggaggatcagtacagactttccaattggtccacaaatcttaacatacgtaacgaaattctaaaaagccaggtatggtaattctttttaaaagttatcccagtgacttcccagctataaaattgggaagcaaatttccctataagaggctatcaagtaccagtatctctcacgtgggtcagctgttacatacggcccaccagttcacaactcaacgagcacgttacactacagtgttccaaatcgtggtaatcttctcacgagcacgagtaacaaagtttattaggaaaacgaggactaccacaaagaagtgttccagaggtgccacacaatttcgtggcagaagaagaagccagtgatcaaagagggggtttccttataggaaacaatttctactaaaaaacaccatgggttaattagaagctactttaaaagtgtccaagactttaaagtgcgaggacgtgactccattattggccatttaatatgcttggtatcatgggatataaaaattaaccccccatctggggcgaatggtcacagctggacacccgaaacaagtcagagcctcccataattcaatatcccacgactatttctgggtggtcccaaaaatataaacaaccagcaacaggatttcacctctaaaaaaagggcattaccccttaaaaacggggatgaggggggatccctccttctaaaaaaggtgtctagagctacttaaaaaccttgccttgacaaactagtggataaaatatcctcgggatggtcaagaggggagaccgcgccccctgatacaccgggcatacgggaataaccaaaatgggtacaagctcaccgggaaaaccagaggggaatccccaagcctcgtccccgttccgcagtaggactacaagactggtacccatcggcggttccttggccccttcctttg

SEQ ID NO: 544654 - DNA, 1627 bp, Homo sapiens
tggggatgaattacccttcccttttactcgggggtgtgacaaaccataaacaaaaaagaccaaacgtgtgttaaaacacccgagggttccgtagaaattacaagacctcaaattcatttacaatttcaagcttcactccgaaacccgggtctcacaaacccttaggtggagggtgctgtgtgtggagccaccaagatctcgggggagagagagggggcgaggaagtgtggactctcgtggaggccaaacgagaagagagggtgtgggaagaaggggactcctcccttaggtgtcccccggggtgaaatcaaccccccaaaccacaaacggggggttattcttccaacatatttcctcaatgtgacgcatatgtaaagagacttttacccagggggcctctgtgcgtccctttgtggcggcccccacaaccccacattcccctgtgggcccaagagggctttccaaaaaggcgcacagagtccccaaaaaaggggggtttctttcacccccccttccacgtgtgtggccctccgccgggcggtcttctattaagcactgtctcccctctttatctctcccctccctatttctttcgtcaaccatttttttcccctcctggcgagcactctagcggtaccgcccggagttcgacggggggtcccgcgggggatataaagcgcgcgcggcaattgtgaagggccgtgggcgcgggcgccccacaagcgggtgcgggtgggcgcggaataacccaaaagcttggcgcactttgaacaaacaaagaacggacgaaaaacaaccacggcccccacagcgcatacccctccgaaccactcacaccaccaggcagcacactcccacaaaaactgtctaacaacacgcacaagccacaccccctactaccacgagcagaactaccccacacacggggcaccaccacgaacagaaaacccgccgccccctagcgtccgcgctcataaaaaccaaccccaccaaaccccacgcaggaaaacaccccacgcacaccgcaagcaccttcccaaccacaaacccgccggagacacgggccgccccaccaggcgccacacccccacactgggcgcgagggacccgagacatcgacaaaacaacacaacaccgcacaaggcgcaacgacacacgcatcctccccccacgggcggtcatcccgtgcctactcatcatcacacagaccacaaaacaaggcgaggtgcgtaaagctccatgagagaagggccccaactagtaatcaaaggacgcgcaccccacaccccccccgaccactccggcagtccaagcaacacaccctacacgtggtaccactgacggcccagtaccaaagtgtaagacaaaaacagacggcgcctcactacaacgatcaagccagcataccagcggtactacgcgcacatccaacacacgaacacaaactacaggtcgctaaacgtaccaccaccacgtcaccccgcctgacgtcagccatgccagtcatcacacgacacctgctgcccacgaaacagcataaaataaatcgagacgacacagcgcgccacacaacgctctagagcttcacataccttgtccggcatcagctaaaatgagcagacagcat

SEQ ID NO: 544655 - DNA, 956 bp, Homo sapiens
tcgccgagggtgatcgaaagcggggcttctgggacgcaggtctggagacgcggctcggagcagccatttcggtgtagaagtggcagcacggagactggtcaaacaaatggatttacagaggcttacgcggacacgtgctctacagtaggacttgctgccagggaaggcgaactgttccacgtcttaaggaaactgctcaccaagggccgaagtgtcgatgttgctgataacaggtggatggatgccaattcatgaacgcagcttatcagcaactctgtagaacttgtttgcacactgtcaactctaatgcacgattcatctgaaaactacattaagatgaagacctttgacaggtttctgtgccttcgcatctcgcctgccagtcaaggaccttggaaaatcgtacagattcttttagaagctggggcagatcctaattgcaactactttagaagaaacgacaccattgttttttagctgtcgaccatggcaccgatacgatgtgttaacggctgttgccttcaacacggagcacatgtcacatggctcccattctatgtgtggatggcactcctttgcaccaggctcctttttcaggaagaatgctgccgatcctaaacttgcttcttagacaaggagcaaccaaggaatgccaggcatgatttggcatcccacctttatttgtggctgctcaagtatgcagctagacaggctgaagcatacgtaattcatcggggtgcaactgtccatgtcagcttgcacaagcttaccctgttccttgctgtcagaggccccccactggtgaggtggctcaccggcaaccggacttatgcagagcagccgagtacctatccggcgcgcgaggcaccaagctgccctgaccttaccggcgccggacaatacccccagccggcgacacgcaacgcagcgccgcgtgcacgcacacgactatgaca

SEQ ID NO: 544656 - DNA, 416 bp, Homo sapiens
caatccacagcgtactataccaacaggtttttgttttgttttttgagactgagcttgctcttgtgcccaggctggagtgcaatggcacgacctcagcccaccgcaacctccgcctcccgggctcaggcaactatcctgcctcagcctcccgagcagacaggaccacaggcatgcgccaccacccctgaccaattcttgtattcttagtagagacggggtttctccaagttggtcaggccggtctcaaactcccgacctcaggtgattcacccgccctggcatcccaaagtgctgggatcacaggcgtgagccatgctgccccagccataccatccatcagttttaagatacttaaccaaaacatttgtgctaggtgtcaagatatacttctaaatatttagctatagtgatggaag

SEQ ID NO: 544657 - DNA, 157 bp, Homo sapiens
gacctggaatttgttttcgtctgttcagtagactccgatttcagaatatgtcggaatttcagactccggaacttttgagaatgtcattacaggaactttgtttacataccgagctgttagccccagtcactgggtccgaaattacgccgataccgac

SEQ ID NO: 544658 - DNA, 354 bp, Homo sapiens
aaggctgctacgtgacctcgacccaggtggtcacgcactgcaaaccgtggatgtgcacgaatcaccgccacaagatgtacaaggacaagtatatattgaagaatagcgaccagaccctgaactgcgaggggactgtctccactgactatgcgctaaacgtcaaactcgctgaaagtgcaaataacatactgtgcattgttaaacaatgaacaggatcttccgtggatcgtgctgcgagacctactatcttagaacaagtgataaatcaaagcagctattctaacaagttttggagcatagacaacatcagattacaggaacatcaatgtgagggagcttagcaagcatctactg

SEQ ID NO: 544659 - DNA, 430 bp, Homo sapiens
  misc_feature (145)..(145): n is a, c, g, or t
cgggagcttacctgaaggaggtgctggagtaggtgatggcatgagatgtcacttgaagatcttgcctgattgaaggctttgccaatgctggaaggcccctcccaggaaaagtactctcgaaccaggggtctgggtctcctcgctngcaggatccagtttcgtgcatgtgtatgactcgtagtccacctgccaatctggactcagcggaaaggcaagctcctggcctcggaagacccagattccagaaatggagctgctatggttggttccaaaaaggatgacactggggaaggcattcttcctcagctggtccagtcgctggaacattccagtgatgagattgcagctcatgaaggtctgagtgagttcttcagggaagcgatactctgagtaccacagggaccagccgtccctatcaaagtgctcccag

SEQ ID NO: 544660 - DNA, 253 bp, Homo sapiens
ctaaacatatagtcgctatcttcatcattaacatccctcttttctattgcttggctgtaattttgtaaagataaattatactagtcctgtatgtgtgtttgtagtatatgttcagaaggcagcatcttcattttgctagctttgcagaatcttaaaatgtgtactcgttatttctaatgatgtacaaaaaaatccctagtcctgtttagcatttgacttttttatatgttttaaatgttgcagtgtgcttccg

SEQ ID NO: 544661 - DNA, 515 bp, Homo sapiens
gaagtcccacagaggaagtgcccaggctcactcacacacagcatgcacttgaagctttctgtggaaatcagaaacctccggggctcaggcgctgtagtggtggcctggtgactctgaccccttgaaggagaagcatctgtgaaggtgctgtccaggacaagtagggtgctctacggtaaaggacatggtggcctgacctgctccagagcagggaggcctcccttgaggaaataagataaacccagactttaaggataagcagaaaccagctaggtgaactggagtgggaacagcacgtgaaaaggccctggtttaggaaggagcaccactccttcagagcacagaaaggccaggatggccgaagcatagggaacaacaggaaagtgacataaattgaggctgcagaggtagaagaagggccttattggtcgtgctaggaatttggaattctgcaaagaagcctgggaaacagattttggtgacactcgccttctctttaatgtgcagtttcacca

SEQ ID NO: 544662 - DNA, 425 bp, Homo sapiens
  misc_feature (83)..(83): n is a, c, g, or t
aagatgacttaataagccgtgaacaaatctttcagcaatctggttctatatccatcatgagactgtggcattaaaaatggccnttatcatacagataaagctaagagaattcatggctttacaagcttccaattagtggcagaaatgagactaaagatttagtcctttgtacaaagggctggaaaatcatttaatatattttaataagtcaatttaattgaccatcctattttcaggctcagtatagctggcaagtcaatattatcaacagtaatcaaaactgccagcaatgtgaaagaaatcagtctgataaattgtatacaattaaactcttatttaaatgattttctaaaattatcaaaaatgatagaaaaaggatgggaacatttactgaaaagtggtaaaggacaccgcctccttccact

SEQ ID NO: 544663 - DNA, 282 bp, Homo sapiens
actccctgggagcaggccctggggtggctccgcccagtgtcgttctacctgaggtctacttgtgtctccccccttgttctctgcccccagaccatggccaaagcctttttacttcgggttttctgagagccttatggatgggctcacagtttttttgtaggaggagaaagaggaaggggcatggtgggcacccagccctgggggcatctgagggcacagccacgtccccagcaagggcacgctccagtagccccgtgggtgaaggcctctgttgaggctgcg

SEQ ID NO: 544664 - DNA, 179 bp, Homo sapiens
caagaaaatatttctctccaaccaaaacctttacatgaccctgtgtcatgaactcccgtcgtttggcacaaaccatgtagacccaaggcctggtggccgacagcagggatgtgataggcctctgctgtgtgatggggtaaacgatgggacccgaaagtgaacccggtcaggggtctcca

SEQ ID NO: 544665 - DNA, 646 bp, Homo sapiens
  misc_feature (58)..(58): n is a, c, g, or t
  misc_feature (72)..(72): n is a, c, g, or t
  misc_feature (103)..(103): n is a, c, g, or t
acacaaacataaacggtcctggtattaccataaacagtgcagccaagaaacagtttanagaaaatttaacangattcagattatatccattctgtcctctcgncctgagaggtaataattcccatatgggtcctatcctccccaatggttttcccatctctgatggaagagtccttttacaaagtggtgttgggcgataatgatgttatccccaacactttgggaggccgaggagggtggaccacttgaggtcaagagttcgagaccagcctggacaacatggcgaaaacccatctctactaaaaatataaaaatgggttgggcatggtgtagggcgatattatccccaacacgcaggctggagtgcagtggcacgatcttggctcatggcaacttccacctccagggttcaagcgattctccttcctcagcctcccgggtagccaggattacaggcgcgcaccaccacgcccagctcgtttggtatttttagtagagacagggtttcaccatggtggccaggctagtctcgaactcccaaactcaggtgatccggctggctcaagctcccaaagtgctgggattacaggcatgagccactgtgcccggtctacttctgtgattccatttaacaaagggaatgccc

SEQ ID NO: 544666 - DNA, 410 bp, Homo sapiens
  misc_feature (15)..(15): n is a, c, g, or t
  misc_feature (69)..(69): n is a, c, g, or t
  misc_feature (146)..(146): n is a, c, g, or t
  misc_feature (406)..(406): n is a, c, g, or t
  misc_feature (408)..(410): n is a, c, g, or t
atacctttgaaaaantttcagaaaattctccctaaattgtttccagcaaccccaggccaaaaagagagnccctggaatccccaaggtgagaggaaactttaaaagttacaccttatggcccaggcacggtggctcacacccgtaantccagcactttgggagactgaaatgggtggatcacttgaggcccaggagttcaggaccagcctggtcaatatggtgaaaccccatctctactaaaaatacaaaaattagcctggtgtggtggtgcatacctgtaatcccagccacttggcaggctgagacatgagaatcacttgcacccaggagacagaggctgcagtgagtgagatcatcccactgcactccaacctagacaacagagtgacactctgtctcattttgntnnn

SEQ ID NO: 544667 - DNA, 316 bp, Homo sapiens
ctacacggatccccacatactgcgcatatgggtacagaaataggaagtgagtaaatactgtacccatctggggtggcttcacaccgtatggtgcaacactagcagacatcacagatataaagatgtctaaggtctcttttacctttaatatactaatatagaaagaagctaattcaaggtagatcttccggatttgaaaactttaattgggataagaatgattaataaagactttcaaggcctatacttatttaaccaattttttttttttgtgagatagactctctctctttcccccgggggggtgtgcaatgtg

SEQ ID NO: 544668 - DNA, 464 bp, Homo sapiens
ggtcaggcatgcatgctggcggggcgtcgtttacatagaaacaagtattagcatattcacagatcacatctagtatcatagctataggcaccattattagaaaacatgatacctcaagagccagaaaaagtgtccatgtaataaaaagtcagctgagtatcttaagatgttttttctttaataaaaagtcaagaggtagagttaaactaccaaatattcgtttgttcactccagcaacaccatgtatttcatcttctgcaccatttgcacagggcatagacactcaggcattggcagcatagaaagctgcaataagatcatgaatggtccctgcacaagaaagtgcttgtcattttagtagaagcaggcaaatgtgaaaaaaaatgaacactataaagtctgtgtacaaagagatgtcttctttacctgccatcctctgctcagcccgttgtttccaccacacc

SEQ ID NO: 544669 - DNA, 719 bp, Homo sapiens
taatctagcagagtcttgaaccatacgatgcgaatataaacaggaaactggaaccctcgtattgaacatgaccaatgatacattcctcgacacatcaccaggcagatccacgatatttggaacgcacgattattgccctcgaggaccgattgggactgacgctcatggacaggttcccatggataaatttgtcgaaggcaccaggtccaatgcagtggtcaagtcggacgcgccaacaactcaatgtttcgtgggaaccatgcctgtggtttgcccgcgatcccattttgtgtaaggcagataatcgaagggtgctaaggcctcacactgagcgccatgccaagcttttgagtcaaggtggtgagcatcgaagcacaagttatggtgatcgcgcttatcgggtccgcccgggaagctttggcggaatcaccaacggcgccatcccaaagaacacgctccagattggccactcctgtgcccgcggacgggaacacagaaaagcgctaaccagcctgggtctgactcagcacggcgccggctggccatttgctgtacctgatttttttatcaaattcctgacagagcccggcgatttggtcgctgatattttttcaggccgggccatgaccggtcgagcagctgaagagaatcaacgtcgctggatctgcgtcgagagtgcattgcagtacgtgcgtggagccgccgagctcttccgttca

SEQ ID NO: 544670 - DNA, 129 bp, Homo sapiens
tagttctagaaggttcaatagcaagcaaacgatcagtatgcgtatatccgtcataaactctaatttagttcctcgagatattgccagcgtttatgcgagacctgttagagttaagcctgtgtattccca

SEQ ID NO: 544671 - DNA, 1094 bp, Homo sapiens
gaaatcgcctcatatggaaatcctcgcttgcctcctcgtcttggtgctccaacatatgcacaaggcctgttctactatttacacgacaggctaggcactcattcatcagtcgtagaagcgactagacaatcacaaactagagtgacatatggcaattgtcattacgtgcaaggtgggggctcagcccatggagatgcagcaagtaccgttcgaatacacattcatgcatactgacatccgggggatagtagcgagactatgatcctctcagagaagttacgtcagacattcagtatggttccactgcctatcgcaactcatgtcgatctagtttggctcccattggtgccaagagagataatcttcgcacatgaagtcaatctcaataggaatgagagggttggtgacacaacagatgcgatagagatactaactcgcaaagaaagaggatagttccactcggagcaaagagcgagctcatatcaacaatgtaaaagcgacaacatacacgaagctatagacaatgtgtatacactagcgctctttctgtcagggtaggttcagagcttggacccaatgccagggtaaccggatttataacgacaggccctccgcaagttatggaaaaggtgatggacgcttcgaattccccaactacagaagccaatcaatcataatatgaacacggaatggatttaccaactcattaatacgagatcgccattcagatgaccataaaccgaagggttgtcaagaggccatacagcggctttgggcactgaaaacttccaaatagcgttaaggtggatgcttttaaatctatacaacggaaactacctgattgattcaccaagggtagaacccctcgaagcgaacaaaggagagtttgccgacagtgaagaacagtgcctatggccccctacttaggcgcttttcgtgaacaacgcaaaatgattggcttggagaacgagggacgagagattaagaacaagtagacactccgacacagggacccagagaagcaacattgaaattgagccaaagagaagacagagagggtacaccaaacacaatatgaggggagagttaaaaca

SEQ ID NO: 544672 - DNA, 212 bp, Homo sapiens
ccggcccttacttcccacgatcacggggttggtgtaaataggcgtgtggtgtgtgttggggtgtgtgtgtctggggtgtggcatgtgtgtctggggtgtggtgtgtgtctggggtgcggtgtgtcgggcgtgtgtatgtgggatgtggcgtgtggggtgtgtgtctgggatgtgtggcatgtgactgggatggtgtgatcgtggggttgtaa

SEQ ID NO: 544673 - DNA, 248 bp, Homo sapiens
tggcgaattcggcacgagggccccctcttgggtcccctcctctgccatcacctgaagacattggcgccacacactgaatgccacctgtgcctgccggattagtccaccttgcggcccgagtttgactcagcttaacttctttatcgctaatatttacggcaaaatcccatgcttgggttttgtctttaaccttgtaacgcttgcaatcccaataaagcattactagtcgaaaaataaaatataaataa

SEQ ID NO: 544674 - DNA, 365 bp, Homo sapiens
gtcggagaagagaacaaacaatcaaagataagagcctttacccactgatagatgtcaagtgggtgggcagacaggtgcagtgactttagctcgatgctctggtgcttgacctgatacatccgtgaaaagtttgaagaatttactgggaaaatcctgtgaatggtttgaaccatcacctcaagtcactgctacccatgatgggggctttttaagtggggagtgtgagattaaacttgcccccaaacgatctcgtggggagactagggctggagaagaagatgaaggagaagaggattctgattctgattatgaaatatctgccaggctcgctacttgggttatataaaacagggcctttacttggt

SEQ ID NO: 544675 - DNA, 603 bp, Homo sapiens
cgacaagacggcggggtgagagtgcgggggggcggagggggaggcgggagcggtgtccgaggggtggggcgcaaccccggtgcgggcgttcagccaaaaaccgccgagaggagcggttcccttcaagtgggaaagcccttcatggcctcccccgccgaagagaggttctctcccctccctacccacctgagtccacgttgcctgctgaaaatggtccgaggtaacgccaaacgcccagggagtcggttctgcccggtcgaccacgatgagtgtccctccggagaggtaccctgcacagggacacccgcgcatctcccttagaagaagccccacctctctggattaaaactgctcctccagagcttcctaagtcaaggcccagtattgaaattggagggctaagactgagtccctccatcttgggtggaatgattgtgcgcacttggcgagaaatatgttgacaatgtctgtcaagacccagagatcagaaggctgggcacgggctaattcgggaggatttgtctaaaaagtgttggttttctgccacacccatgaaatttttaacttggggcaaccattaaaaggttcccaaactaaaataac

SEQ ID NO: 544676 - DNA, 894 bp, Homo sapiens
gatacgggcctagcaaatgtatatgctcctcccttctgtacatcatagttggatgttaaaatctgcacagcaacagtgacatacatgcagatcatatgaacaaaatgtagtttccctctgtgccaagacaacattagaatgaatatcgtctagcgatagtggtgcatgcatatcgtgcctttgtggtccgaatctgtagattctagacggtgagtaactcttttgtgcatacgttggtaattgtggcctgttaattttgttaatcacttggtacgaccatcaacaatggacgtggcatgttccgtacatcctaccaagtacgtaatagatcgttcacccctcttatagatctctcagcgaacaataattctttggaagcaggaataattgctcatacatagcgatcgatagcctgtcttttcgccgtgaaagcagtatttggcgccgtatatatagcctggcttgaatatcgtgtcatcatataggagctgtccacataagacattctgttgcatgagcgtaacacatcgaaatcggtggattataagtaataagccatcagatgccacacaacagggtctctgattgataacctttgaaggctctatagtactggtcctgcaccaggaagatgtctgtccttactcattgtctaaaaaatgtgttagtacagacactgcactaggagttaattggtcctacaagcatgcaacagtttatggctctacgtttggtgtttcccatacagtcagactcgtatttgaattacccgtgccatctgaatttcaccgttgcgaggtatcctgccttagttttccatgctgcttcaggtcgaatgttttgcgtcccgacaagattgttcaaggcctttcccagagacgtccggccttacgg

SEQ ID NO: 544677 - DNA, 546 bp, Homo sapiens
gacaagggtcgcctgtttctgcttaatcacatgcaggtccacgaaatccagtcttgaattggaaaccttgagacggccgacaagtaatctgtgcccatagttgttcacgaaattccctggagcataaactcacatgttcccgcatttgaacgatagcggtgccttttcaataagggcccctctctcaaaaagctgcatgacataattcttcttgaccagtgaaggagtgatggcccgcacctgtatactgagctcagggaccttcaacatcggctgcatgccaaggaacggactgagacacaacgagatgagcttctgaatcacaactctgccaataagggacatgacacattcatacctttggtcgaatacatgtgttgcactcataccttcagtggaggcacactggggtggatacctcataattgaggggcccagcattaaaattggctgtagcccaaagactgaccttttatgtgactaggggaaaaaactttaaattgccaacttgctggcatcgaccacacagagatgcaatcattcaaa

SEQ ID NO: 544678 - DNA, 173 bp, Homo sapiens
cgtgttagcggctctatggggagcatagggctagtgtgaactaggcagcgccgcgatcctgagccaagccgcattggggctgaggtctgttccccgagcacagtttccctttgcagaatgcagctcctcgaagcgcgttttgggccatttggaggctaggctctatgtgtgtc

SEQ ID NO: 544679 - DNA, 349 bp, Homo sapiens
  misc_feature (192)..(192): n is a, c, g, or t
  misc_feature (284)..(284): n is a, c, g, or t
aacatcaggaagtaacactatatggtctaaaaaggagaggaaccctcagttctggtaattgctcacacctttcccgggaaacttatgaataatctaccccttgtttagcatataatcaataaataaccataaaaataggcaaccagcagcccttggggctactcttcctatggagtagccattctgtatttntttactttcttaatattaactactttcactttgtggactcgcccgaattcttttcttgagcaaggtccaagaactctctcttggggactggntcacggccgctttctggtaacaggagcaatacaaatgggtattagtaaacggacggtttagtaac

SEQ ID NO: 544680 - DNA, 218 bp, Homo sapiens
tggctgtctagaggatcccgacgcaatactcgggaggctgggcacgagaatcgcttgaacctgggaggcagaggttacagtgagctgagattgtgtcagtgtactccagcctgggcaacagactgagacactgtctcaaaaaacaaacttttttttagaattggggagttacacacagtaccctaaaatacagtctttattcagatttggccaactgt

SEQ ID NO: 544681 - DNA, 129 bp, Homo sapiens
cacctgtcactcggataagccaagcgccatcttgataatcagtcatcatcagctgtgagatggattcctatgacgcctgcgaaagtgtctactacacgggcacagtctgtgagggggtaccgacgctcg

SEQ ID NO: 544682 - DNA, 302 bp, Homo sapiens
gaaaaacaaggtcttgctatgttgcccaggctggtcttgaactcctgggctcaagcaatcctactgcctcagcctctcaaagtgctgggattacaccatgagccaccatgcctggcctttattgttagatgaattgttttcaaaacaaggtcttgctttgtcacccaggctggtgtgcagcattgtgatctaagctcactgcagcttcaaactcctgggttcaagtgatcctcccacttaaaccttctacaggcacgggccacagagcccagttaatttgtaaattgtctgcagagacagga

SEQ ID NO: 544683 - DNA, 1631 bp, Homo sapiens
  misc_feature (1422)..(1422): n is a, c, g, or t
  misc_feature (1460)..(1460): n is a, c, g, or t
  misc_feature (1472)..(1472): n is a, c, g, or t
  misc_feature (1496)..(1496): n is a, c, g, or t
  misc_feature (1531)..(1531): n is a, c, g, or t
cttttgtggtgatctccgctgggtgtgtcttccttcctctcttcacatggctggttggtggtttctcctcctccgtcctgcccctcttgtatgctgtggcggcggctcgtccttttatataccactttctttgtctcggggggcgtccccccaacatcacctcgccaatattttttgttttgggccgagaggccctcctttgctcgagaggggtataattttctttggccgcccccccttccctcctcacccctactggcgggagggggccatcacgtgcctccctgctctttcttgtgggggcgcccggtgtctgtcacaaaaagggttgttgtttttgtacgcgcgcgtcagtattccctcctctcgccgccgctccttcttgctgtcgtccccaaggtgggtatatacgcctcggtgaattttggtggtgggggtttttctacctgcgccgttggcgcccgccgtgtcaaaaggggtgctctctgtgcgcgtttccttggttaaaggccgccgtttgcctcccaaagagaaaaaagttgttgtggcccctcaatattactttgtgggggcgcgcccccctttgtggcgcgttctacaaccgaagaggagttttttgggtccgtcggggagaatggtgtattccgccctaggcgcccactaggtgggagccactgcttccacccccccccctggggaagggtgaagagataaagagggggtgaaatagagtggataagcctccccaaggattctctctcgtttacccctgcggtgatagattatagagacacacacgcgttcttcataagagggggcgttaacaccgggagacacacacggcccccgagagaaagatcacacgtgtgcgagagaagagaagaagtgtgtgacccacataagccccacgagaggtttctctctccaggaggcgccctccggagactctcctcgggtgtcttgaggcccccccgaatgtgaaagagctctgtgtagagtatgtcgctctcactaggcgtgtgtgcctcgggccctcttcgctcgccactactggtgtgggccccctcggagataagtaacgcgggagaccccacagggggcacacgcacacgcacagtgtcccacagagtgggcgcacacacagtgcacaggcccctcggggacacacaaaggagaagctcgggggagagacacacaggagaaaagggtgtcttatagtgcacctgcctctcccgagaagtttgcttgagaagcgcacacttcggagagaaaattgggccacaggtggtcacatttaatctattgagcccaatataggagaagaggcacacaccacgttatactaatgagagtgaaaagggagagccacgaaagagactgattggagaggccctatcttgtgagtggggccatctgttgganctttccaccctggtccatatactctgcacagctgttangaatgtgccagncaccttggggaccacgccatgagncttgctgttgtacacccagggtattttttagaacnccagaaatagactgggaagatgccaccacccaggggttaccggcatcgcccctgctcctcaccctgtattttgtaatccagaaataaattgccttttaaa

SEQ ID NO: 544684 - DNA, 410 bp, Homo sapiens
  misc_feature (12)..(12): n is a, c, g, or t
  misc_feature (41)..(41): n is a, c, g, or t
  misc_feature (78)..(78): n is a, c, g, or t
  misc_feature (171)..(171): n is a, c, g, or t
  misc_feature (182)..(182): n is a, c, g, or t
  misc_feature (204)..(204): n is a, c, g, or t
  misc_feature (221)..(221): n is a, c, g, or t
  misc_feature (383)..(383): n is a, c, g, or t
cagcgatattgnccgctaatggctacagcatcgctgtgtcnagtgtacattgggcacgccgacacgcgtgagagtaangacatcaaggcgctcaatcgtgacattgcccgcatcgttgcaagacaagccgaattgaggaagcagattgatgccatcgtggctgatctgganaggggagccantgactgagtggccaaggccgcngcgacatgatcaagccnagggcgttcttctttgggggcattgatcgtgagggtgtccggcaacggtcaagacaacgccttgcaacgtgcacgctgcgggcagtttcagtgatcagcaagaagttgttcatgcctgcagcggcgtacgcaaaagacgctgcgcaacgccgcggccagcangcttgatgtggtagcagtgtctctaac

SEQ ID NO: 544685 - DNA, 755 bp, Homo sapiens
  misc_feature (546)..(546): n is a, c, g, or t
  misc_feature (584)..(584): n is a, c, g, or t
  misc_feature (596)..(596): n is a, c, g, or t
  misc_feature (620)..(620): n is a, c, g, or t
  misc_feature (655)..(655): n is a, c, g, or t
caagaaagttgcccatctggggcgcctggctcacgaggttgcctggaagtaccacgcagtgaccagcccgcctggaggagaagagcgaaagaggagcccagagtccccttcccgggagaagaaaccagctccatgaggctaccggaaaccaggcccgagaagaacctggagaagggaaattggccaataccacccgaggtcctccagacccccggctcctggtctgagccccattaagagctgttattcctcactgcgttgcctgcccttcctcccttgttgccctggaaatgtacgggaccccaggggcacgcagcacagtcccaggtgccaccacggcagccctgggaacactataggaaactgggagccaaggaaagggtcttagtcacctgcctcccgaagttgcttgaaagccctcggagaattgtgcacggtgtcatttatctatgacccataggaagagccacccgttactatgagtgaaagggagcccgaagactgattggagaggccctatcttgtgagtggggccatctgttgganctttccaccctggtccatatactctgcacagctgttangaatgtgccagncaccttggggaccacgccatgagncttgctgttgtacacccagggtattttttagaacnccagaaatagactgggaagatgccaccacccaggggttaccggcatcgcccctgctcctcaccctgtattttgtaatccagaaataaattgccttttaaa

SEQ ID NO: 544686 - DNA, 243 bp, Homo sapiens
aatgggactgtgagaagaaacatttgtcatttagcattattgggggatgcctgatacggttctgtatgaatagaaaaataaaacgagtaagagaaggagaaaaacaggtataaaaggtctaaagaattgggagggactaggacatctataagagtgcctaaggaaatacagcataatcctgtcagcgaagataatttatttactatcaagagtataagagtaggcagtctagggagataggca

SEQ ID NO: 544687 - DNA, 880 bp, Homo sapiens
tgactactcatctggaaaataggctttatccaaggtccgattggggtggatgacgtatgatataatcgagatcccagacaggaaattggacaagaactatcagaacttactagactaagtgtaatagcatacatgaccagtcacgttccagtccatgagaacaacgtatcgctgcggattggatattaggcaagagtatcttgattactgtgcttcttcaacaaacacaacattgagacagtcgtggaccacgccaattcattacaagtctagtatcaatcaaattcgtgatagttggaaacctgttagttactgacaagtcatcaaatgggcatatagcatagttttccttgcaattgataagcgctattgtgaactttacctatcagaaaaatgaatgttgtaaaacgaattcaagtgcagacgggccatgtagttctgagcagtatcagaatatcgatggcctcagtatatcagagagcgtacataggcccagttatggtagtgaaggtttgctaagctgaaggcctctactggtggtgatactctctatccaccaatgttgctagaatcgtgtgaagcagatacctctgtgggtggacgacatcgtttgcattggtgttaatacatacatgaggaccaaggttgacaaaaaccagtatccgagcatgtggtggattggtttacaaggattatcatcgtgtatgaacgagtgtctttgacacgaaggcattgacaattaattggggtgtaattcttgatcccgttgcggatcagtggtactagggaaagcatctgagagatggtcttgatccttaagcgagattcctttttcctttgtagaggttcgattgacgattgttcaggagtcaggtttcca

SEQ ID NO: 544688 - DNA, 347 bp, Homo sapiens
  misc_feature (126)..(126): n is a, c, g, or t
ctataatagcgacgcatcgtggccccctaagtcttcccatctttgtctgaatcacccccatctctcactcacacctcacacaaggtgcccagagggtctcacccttctgctgacatttatatgganggactcaaagctggttggtgtccaccttcagaggcagaatgaggctccaggggctgtgacctgcccagctcccttgcagctgctgttccctccatgctgaccctcgccaggccccaacatggctggctcctttggatcagtcacgtgtccattcagaccccacttgctaagaggattttccagcctgtgagaccaaacagacctccgtcggcttaaatttt

SEQ ID NO: 544689 - DNA, 1172 bp, Homo sapiens
gaagaaattgtcttatgtgaacctctactatgcattgggcggtaaggcacttgtgttggactattatggtagtaagatgtgggcgtcctatcaggaattcgtgtggattattgtctagtgggattgtagatgatggtctgagaaggaagacgaaagagttccagtgatgctacttgtgaatgataggggatgtgtggatactggagaaaagtagaataactctatgggtggttggagttgtcttacagaatgtggtgaacaatgagggaagcatgtgtgaacagtatggtagacgaattgcaattggttagaactatgacagtgaaagtagaattattggggtgaaaagtggtggacgttataggagcaagtagaatggtatagcgcatagagttggacgctcgaagggcaaggacatacgtattgtggggtggatataagaaatgcacgtgtgcgaatagcgtcgttgatgggggaagaaactacagggtttgtaaggtaggtagggttatgagtaggaggtgcgtgatgcaggtgtgagaaaagtataggttcacgttaggggttgagtaaaatagtatgggattcttgtggaacaattgtccatcagggaagtttcccgaattggcatatcagaaagggtggatagaactttagggaagacgtgttaggactatgtgggcggtttgcatgaaaggacataacggtgagcatagagtcagggagtgaaagcgagaattgctcaacatgggaagtgggcgaaactgatggttgccgcggaaaataaagggaggttggaagaggacaactcgaaggtaggtagaggttgttgtgtacttggataggacatggcatggtttgggagagctattcgaattcagaagtgagtgccaaggtgagctactatcaaggacgacgaatagaggcttgaaagcgaagaaggaattatgtgtcctatgtgactttgtaacatatgtgttaggaggcaaggtgaaataacaggaggtagatgtgaatacgtatgtggaatttagtgggacccacttggggtaggaaataatgggattcacagtggaatgtaggtattgttggttggactattgaagaaagaggggcagtcatctcagaagaggttttttgaccgaatctgtggtaagcggcagatagacagg

SEQ ID NO: 544690 - DNA, 1480 bp, Homo sapiens
  misc_feature (299)..(299): n is a, c, g, or t
  misc_feature (421)..(421): n is a, c, g, or t
agcggggcggcgcgccagcaaatccactcctggagcccgcggaccccgagcatcgcgcctgacagacccctgactggaccgtgcgcgcggcgtcgccaggccatgcgtatggcccccagtacccgggtggcctgccgacgaccgcgggcgtctagggatactaccccggcagctacattcaaccgtaggcgacggaggtggagcccaaacgcctcaaggggatgatgaggtagacggtgtgactagtggtagtctcgagcgtaacggtggtacaacgatcaaggactgatgtttgcacncgcgtcacgggcgaagtccgaagggggccttccacgggggggtcgattgcgaagcccaactagcggccgcggtgggcaggggagtggcgcgatcgcgaatctcgcggtattgctgagctctntatcgcataaagtcaaatctatacgggagcgcaaaaggttgcatacagaataggctattagtttcgaaagccttcgttcctttcccttgtactgtggtgtgagggcaaagacatcgggttcttccctatgtaagaaccaacgagccttctatagccttggtggggaacgaccgcccgaggcacaaaccacggaagacgctaagcagaaagacacggccttagttaggcgaagcgcaaatttgtagggacttttgcacccgcggcgaaatgtccttgccttgggggggactatacccacccgtttaggtggacggcgccgaggtaagtgcggggatggggacgtttcaccttcggacacacaggcgcctttagcacaccagttttgattcgtgtgcacgatgattcctccacctgtgggcgctttgtgctatattcggcacttagagcactactggacacaaggccacaactttctggtttcttcggcggatatatgggcattgtatgcaggacgctatagatgcgtgaagtcccacgacgccccactaaggacgggtgcttacacaaacgcccaacattgaatatgcgggtggatgtcagtaatagctgcgggtcgacacccatgtttcgccattatcgagaatagacgggccctccattattcgccatcgccgcgtttcggtttagattcgaacaagtggatatagacgtatcgccgattccaaacagtctggggtgccaccgcccaattccaaaagcgggcccgctcgcacattggaccaattggggcccttgtgaggcgcttggacacatcagtgtaaggcttgacaatcatttgtaaggggagcgccaaaacaagcgtagggagtctcagggagagtaccatttttagcaagcgccgcaagtctccggtaacaaaggcatggacttaggcagacaaaccgcgcgggaagtactcgttcgggcacctacacccaaattgccgccatttccacaaaggagtgaggacacttatagggggtagtccacaccccccccttggaaacagacagatgggcg

SEQ ID NO: 544691 - DNA, 739 bp, Homo sapiens
  misc_feature (2)..(4): n is a, c, g, or t
  misc_feature (9)..(10): n is a, c, g, or t
  misc_feature (174)..(174): n is a, c, g, or t
  misc_feature (177)..(177): n is a, c, g, or t
gnnnaccannacccacgaacgaaacgcgcgcggcacaccagcaaaaacaggaaacagggaaacccgcacaaccacaccaacaaccacacacgggacccgcaaacaaaagcccgagaacacaacaccaccgaaccaaaagggacaccaaccgctttttaccggggggaacccccnaanaaccgccaaccccacaaagaagggcgaggcaacactgagaggcggaccaaccccaccccacaagtagcacaccagccaaacacacgcaacccccgcaacaaaaccaacaaacgaggacgggcaacaagaaaaacccaacacgacgaagaagcccgaaaaacaacacgcaccaactgcacgagaagggcgcgggacaacgaccaaaaaggcagacccaaaaagagcgcacacaggcggaaaacgccgataaaacaaaaggcccaacacggcggaacaaaaaaaaggccggaaaaaaccacgaagaatgaacccgaaacagaagagcctcaaaagcccccccacaccgaaaaaagggggcctaaacccaaagaggcgaacaacagaacaacccgtgccaaacgccggagaaaaaacaaaagagagaccccagaccaccgaaaagtaacaacaaccccgcacaaagcgccaagatcacaagaaggaactaaaagacaaagcgcacacaaaaaccccaccaccacccgggaacacacgacaaaacaagaacaaccgcccaccaaaa

SEQ ID NO: 544692 - DNA, 506 bp, Homo sapiens
ctggttggggggcttgccctggcgagcaaaactgtgcccctttcgatttgaggggtggccaagtcaaccagctccttaaaattgaaaaggaggtgggcagcaaggctaatttttccggcaggaacttcaaaaaccccttggccaagtaaaatgtggggaggcaaaccctttggttccctgttgggtacacaaacccccccccttgggttaggttagggaggttgggggcccccaccaaccctttcagggggccctgttagttagggccccccccccgtggggtttgggccgcttcctttaaattttttcaaaaaccaagctccctggggccctgttgggagctttaactttgcagtgggggaattgggcccaggcattgttttttttccccccctttcccccaagggtttaaagttatgtgagccccgggttttttccgggggggccccagggtaaatccccggggggtttggggtcaaaaaaaaaagcccccggggccccttgga

SEQ ID NO: 544693 - DNA, 275 bp, Homo sapiens
agacagggagacttggtgcattaatatccaaagcttagtttaagctggtgatgattagaaaagtggctttcatttgtgttctctggagattctcagtagtcctgtgggcatgttaacagagcatgtgtaatctccaaaatgtatgtcttgttagcagaaattgtctaggcatttctgaaatggggggatgccctgaggctactgtttttgtcttacagggcccctatatgtttgtgagaactgagcttctccgaaaagttagagttctcggggct

SEQ ID NO: 544694 - DNA, 2434 bp, Homo sapiens
  misc_feature (2198)..(2198): n is a, c, g, or t
  misc_feature (2267)..(2267): n is a, c, g, or t
gaagcccacattcacatctacccaccccaatgccttctgtcctcttccctctgcccggggttcttctcaccccttggcttctgagcaaggctcttcctccacccacagatcagtgctgcttccctcgggggacagacccagatcctggggtccctcactacagctccagtcattaccagcgccattcccagcatgccagggatcagcagtcagatcctcaccaatgctcagggacaggttattggaacccttccatgggtagtgaactcagctagtgtggcggccccagcaccagcccaaagcctgcaggtccaggccgtgaccccccagctgttgttgaacgcccagggccaggtgattgcgaccctggctagcagccccctgcctccacctgtggctgtccggaagccaagcacacctgagtcccctgctaagagtgaggtgcagcccatccagcccacaccaaccgtgccccagcctgctgtggtcattgccagcccagctccagccgccaagccatctgcctctgctcctatcccaattacctgctcagagacccccaccgtcagccagttggtgtccaagccacatactccaagtctggatgaggatgggatcaacttagaagagatccgggagtttgccaagaactttaagatccggcggctctcgctgggccttacacagacccaggtgggtcaggctctgactgcaacggaaggtccagcctacagccagtcagccatctgccggttcgagaagctagacatcacacccaagagtgcccagaagctaaagccggtgctggaaaagtggctaaacgaagctgaactgcggaaccaggaaggccagcagaacctgatggagtttgtgggaggcgagccctccaagaaacgcaaacgccgcacctccttcaccccccaggccatagaggctctcaatgcctattttgagaagaacccactgcccacaggccaggagatcactgaaattgctaaggagctcaactacgaccgtgaggtagtgcgggtctggttctgcaatcggcgccagacgctcaagaacaccagcaagctgaacgtctttcagatcccttagggctcagccctggccctgtgttctagcactttgtccatttcccgtggcatccggctgcagccactgccatgacagcacctgtcattttgccacgtgcagctgtgctcaccccaggtcatcagactccaccgtgtgcatgtgcatcaatgtccctcttttctcccacacatctcacatcatggggaggccagagggggccacacgagagctccaggctctgggctggtcactccgaagaagaggatttgtgacgtcacttagagaagcaccttgctagcatggtttctgaagggtgaattctggtggggaaccagaaactccctgtctttggggcagggctaaagcagctcctaaggaccactggccattagctcttgcttttgatggcattctctttccaccttgtcttctcctttgctcctctgtgttagtgtggcaggtatgacaactcatccagtggaaacacagcctcacactgcccttccgccccccacactttgcctgcaggtgcaccgaaaggacctgggagataaaattcaaaaaagtgtgatgtgctgctcagaaggtcagactccatgtctgccttgacctcaaggtcagaaggttcccaaacccctggggctggaacatgggatctcctcttccacctcttcctggttcctttgcggggaaaattgcactaaaacagaaccttttcttaatccatgttggaaggaagcaacagtgaactctacctgttctggagttctcctgggtctgcagaaggttgggaatttagaaaataaggctgttctttcatattttaatttaatctctgtcaatggccatccctcccacaaaaaaacgtgggttaagagaacttgcagactggatatgcaagcaaacgggcaactctggagaaaaataaggaaaggaatgctgactttctctttctttctcttgtccccacacccattcccaacccaatactggggccttctcaaaaggagcaaattaaacaataaaccagacagcaaggccctgggggaaaggacaacatcctgaaataaatgatggagcccaggaaggtctcttgtggaagttgacttaactctaatttnctttgtaactttaagccttggatacgggaggagaaatctcattttgtcgagtctcagaccatgtctgtntgtaagcaatccccacagtgtcctctgagccaaggacacccccagatcagattgagttttgcttctagacggggtagctatggtaccttgggggttagctctcatccaagctgttaagtgagtttccagcctcactgtggctggaaagcccctaaaattcagtatgt

SEQ ID NO: 544695 - DNA, 2395 bp, Homo sapiens
  misc_feature (2159)..(2159): n is a, c, g, or t
  misc_feature (2228)..(2228): n is a, c, g, or t
ccaagccagtggacaccccccccacagatcaccgtccagcctgcagcgttcgcatttagcccaggaatcatcagtgctgcttccctcgggggacagacccagatcctggggtccctcactacagctccagtcattaccagcgccattcccagcatgccagggatcagcagtcagatcctcaccaatgctcagggacaggttattggaacccttccatgggtagtgaactcagctagtgtggcggccccagcaccagcccaaagcctgcaggtccaggccgtgaccccccagctgttgttgaacgcccagggccaggtgattgcgaccctggctagcagccccctgcctccacctgtggctgtccggaagccaagcacacctgagtcccctgctaagagtgaggtgcagcccatccagcccacaccaaccgtgccccagcctgctgtggtcattgccagcccagctccagccgccaagccatctgcctctgctcctatcccaattacctgctcagagacccccaccgtcagccagttggtgtccaagccacatactccaagtctggatgaggatgggatcaacttagaagagatccgggagtttgccaagaactttaagatccggcggctctcgctgggccttacacagacccaggtgggtcaggctctgactgcaacggaaggtccagcctacagccagtcagccatctgccggttcgagaagctagacatcacacccaagagtgcccagaagctaaagccggtgctggaaaagtggctaaacgaagctgaactgcggaaccaggaaggccagcagaacctgatggagtttgtgggaggcgagccctccaagaaacgcaaacgccgcacctccttcaccccccaggccatagaggctctcaatgcctattttgagaagaacccactgcccacaggccaggagatcactgaaattgctaaggagctcaactacgaccgtgaggtagtgcgggtctggttctgcaatcggcgccagacgctcaagaacaccagcaagctgaacgtctttcagatcccttagggctcagccctggccctgtgttctagcactttgtccatttcccgtggcatccggctgcagccactgccatgacagcacctgtcattttgccacgtgcagctgtgctcaccccaggtcatcagactccaccgtgtgcatgtgcatcaatgtccctcttttctcccacacatctcacatcatggggaggccagagggggccacacgagagctccaggctctgggctggtcactccgaagaagaggatttgtgacgtcacttagagaagcaccttgctagcatggtttctgaagggtgaattctggtggggaaccagaaactccctgtctttggggcagggctaaagcagctcctaaggaccactggccattagctcttgcttttgatggcattctctttccaccttgtcttctcctttgctcctctgtgttagtgtggcaggtatgacaactcatccagtggaaacacagcctcacactgcccttccgccccccacactttgcctgcaggtgcaccgaaaggacctgggagataaaattcaaaaaagtgtgatgtgctgctcagaaggtcagactccatgtctgccttgacctcaaggtcagaaggttcccaaacccctggggctggaacatgggatctcctcttccacctcttcctggttcctttgcggggaaaattgcactaaaacagaaccttttcttaatccatgttggaaggaagcaacagtgaactctacctgttctggagttctcctgggtctgcagaaggttgggaatttagaaaataaggctgttctttcatattttaatttaatctctgtcaatggccatccctcccacaaaaaaacgtgggttaagagaacttgcagactggatatgcaagcaaacgggcaactctggagaaaaataaggaaaggaatgctgactttctctttctttctcttgtccccacacccattcccaacccaatactggggccttctcaaaaggagcaaattaaacaataaaccagacagcaaggccctgggggaaaggacaacatcctgaaataaatgatggagcccaggaaggtctcttgtggaagttgacttaactctaatttnctttgtaactttaagccttggatacgggaggagaaatctcattttgtcgagtctcagaccatgtctgtntgtaagcaatccccacagtgtcctctgagccaaggacacccccagatcagattgagttttgcttctagacggggtagctatggtaccttgggggttagctctcatccaagctgttaagtgagtttccagcctcactgtggctggaaagcccctaaaattcagtatgt

SEQ ID NO: 544696 - DNA, 2138 bp, Homo sapiens
ccaagccagtggacaccccccccacagatcaccgtccagcctgcagcgttcgcatttagcccaggaatcatcagtgctgcttccctcgggggacagacccagatcctggggtccctcactacagctccagtcattaccagcgccattcccagcatgccagggatcagcagtcagatcctcaccaatgctcagggacaggttattggaacccttccatgggtagtgaactcagctagtgtggcggccccagcaccagcccaaagcctgcaggtccaggccgtgaccccccagctgttgttgaacgcccagggccaggtgattgcgaccctggctagcagccccctgcctccacctgtggctgtccggaagccaagcacacctgagtcccctgctaagagtgaggtgcagcccatccagcccacaccaaccgtgccccagcctgctgtggtcattgccagcccagctccagccgccaagccatctgcctctgctcctatcccaattacctgctcagagacccccaccgtcagccagttggtgtccaagccacatactccaagtctggatgaggatgggatcaacttagaagagatccgggagtttgccaagaactttaagatccggcggctctcgctgggccttacacagacccaggtgggtcaggctctgactgcaacggaaggtccagcctacagccagtcagccatctgccggttcgagaagctagacatcacacccaagagtgcccagaagctaaagccggtgctggaaaagtggctaaacgaagctgaactgcggaaccaggaaggccagcagaacctgatggagtttgtgggaggcgagccctccaagaaacgcaaacgccgcacctccttcaccccccaggccatagaggctctcaatgcctattttgagaagaacccactgcccacaggccaggagatcactgaaattgctaaggagctcaactacgaccgtgaggtagtgcgggtctggttctgcaatcggcgccagacgctcaagaacaccagcaagctgaacgtctttcagatcccttagggctcagccctggccctgtgttctagcactttgtccatttcccgtggcatccggctgcagccactgccatgacagcacctgtcattttgccacgtgcagctgtgctcaccccaggtcatcagactccaccgtgtgcatgtgcatcaatgtccctcttttctcccacacatctcacatcatggggaggccagagggggccacacgagagctccaggctctgggctggtcactccgaagaagaggatttgtgacgtcacttagagaagcaccttgctagcatggtttctgaagggtgaattctggtggggaaccagaaactccctgtctttggggcagggctaaagcagctcctaaggaccactggccattagctcttgcttttgatggcattctctttccaccttgtcttctcctttgctcctctgtgttagtgtggcaggtatgacaactcatccagtggaaacacagcctcacactgcccttccgccccccacactttgcctgcaggtgcaccgaaaggacctgggagataaaattcaaaaaagtgtgatgtgctgctcagaaggtcagactccatgtctgccttgacctcaaggtcagaaggttcccaaacccctggggctggaacatgggatctcctcttccacctcttcctggttcctttgcggggaaaattgcactaaaacagaaccttttcttaatccatgttggaaggaagcaacagtgaactctacctgttctggagttctcctgggtctgcagaaggttgggaatttagaaaataaggctgttctttcatattttaatttaatctctgtcaatggccatccctcccacaaaaaaacgtgggttaagagaacttgcagactggatatgcaagcaaacgggcaactctggagaaaaataaggaaaggaatgctgactttctctttctttctcttgtccccacacccattcccaacccaatactggggccttctcaaaaggagcaaattaaacaataaaccagacagcaaggccctgggggaaaggacaacatcctgaaataaatgatggagcccaggaaggtctcttgtgga

SEQ ID NO: 544697 - DNA, 558 bp, Homo sapiens
  misc_feature (102)..(102): n is a, c, g, or t
gcctgtctggaccagagttactgtggatttttaagagactcagttaaagcaatttcaggaaatttctgattcatttaaaggatttacaaattcatcaacccnctgaaaactaaagcaaattgaacaggaaaaaaaaaaagaagatgggttttttaagtccaatatatgttatttccttctttttgggagtcaaagtactatggccaatatgaaacttatcaggtgggatgaagactatgaccaagagcccagatgactgattcccaaacaggattcccatttcgtacaaaagtgttagactacggagttcccttttcatcgagtattacttataggcctgtgttcagtgaattgcttctgtccaacttaaccttttccattcattcaagtgttacgtggtgataattcgcaaacttcaagacaattcccaaatattccgatgcacattcagcaactctaccttcagttcaatgaaattgaggctgtgactgcaaattcattcatcaatgcaactcatcttaaagaaattaacctcagccacaacaaaattaaatctca

SEQ ID NO: 544698 - DNA, 99 bp, Homo sapiens
cttgtgatgtaattattgtagaatgggggcttcaatcgggagtactacccgttgtcaacgtcaaggagtcgaggtcgcctggttctaggaataatgggg

SEQ ID NO: 544699 - DNA, 2400 bp, Homo sapiens
  misc_feature (2164)..(2164): n is a, c, g, or t
  misc_feature (2233)..(2233): n is a, c, g, or t
taggcactctaacagatcacggtgaaactgcagctcgctatttagcccaagaatcgctcttcctccacccacagatcagtgctgcttccctcgggggacagacccagatcctggggtccctcactacagctccagtcattaccagcgccattcccagcatgccagggatcagcagtcagatcctcaccaatgctcagggacaggttattggaacccttccatgggtagtgaactcagctagtgtggcggccccagcaccagcccaaagcctgcaggtccaggccgtgaccccccagctgttgttgaacgcccagggccaggtgattgcgaccctggctagcagccccctgcctccacctgtggctgtccggaagccaagcacacctgagtcccctgctaagagtgaggtgcagcccatccagcccacaccaaccgtgccccagcctgctgtggtcattgccagcccagctccagccgccaagccatctgcctctgctcctatcccaattacctgctcagagacccccaccgtcagccagttggtgtccaagccacatactccaagtctggatgaggatgggatcaacttagaagagatccgggagtttgccaagaactttaagatccggcggctctcgctgggccttacacagacccaggtgggtcaggctctgactgcaacggaaggtccagcctacagccagtcagccatctgccggttcgagaagctagacatcacacccaagagtgcccagaagctaaagccggtgctggaaaagtggctaaacgaagctgaactgcggaaccaggaaggccagcagaacctgatggagtttgtgggaggcgagccctccaagaaacgcaaacgccgcacctccttcaccccccaggccatagaggctctcaatgcctattttgagaagaacccactgcccacaggccaggagatcactgaaattgctaaggagctcaactacgaccgtgaggtagtgcgggtctggttctgcaatcggcgccagacgctcaagaacaccagcaagctgaacgtctttcagatcccttagggctcagccctggccctgtgttctagcactttgtccatttcccgtggcatccggctgcagccactgccatgacagcacctgtcattttgccacgtgcagctgtgctcaccccaggtcatcagactccaccgtgtgcatgtgcatcaatgtccctcttttctcccacacatctcacatcatggggaggccagagggggccacacgagagctccaggctctgggctggtcactccgaagaagaggatttgtgacgtcacttagagaagcaccttgctagcatggtttctgaagggtgaattctggtggggaaccagaaactccctgtctttggggcagggctaaagcagctcctaaggaccactggccattagctcttgcttttgatggcattctctttccaccttgtcttctcctttgctcctctgtgttagtgtggcaggtatgacaactcatccagtggaaacacagcctcacactgcccttccgccccccacactttgcctgcaggtgcaccgaaaggacctgggagataaaattcaaaaaagtgtgatgtgctgctcagaaggtcagactccatgtctgccttgacctcaaggtcagaaggttcccaaacccctggggctggaacatgggatctcctcttccacctcttcctggttcctttgcggggaaaattgcactaaaacagaaccttttcttaatccatgttggaaggaagcaacagtgaactctacctgttctggagttctcctgggtctgcagaaggttgggaatttagaaaataaggctgttctttcatattttaatttaatctctgtcaatggccatccctcccacaaaaaaacgtgggttaagagaacttgcagactggatatgcaagcaaacgggcaactctggagaaaaataaggaaaggaatgctgactttctctttctttctcttgtccccacacccattcccaacccaatactggggccttctcaaaaggagcaaattaaacaataaaccagacagcaaggccctgggggaaaggacaacatcctgaaataaatgatggagcccaggaaggtctcttgtggaagttgacttaactctaatttnctttgtaactttaagccttggatacgggaggagaaatctcattttgtcgagtctcagaccatgtctgtntgtaagcaatccccacagtgtcctctgagccaaggacacccccagatcagattgagttttgcttctagacggggtagctatggtaccttgggggttagctctcatccaagctgttaagtgagtttccagcctcactgtggctggaaagcccctaaaattcagtatgt

SEQ ID NO: 544700 - DNA, 556 bp, Homo sapiens
taggcactctaacagatcacggtgaaactgcagctcgctatttagcccaagaatcgctcttcctccacccacagatcagtgctgcttccctcgggggacagacccagatcctggggtccctcactacagctccagtcattaccagcgccattcccagcatgccagggatcagcagtcagatcctcaccaatgctcagggacaggttattggaacccttccatgggtagtgaactcagctagtgtggcggccccagcaccagcccaaagcctgcaggtccaggccgtgaccccccagctgttgttgaacgcccagggccaggtgattgcgaccctggctagcagccccctgcctccacctgtggctgtccggaagccaagcacacctgagtcccctgctaagagtgaggtgcagcccatccagcccacaccaaccgtgccccagcctgctgtggtcattgccagcccagctccagccgccaagccatctgcctctgctcctatccaactcagatcagccctgttcccgaaatgtcctgctcgagggccaaattccct

SEQ ID NO: 544701 - DNA, 492 bp, Homo sapiens
  misc_feature (15)..(15): n is a, c, g, or t
  misc_feature (30)..(30): n is a, c, g, or t
  misc_feature (100)..(100): n is a, c, g, or t
  misc_feature (123)..(123): n is a, c, g, or t
  misc_feature (217)..(217): n is a, c, g, or t
  misc_feature (246)..(246): n is a, c, g, or t
  misc_feature (283)..(283): n is a, c, g, or t
  misc_feature (437)..(437): n is a, c, g, or t
  misc_feature (462)..(462): n is a, c, g, or t
tccccacctcccctncccctagaaaagccnaaccctttggcccctatcatcaaacttcacctactcatatttcctcatgtaaggggaatcataaaagtanttgccccttttgtgactggttcnccttagcataaagtctttaagatgcatcccatgtttcccagtgtttcggtttttttagaaaaactcatacgtgattgcagccgggcatagtgtntcacgcctgtaatcccagcacttgggagnccaaggcaggcggatcacctgaggtcaggagttaaanaccagcctgacaaacatggagaaaccccatctctactaaaaatacaaaattagctgggcgtggtggcacatgcctgtaatcccagctactcaggaggctggggcaggagaattggttgaacccaggaggcggaggttgcagtgagccgagattngccactgcactccaccctgggcaanaagagtgaaactctgtctcaaaaaaaaaaa

SEQ ID NO: 544702 - DNA, 659 bp, Homo sapiens
ggctcgaaaccgcgatcgagaatgacgaggaatccctacgcgccgctctggctcgactccgcggctacagcgtccaggcaaccatcttgctggcacaacgagccaaatccgttgccatcgcatcccagcaacgccacggcgacaagctggtctctgtcatcgcagggcaccccgactcccccgagtcaccaattgtcgcgatcgaccaagcactgggagcccgtctagccactaaacacctcatcgaacagggctaccggaatcttctccatgtccctggcgacctggaatggcaggacgcgtcagaacggctttcctcctacatcgccgtctgcaaagaggtcggcatcgaccctgcatggatgccagccaattcctggggagccgaagccggggcagccgtggctgaagaacttatcgccggacatctccccgacgcggttctcgctggcaacgatgacatcgccattggcatgtgtcacacattcctcactcatggcgtgaggatccccgacgacatcggcattgtgtgattcgacgacatccctctgcttcgctggatgaccccatcccttaccacggttcgttccaggacttcgaagcacccggacaccaagctgtcgagttcaacgttggtcagcccgtattctgcagatatc

SEQ ID NO: 544703 - DNA, 1067 bp, Homo sapiens
ttaaactgacacttcccttttaaaagccacctttatgtctatctctggcctgccacgattctacctagtgctccataggaggacccattggacccccgggactggctgcagggcccacacctgggttagacctcgcacagggcacgctgctgccactgtcactaaagcgtagcctacacgctatctgcacactggtgtaaggaacaacctcagctctctgtgcaaaggcggacgcagcaggacaagaatctccgtggacatctgtctgcgagcgagcacacatcaacctgcagacatacatacaagcaccccaatctaatcgattaccaaagggtgtccatcgcgtcttccttcactgccttgatcatgtcgagggtccaccactgtcgcgagatacgtcctgcagaccctgactcaaagacgcgcactgactaatgtacactgacacacatcttctgctcgcacagacctgcatgacccatccagggccacaccttaccagcacctccaacgaagacggtcctgtaaagccaccggttctgacttggtagggcctcccggcactctatttagccaatacatttaatggaccgaacgcctcaggctggacacacacatctacatacgatatcactaacaattgcaacaatactaagccacatagaaacctactacgacaccatacagatatccaacaactgacccactaccaggaagctactctctgatcaatccctccgcgacgacacgatccaactacctgcctggaatacctgaactacgatttatccaagattcgagaggacctatatgctcgacggtcatatcaacaaatatatataggcagttagccacagacatcgtgtccacaagtagacatcgcggccagcgatcccgccgcacgcgtcagaatgggtagaaacgcgccattatatagtcgtggaggatagagtgacatgagatgatgacatagcagtgcatacactctttgggagaggaatctatcatgagagtaattatacctgctcggctcgtcctacagcgttaagctaaccgatgcatattag

SEQ ID NO: 544704 - DNA, 1102 bp, Homo sapiens
gtatgcgatgggtattttaggataactactatattagacactactcttattctcctgaagatagacgctagaacggattgccgtgatgcgctgaattttataactggtcgcatagaactacatggaaccgtctggctgaatcggtagggagagtaatgccggattagcctccgcgcgcggttgtgcacgctttgggtgctgggcttcctcagctcctggtgagctctttgaggtctctgagggtcccactactgatgacgtaagtggttctggtacactacattgcttatcacgctatcttctggagtgcacgtactacagtgacattatgttcccaggcaacgatatattcatcgtaggcacgtgaccatgtaccctttctcaaaagtcccgtggtaatggtgactcagtcacaattcatgccacgagactacactatactgagtggctagtgggctctactgatatgaagggccagattcataggaggatcctatcggagtggcgggtccgactttcctctgtgggacaacatagaccgcgcgcctgcgtcgatagtctcagacatgagtcgtcgatctccatagtctgtcacccatgggtgggtggcgctgaggggtactaaatccacgcggaaagggctcactgaccgaagacacaagtctcaacgatctctattctaactccaccgatacatggtgtgcgtaaagcttctaacgattcgttgattccacctgagcccttcccataattttatggtctgggttccgagcgccactggtcaaagctgtgttgggtatgagctggtgctgaggggtatgggctggaagggttacccgcgctcccgtactctcgtgtctttccctcttccgggtccttccgcttgctcggggtcctccgtgacggctgggggccttccgccctgggtgtcggaggggctcggtgtccctagctggcttgtgtcccaacgattgcggtgtggggggggtccggcaacgtgggtggtctgtgtgttcctgcggcttgcctgggtcccgtgccgcacgaaaggcttaaattcgcttgtccggatggcgtcttgccagctgtttgttcgcccttg

SEQ ID NO: 544705 - DNA, 151 bp, Homo sapiens
  misc_feature (70)..(70): n is a, c, g, or t
tgccgacatggctgtttccaactataccaaagcgccagcgatggccgccgtcgcaagttggaccggcttntatgccggcctcaacgttggctatgggttcaatgatccggttgcgacctttacggcgaatgacgtcgtctccaattcgatc

SEQ ID NO: 544706 - DNA, 123 bp, Homo sapiens
gttttttttttttaaacccggtttaaaaaaactaaaacgttttttcaaaaaggggatttaaatgggttcctaattttgtaaagggggttgggttttgtaacccataaaaaaaggggctttcca

SEQ ID NO: 544707 - DNA, 310 bp, Homo sapiens
  misc_feature (19)..(20): n is a, c, g, or t
  misc_feature (35)..(35): n is a, c, g, or t
  misc_feature (74)..(75): n is a, c, g, or t
  misc_feature (82)..(82): n is a, c, g, or t
  misc_feature (86)..(88): n is a, c, g, or t
  misc_feature (121)..(125): n is a, c, g, or t
  misc_feature (171)..(172): n is a, c, g, or t
  misc_feature (239)..(241): n is a, c, g, or t
  misc_feature (245)..(245): n is a, c, g, or t
  misc_feature (268)..(268): n is a, c, g, or t
  misc_feature (279)..(279): n is a, c, g, or t
  misc_feature (298)..(298): n is a, c, g, or t
gacgtggttcccaaagatnncaatgctgccattgncaccatcaagaccaagcgtaccatccagtttgtggattnngtgcccnactnnnttcaaggttggcatcaactaccagcctcccacnnnnnggtgcctggtggagacctggccaaggtacagagagctgtgtgcatnnctgagcaacaccacagccattgctgaggcctgggctcgcctggaccacaagtttgacctgatgtatnnnaaangtgcctttgttcactggtacgtnggggaggggantggaggaaggtgagttttnagaggcccgtga

SEQ ID NO: 544708 - DNA, 325 bp, Homo sapiens
gatatgggcacagaaatcgtgagcagacagtagtttgataataatcaaagaaggcaatcacaatttaaatatatcatgccctctcacaggttagtgtatataattagtaagcccatattacttgatgttagtggtttagtctctactacgtaacataatgacagtggtgtaaagtttctgttcaagaaacatatgtagtaaagttactttatacaagcatcacctgccaaaggaaatggtcttactttcaaatgacttagacagcctgtctaattgaaaacagagcaggagacgactttaatcagaattactgtgcccaatttca

SEQ ID NO: 544709 - DNA, 212 bp, Homo sapiens
aggatggaccatctgcatggacgtgaccatattaccctgtctcgcctcacatatatgagtgggcggctggtacgttcagactgtcccatgacgggagaacattacactgagaggtcttgtccttccagtgggtggaattcaagacagggtgctggcggcacacagagcgggactgaagcaagtcattattcctcggagaaatgaaaacgacc

SEQ ID NO: 544710 - DNA, 540 bp, Homo sapiens
  misc_feature (86)..(86): n is a, c, g, or t
cgagtttcctgagatagctgtgattacctacatgtgccaccacgcccggctaactgttgtatttttgtagaggcgggtgtattctnccatgtatggctcctgtctggatctcgcaactacctgacctcaggtgatctgcctgccttggcctcccaaagtgctgggattacagggtgagccaacgtgcccggcctaccgcagtttttttttaaagggcatatggttcattttttccctctgccaagagggatgtgcagcatgagtgagaacaaagtctgttttgaactactgaggtttgagtttgttccagcagcataacctagcacatcctgactgataaggatcataaggaccataactgcccttggagttggagaacaggagcagatttgagaggtagaggattagaaggtgatatgttgcatgtgaaggtggggagaaagccagaggtctcacaggcgtgtctggtttggaccactatgtagttgatgatgctgtttacaaaactggaaatggaatccaaaagattcaggagagatc

SEQ ID NO: 544711 - DNA, 199 bp, Homo sapiens
cgtgttgcaattcacccaggctgcagtgtgcagtgggcgatctcggctcactgcaaggctctgtctccgcgggttcacggccgaatccttccttgcctcagccacctagcagctgggactacaggcacccgtacacgcctggctaattttcctgtatttttagtagagacaggtttcaccattgcaacagggtctctca

SEQ ID NO: 544712 - DNA, 399 bp, Homo sapiens
  misc_feature (48)..(48): n is a, c, g, or t
attgaaaagttttgagcagggcctcagcaccatcaccaatgtgcatcnaccatcaccgcgctttcagattctatgtgcaccgccatggcagggagcgatccaggcctccagagatccgttaggaggtggtacagacggtgtaggacgaggtgtttgacatccacttgtaatagatatgatggttggatcaaggactcattcgtgccttggagaaaatacttcaaccagagcagggagcgtgggggtgtcggggcagaaggctcagtatcggggtgggatatgagggtggcatgcatctcagggcagggccagggatggtgtccataaggttgtacacactcttgtgaatatttgtattttccagatggaataaaaaggcccgtgtaattacccttcaaa

SEQ ID NO: 544713 - DNA, 501 bp, Homo sapiens
  misc_feature (462)..(462): n is a, c, g, or t
cggtcctatgagacgtttgccgcctgctgccagatgcagtgacaacatcgtatcccgatgcagctggaaattgcaatcgcttgacgtgataatgcctgaagtgcatctatgacactgctggcttctattgtgaccggtgcaaatacagattttttggacatcccctggctcccaatccagcagacaaatgcaaagcctgcaattgctatctgtattggaccatgaagcagcagagcagctgtaaccccttgacggggcagtgtgaatgtttgcctcacgtgactggccgtcattgtacagcttgtgaccctggattctacaatctgcagagtgggcaaggctgtgagagagtgtgactgccatgccttgggctccaccaatgggcagtgtgacatccgcaccggccagtgtgagtgccagcccggcatcactggtcagcactgtgagcgctgtgaggtcaancactttgggtttggacctgaaggctgcaaaccatgtgac

SEQ ID NO: 544714 - DNA, 362 bp, Homo sapiens
tctccataatgtgtgccagatggagtgcagtggtacgatctcagctcactgcagcctcgactttcccagttcaagtgatcctcccgctttggttcctcaaatgctgggattacaggaatgtgccactgtgtcagcctaagacaagttttttaaaaaaggaagtcatacaacctgataactgtttatatcaattgcaattaggttcagctgcttgtaaacccaagctactagtcatttaagatagaggtgcatctttctctcgtagaaaataaatgttgaggtaggtagcgaagggcttgtatgatattcatacagtcatcagtggctcagctttacctgcagcatgggcacacattatggag

SEQ ID NO: 544715 - DNA, 964 bp, Homo sapiens
  misc_feature (945)..(945): n is a, c, g, or t
gataggagagagtataagccgcctctgtgaatttgcagggtatgacgtgcgtcaggttaagtcatgtaggagactgggggacccagtgctggcatgctcatcgctcagctgcaagacaaactgtccagattcatctaacagttttctccgtcctattgggtgatctccagggtcgtttgataatggaatctacagactgaggtatgactacctgagggtaggaattatctatagtaccgtcgtacgtcatattcagtgctgttggttcttggctccaggggataagaaactcttacgaatattatcacacatagcattggcatagcctgtatcctgtgatggtctctcagtcacatgagttatagatgaataatctatgaatgcagttgggacgtcatctttaattagatgagagggagaatcctttctgactgaacgataggagagtgatatggaatagttgtcaagagtggaatttcgaagcataagaaaggaattgggggagcattgcgatggcgcattggcaatcgcgtccaagggaagagtgtaaggccgttaactaatttagtacccccctgagagagagtcgacgatctcccaatcgcccacacggcccaaccacagataacgcctaggattgcccaacgacattgggcccccgtgttaaattcgctctaaacttaagggccaacctgaacttcgattgcaacggtgtacttagctatatttgtccctaggcggggacaggagcacttccctatcctgttagggcggatgggcgcacgggggcgaggaaactcatttggacatcaaaatcgggacccgatttgggctagaggatcataaccggcaggaaacaatgcactaggtgtgggaaacggtcttctccacggaccccaaggactaactcttctagggccatggacgggcggtttccgattaacntaggacttttgggtatgtg

SEQ ID NO: 544716 - DNA, 263 bp, Homo sapiens
ggaggcaaattcgggggagtggtaaccgacacgagggcaacagcgcgagggggggttttctaattgtgccgattaggcgacgagaacccgaagcccctagatttaggaccacaaattagatcaatcaattctggctcatttaagcccgttacgtctttttccggaccggaacatagtgctaggaaaaagatctccggtggaccttgttccagctttcgcttgcgggcttttcgcttcggggttctggcagagggtacctttag

SEQ ID NO: 544717 - DNA, 264 bp, Homo sapiens
caagagggacgagcattaagcacgtcgcattgctccttaaacgcttagcctagccacaccctcacgggaccacagcgagtattaacctttagtaatacactagtgtttaagctaagctattacatcacccgcggttcgctctatgtcttgccatccaccgcgctcacacaactgactcgcgtcataataagccgcttttgccttgtgtaccgtgctcgaagttctctatctcatggttcatcgcgtattgtccttgctgtacaa

SEQ ID NO: 544718 - DNA, 177 bp, Homo sapiens
gactctagagtatcccaagcttacgaggctgcctccctcgtcagggagaagtgcaacatttccagaaaggggctccgagtcctccggggaagttgatttatgaagatttactccctttccctcagtaaagctgttagcagaaagtgctgactggctgctgcaaagaatttcctcgtt

SEQ ID NO: 544719 - DNA, 1487 bp, Homo sapiens
  misc_feature (1095)..(1095): n is a, c, g, or t
accatgatgataccgacacatactctcgccaaaaccattctacccgctgagtaaagaatagttgttgagtatgctatgtgtataccgggtgacaatagatatatctcccgatacaggtaaagattaagcatgatttatagcaccacgtcgtaactatattcatgttacatagcccctattaccttctcagctgtaagtgtagtaccatcttagataatacatctgttagtcaaggaagatgactctgtgctaagactctctccgagttggcacgacgatgctatccttaatgataactagcttagtagtatgcagcactcgccgcctagttgttcgcaagaactatggtggcgaactactatactatggatgggaaggccgacgaagaacttaattcagacgccttgggttccatgagctctcgggtttgctcccgagaatttggacatcattaattgcgagccgtttgaagatataagcccctagttaggaacactcatcatatagtccgctcgttggttcacattcctgatgcttggatttggattcgccaagagcaggggaacctaagcttcctttgcgtgaacggaccgaacgctgtagacatatataagccccatgtggttatgaggcacccaatgtgtaatttgggaacttttcctagcgagcacaccaattttggggtaaagctgtcccctgagagaagaggccctttccccaaccccaagattctcccaggaaaaacgcgcggatttccaagggcgtccagacatataccgctaattatattccctatagagaagaagggatgtccccccaaaaaaataattatttattctttgaacacggtggcacattcagagcatcgccctagatttccggtgtacctcgagaggtacgtaacttcgacgccccttattttggagagtgaaagctgtcccccttggtgtgcagggtagttaacttgcttccatcctattggtagaacacccaagtttcccttccgctttcccagaaaataaaacgccccatggggcggatccacgaagtttcatacattagaacccataggacatttttggacctaggggttangaaccaagggcgcccgccatatattcaatttccataaagcataaggtgccgagattcccacaaccccaataggctgcaactgtcaattgtaggccccgcatactatcatagggtctaacaaactccccaatacctaagcatggaggctcaacttcgccttctcagagttcaggggggaaaagcatggtcttcagggggacacaagaccatattagtcacaacatatatgggggtgggcccgcccctttgtaagagtgttaaatctccccctcactggattggtgggtccctcaatgcccgtattcggcctagaacctcaggaggttttttggtagtttcccaaacaaggggggtccccataataggtcgataggcccggatataaatacagg

SEQ ID NO: 544720 - DNA, 318 bp, Homo sapiens
cacgaggctccagtcgaactggaaggcctcacccggaccgaaggccaggggaacgaaggtgccgcggccggttgtctgctgagccaccaggcgctgctcttgccagaggcgggcaaaggccgcaacgcggttgtaggagccggtgtagcccagggcctgcagatcggcgtgcatctgcttgacggtgcgccgctgcttgcgatagcggcccgcttctgtcttgagccagcccgagagcttcaaggcgaagggatcgatcttggttggactgacccgcttggcatagtgcggctcggactcgcctgcccgcaggtactt

SEQ ID NO: 544721 - DNA, 328 bp, Homo sapiens
acttctcgaagatctcggtatcgaccacttcggcggcacgcttggcctgttcctggcgctcggccggaatctccacgttcatgccgtcgatcaggattcggccggtgtcctggtcctcgatgcgcgacagcagctggcgcagcaggcggaagctggacgggatcacgccggaggcatcgccggaatgcacgccttcgttgagcaccttcacggtgaagttgccgccggtcaggccgcgcagcgaggtggtgcaccacagctggtcgtagttggcgcagcccgaatccaggcagaccaccagcgacggcttgccgatgcggtcggccgg

SEQ ID NO: 544722 - DNA, 248 bp, Homo sapiens
  misc_feature (87)..(88): n is a, c, g, or t
  misc_feature (121)..(121): n is a, c, g, or t
  misc_feature (123)..(123): n is a, c, g, or t
gaattacactgtgagcagcctgatcactagccagatctattgtgtcagggatgcctcagaagagtgtgtgttatcttcatactggcnnaaaacttggaggcacaatgctggtgtaccagtngncttagtatcactgtatcataggctgggtgccaccatgtaaaaactggacaaaaagcttagaatagacaacgcgatctttgtttattttgctcacacacgtgtgccccttgattgttggacacaga

SEQ ID NO: 544723 - DNA, 263 bp, Homo sapiens
gctagaggatccgaagaaatggaagatagaaacagaatagaaaatgaaaataagtcagagtttcagatagaaaatgaaaaacaagctaagacaagtaaggagaagtatagaagatagaaaaatataaagccaacaaaaggataaaatagcactgaaaaaatgaggaaattattggtaaccaatttattttaaaagcccatcaatttaatttctggtggtgcagaagttagaaggtaaagcttgagaagatgagggtgtttacg

SEQ ID NO: 544724 - DNA, 218 bp, Homo sapiens
tactgctcaccttccatgcctggatcatcaggccacttggtgacccccaacaagtggctccacaccctgttttacaaaaaagaaaagagcagtccatgagggaggttttaagggttgtggaaaatgaaaattaggatttcatgattttttttttttcagtccccgtgaaggagagcccttcattgggagattatgtactttcggggagacgctgaagg

SEQ ID NO: 544725 - DNA, 896 bp, Homo sapiens
  misc_feature (1)..(1): n is a, c, g, or t
  misc_feature (249)..(249): n is a, c, g, or t
ngtgagagcgtggaagactgaaagagacgaggcgaagacacaacagcgcgtcgcgtatgtgtgcataacggcgtcccctcgggaaacagttgtttgccgtggtccaatccttgtggtgatacccccgccgttttctcggagagacgccattgggccattaccccggtactggccctatctccgagtttccggggtttagctctgtgtcacgggcagcttttaaggtcgcccgcatggcgtcaacacttncgcgaggtgtctccccctttctccgggggggcacccttcaggccgtgtggaactgtcccacaaccaacgacggcgccaatttttcttctccgtgttgcaggagcccccctcttccgttgttggggccaaccggccttcgatacccacagcgaggggccctccaccttcggggaagaacttgggagcgccgtcctcttgcggggtcccccccatcggccccctcccccgatctaggcgcccccctttctgggggcctccgttcttcaggcaccctccgcacctctgttgttggcgacgcgcgtggatgcacgcccgcctcgatagatgggtggcgactccctgcccccattgttgctcacgagtgggtggcgccgtagtatgcgttctggcgggacaatccttctttagcgaagaccccccctcgcggcggcccgcgtggttatcgcgagactctagccgcgggcggtcattttccccccaaccctccggggggggtatctctcgtgtgatgcccaacgcccgggctaaggctcatgttgggggtctgcccctgaccccgttgtacgagcgtcggcccccaacccaccctcctagtggttgcaggttggcccccccctcccaaaaaagaattgggcgccccacatgac

SEQ ID NO: 544726 - DNA, 459 bp, Homo sapiens
  misc_feature (15)..(15): n is a, c, g, or t
  misc_feature (70)..(70): n is a, c, g, or t
  misc_feature (170)..(171): n is a, c, g, or t
gcgtgacctgatccnaccaatcctcccggtgaaggtgctcccttccaccgatttcttcgtaccccacttntaggacctggaagggctctgatgagaggggaaagaaattgctgaggccccctctaactggaaactctgccttgtgcgatgcgatttccttgggatccttnngagtaattattataactacaaagcactggagccttggagctaataaagatatctatggaaaccctagttatctacaaaaggtcaatggggtagtagtaagggtgagtagaggagatgagttatagccatctagctctatgggagtttgaaggcttctcctttaatgacaagtttctgagatattgtaaaaacctctgaaataagaacaccctatatgtattgctttccttttaatatggaatgtttcatgttgcttacctgaatgtatactagtggaatctgaaagac

SEQ ID NO: 544727 - DNA, 1162 bp, Homo sapiens
cacttagctgggctatctcttatctgcagctgttcgcttttgctacgcacacagaggatgtggaggacacggaggaggctgggcaactctggcttgagttgtgctgtactccatcattcccttgctatagctctgccgttagatctcactggagaccactttgcggactagctgctatggctccactgccacagccaggcacacgggcttctgcctgcttctgaaagtctggctgcttctgtactctgcgggcctgctggcgcttccctgctgctctagcctgcatcagcgaaactcttgagcaagcattccactctggggctgtaaacccagctactgagctttgaacattcaagcgcttcgtaccatgagcttggggcagcagaacttgcaaggcactactttctctgaaagtaacagaaccacttcacggctgccatgcttattaaggaatctgaactgttcgcatagcagttaccttatgggtgatacaactgggaggcggcaaaaacaactacctgcataggagaccctgccctttgtcaagagctgggagcacatttcatcagagtagcaggcccacctggtgccagagggcctgcccctcctgcttcatgtatcctttgccttgcagtctcctggaagagagactctccttatcctgtacagccttctgggccaaaatgccttctagcttctcaaagaagatccgagtttaatctccattcctaatgactaacaagcacggtaccacgcgcatataccaagcggcacgcaagctagggcgccacagcacgcgcaaggccccctatgtactaccccctaccgtatggccgagaaaaccatttcgcagcgcgtgcaccgaaaacacccagccctgtgggcccacggagataccaacaaatggaccgcaacaacactagaacataaggcgggacgcgcacgcggcgaatagtagggcaaacggcggcgtgtgccgcctcgcttgatataaatgcacgagggcggacaccgaaggcagctagcaaagcgggactgttacaaccgcgcggaatgttcgtgagtctcgcccagcagcacaacaaaaatgaaaaaacaacgtggaccgcaccgccgtgcaccctcaagccccagctacgacatcacaaccagcccgtcgcag

SEQ ID NO: 544728 - DNA, 382 bp, Homo sapiens
gcccttataacccacgatcacccaggtctatcaaacttttttttttgaggcagagtcccactctgtcgcccaggctggagtgcagtggtgcgatcttggtcactgcaacctccgcctcccaggttcaagcgattctcctgcctcagcctcccgagtagctgggattacaggcgcccaccatcacatccggctaatttttgtattttagtggagatggggtttcgccatgttggccaggcttgtcttgaactcctgacctcaagtgatccacccacctcggcctcccaaagtgctgggattacaggcgtgagccaccgcgcccggccaagcttctttctttatatggactttgaaacatttactgtgactcgtgggattgtaa

SEQ ID NO: 544729 - DNA, 1343 bp, Homo sapiens
tggcaaaagcccctggggcgggggcgggaaaacccttgtgacccccggggggtgtgtgcgcgggggaaccccagagacacccccccgcgtggccccccacccagaggcaacagagaagacacctctgtgtgtctctcaaaaaaaaaaaaaaaaaaaaaaaccccgcgagagagaaaaggaccccatatttcgcggagagggggagacgcggagggggtgggagaaagacaccacaccgcgggtgtacaccccaccagagggcgaaagagcccaccacagcagggtggagaaataagaacaagagagagcggcgagacaccacaaaaaatatttcacacaaaaaaagagagaggcgcacacgaggagaggggcgcgccctgcgccacaccacgaggtgggtgtggagagagaaaacccccaccacagagtgtggcgcgcgcgccgagagagaggcgcgcgcgcgccatgtgtggcgcggtgtgagccctccgagaggggcgatccacccccccccaccccgctgtgtggggggggggcccccatcaacactcttctctcttcctctgaagagaagaggagaaccctctacattctcgcagaacagagactaccaacaacaacccccggacgaaagaagaacacatcctactgccggcagagagagaggagcagcaccctaactcttgatggactgatggaacgcacaagcatgagaatccgcgcatgcccaacccccaatcagtgagcgccccacgttcagcgcgctcctacacccgcacactccgcagctccacgcgcggcccaccggccgccgccgttcgggcctcgcgcacgccggcgcgagcgcagcgacatacacgagcggcccgcccaaccaccggaacgcacaaaagacgacgacgagcgcgacggaagcgggcgaggcggacccgggaccacagacgcggccaccccgacaagccgcgcagcacgccggacgccgacgccggggaccgcagcacgcgaacgtctggcacgggaacgggagcacaacacataaatagaaggaaagcaaagtagatcagagcgacgataacgactcagcagaacacacaaacaacgaccaacaaccaagccacccacaacaccccgccccacccgcaacgacccagccaccacaaagagaccccaaacgaacgcccctaaatagaggaacacaaacaaagaggaaaccacccacctaacacaatacaagaagagcaacacaagaccgcaaccaccgagccccacatagaacattaaaaaggccaaaacgaccataaaaccaaaaacccatacggccaatgcaataaggaatgagacag

SEQ ID NO: 544730 - DNA, 426 bp, Homo sapiens
  misc_feature (5)..(5): n is a, c, g, or t
  misc_feature (24)..(24): n is a, c, g, or t
  misc_feature (79)..(79): n is a, c, g, or t
  misc_feature (142)..(142): n is a, c, g, or t
  misc_feature (218)..(218): n is a, c, g, or t
  misc_feature (319)..(319): n is a, c, g, or t
  misc_feature (360)..(360): n is a, c, g, or t
  misc_feature (392)..(392): n is a, c, g, or t
  misc_feature (397)..(397): n is a, c, g, or t
tggtnaccccaagaaccgtgcccntgcactcccaccccgggcaacaagaccggaaactccgtcctcaaaaaattaaatnaataaggcttatgtgcagttattcctcaatgagcctaaaaagccttccctgaggcctagaaantcttgtcatttttggctgggagcagtggcttacacctgtagtttcagcattttgggaggtcgaggcgggcagatcncctgaggtcagggatttgagaccagccctggccaacatggtgaaaccccgtctctactaaaaaatacaaaaattagccgggcatggccgtgggcgcctgtnatcccagctactcgggaagctgaggcaggagaatcgcttgnacccgggaggtggcagttgcagtgagccgagntcacnccactgcactccattctggcaacacagcc

SEQ ID NO: 544731 - DNA, 107 bp, Homo sapiens
gctattatcccagggatggactatttgggttctcggcaatacgtcaccgggacttggcagcaagaaatgtgcttgttgagagtgaacaccatgtgattgttcccctt

SEQ ID NO: 544732 - DNA, 566 bp, Homo sapiens
agcggcccgttccctccccatccatccccgtgagctggacgctagcacgacgccgtctgtctcgctttgtgtcttattttatcgccactcgcatataatcctgtgccttaaatcgtgatcattatcttatgtacagtcacatcttgctaatgtctattttcctctattcggaaggtagcagatcgcggtgtcaccgatgtgaggcccggctaggtctcgaacgcctgacctcaggtgactccacccgccttggcctcccaaactgctgggatatacaggagatgagccaaaccagtgtctggccacaaatgctcttctgtgttgttaacacttaggaaaacaatcttacggaatgggttaacaattagggaaaatacatttagcgtgacaatttgggtcactgtgctagcctagcgtttagaggaacagacattagttctacacagtgactacacttataaacttacattgtactaggagtgcctgacaaagagcgtattttgcaacattgcccaacaactcgggctttcacattcacaaaaaccaaagcgacccaagcacaccgg

SEQ ID NO: 544733 - DNA, 1192 bp, Homo sapiens
ctcgttgttccttgtgtgtcctcacacgctggtgagcttcatttccggtgtcctcacccttgtgcactccttcttctatgctgtgagctctttcttccgggtctcttatctcaggtgtcccctcttccaaagtgtcttgcggatttcccccgttgagagtttctccccccgggttttccacgagcctctggggccaactcccccgggttttccgccctttcatcagagacccccgagtgccacaaacggggtattcccagatcccctggccacccccccccccgggacctgtacttgatggaacccacttagaacttggacccaggtcggccattcccattcgctggtatacaggtcccgggtcaacacacaagctgggctatagctgtcaaggagaccactctttactggaaaccacccctgggcctctcattctggcacatttcacccacgagttaatgttgcttgctcgttagaagatgtacgcacctttgatcctctcctactccagtaactggctcccgcgggttacagaactccctggtttctctcccacgggcttaccacgtggaacactcacatcacgcttctctcgcctttataaaaaatattcttaatgtccctcaatgtcgcctcttctttgtacccgtcgagactttgtgacaccctcttggttgttcttttgaaatttctcttaagggctcgcacataatatatatttatacacactgcctcttgtctcttgtccacatgtaataatacccacgcgtatttggtgtttattggtgttaaaccaccatatatggaatacccggggtgttgtttttggcaccacacttgttataataagtcacatgcacctacacactaaatgatgtttgtggtcgcatgaccacgagccaccgtaataatgttggcacgttctcacataaagagattattaatatctgtattttttaactaagaccctcttttctatgtttagataccacaataccacttatgttaccacgttgcctaccacgtattcacgggcacgtaaccactgatgtacacacggtttgtagcctcgttttgcacttttttcttacggttgtatgcttctttctgttttaaaggtttgaatcaccagcatttttgtgatccaaatcctatttagaaaaaataaaactactttctgtttatctctcta

SEQ ID NO: 544734 - DNA, 402 bp, Homo sapiens
  misc_feature (13)..(14): n is a, c, g, or t
actcactgataannggatattagcccagaaacttagaattcccaagataaaagatacaatttgtaaaacacatgaaactcaagaaggatgaagaccaaagtgtggacactttgccccttctcagaattggaaacaaaacacccatgaaggagttacagagacaaagtttggagctgagacaaaaggatgaaccatctagagactgccatatccagggatccatcccctaatcagcctccaaaggctgacaccatttcatacactagcaagattttgctgaaatcaccctgatatagttgtctcttgtgaggctatgcagcggtctagcaaacacagaagtggaggctcacagtcagctattggatggaacacagggcccccaatggaggagctagagaaagt

SEQ ID NO: 544735 - DNA, 255 bp, Homo sapiens
acagaggcgatgggaatgtaagttagttcagccactgtggaaagcagtttggagatttctcaaagaactccagccaatcccatcaggagtgtatatcaaaaagaaataaattattctaccaaaaagacacatgcactcatatgttcattgcagcactattcacaatagcaaagacttagaatcaacctaggtgtccatcaatggggtactggataaagtaaatatggtacatatacaccatggaataccattcag

SEQ ID NO: 544736 - DNA, 350 bp, Homo sapiens
gagacggagtcttgttctgtcacccaggctggaggggagtggtgttgtgatcttggctcactgcaacctcaacctcccgggttcaagcgattctcctgcctcagactcccgagtagctgagagtacaggctcctggcaccatgcctggctaatttttgtatttttagtagagacagagtttcaccatattggccaggctggtttcaaactcctgaccttgtgatctgtcctcctcggcctcccaaagtgctgggattacaggcatgagccaccacgcctggcctcaaaatcttacataattatggctttgtggttttcttttaaagcgagtccccttctgtcgtcttctc

SEQ ID NO: 544737 - DNA, 207 bp, Homo sapiens
  misc_feature (36)..(36): n is a, c, g, or t
  misc_feature (115)..(115): n is a, c, g, or t
atacactgttaaatattttcttccctttgcttttcntcattttgtcaataaaagattttattttttttttttttttatttttggcacagtctcgctctgtcacctaggctggagncagtggcacaatctcggctcactgcaacctctgccttcccaattcaagtgattctcgtgtcctccgcctaggcaacagactgagactcagtc

SEQ ID NO: 544738 - DNA, 449 bp, Homo sapiens
  misc_feature (2)..(2): n is a, c, g, or t
  misc_feature (144)..(144): n is a, c, g, or t
tngggcccctgtttttttaaaagtaggaagagagaacctttttggaatcagtcgttgcgcctcaaaacttcataatttttgtcgagtttcttcatgaggagggcagcccattggctcccctttgaacccctttgcctttgaaanttaattacatccaaaaagaaggccccttgtttgctagtctatggcccgttggggaatatgcctgtttttataggcccctgtaaccccaaggccccaaataaatgggctttttttttaaaataattttaaaagttgggaaaagggttattttttggccggcttaaatattgaataagtatttttcccccgcctttaataaatggataggccgaggtaagggaatttttgggttttttgagaaaatgtccaaatcctgaatttttccaaataaactggggggttttaaaaatccccctagggattta

SEQ ID NO: 544739 - DNA, 361 bp, Homo sapiens
  misc_feature (32)..(32): n is a, c, g, or t
  misc_feature (57)..(58): n is a, c, g, or t
  misc_feature (246)..(246): n is a, c, g, or t
  misc_feature (269)..(269): n is a, c, g, or t
aaaaacttcccaaggacccaaggacccatttncctctctatctgcctaaaataattnnttaataactcctacaacattcccccctgtggagatgccacactaactgctgttagggagttttgggcgacgactccttctggctacttcttgttgcaaaagggcgtcgaatggggaagagcagctagggctcctcctggggtcaatctaagggtcctcagaagaatgatgtgtctatgtgtggttctntttacagcaccatttggagtttnattgcttctagatgagaagaaacaatttgagttatagtattgtgtatacagggtccaatatccaatacaaggacacataagcaagagagggg

SEQ ID NO: 544740 - DNA, 413 bp, Homo sapiens
gttggcagtcgctgctggccgactgctctgccgctggagctgctggagcccctcctgtcgaggccccccagacccccaggagtggagcggcccatctctgctattctcaggaaacgaactgattccagatccgggagccgcccggtgcccgtctgtccgtccctccactcctctgtttctcccgttctccctgtgcccatccaccggttgaccgtccatcttacccatggatgggctgtggctacgccttcccgaagggaccgccacacgtgggaagggtcctcaggtcctcgcctctaccgggaggtgtttgcagccccctcaacacgcctcgtggctgaagcctaactcgtcattgcttctacatgctactatgtacatcgaccctcagccatgcccctgccccgcttccc

SEQ ID NO: 544741 - DNA, 357 bp, Homo sapiens
cctcagtaggaagaacagatggacctaggaacaaaggagttaaaaagcaggagtgtagactgtgagtttcttaagaaaaaaagtaagagtggctcatttgccatcactcccaatgaccccctgggtgaactcgtgcttcccatccctgcacctctgggctccacaaagtcagaggtcttggtacccaaatggggctcacttatcactacgacgaacaggggccagactgttgattatgtgaagataagatgaggaccagcatctctgcagccttcagattcttaagtatggcattcatttccacctttcccctcagaatgtgatagatactgtttttgatatactgttaaaaaaaaa

SEQ ID NO: 544742 - DNA, 178 bp, Homo sapiens
tacaggacacacagctctagtaaggatgtcactaacggaaattaaaatcatttgttgtagaatactttatgaatcaatgcagtaagaggaggtttacacttctggtgaagaatagggaatgaatttgtgataggcatgtagaaaattatgcaaacaaataaaataataatcaactcct

SEQ ID NO: 544743 - DNA, 152 bp, Homo sapiens
  misc_feature (59)..(59): n is a, c, g, or t
  misc_feature (123)..(123): n is a, c, g, or t
  misc_feature (134)..(134): n is a, c, g, or t
tgtgttacgtgaagtgtgcttcttttcggatggggtatatgaagctgtatgacatgaanctactacacaagaggaaagtctagagctgctaggccaagggtgtgaacactgcgtcctcgtggnatgctagtcangattcgtttacgcctgtg

SEQ ID NO: 544744 - DNA, 556 bp, Homo sapiens
  misc_feature (168)..(168): n is a, c, g, or t
  misc_feature (430)..(430): n is a, c, g, or t
  misc_feature (449)..(449): n is a, c, g, or t
  misc_feature (470)..(470): n is a, c, g, or t
  misc_feature (490)..(490): n is a, c, g, or t
  misc_feature (497)..(497): n is a, c, g, or t
ctgataagatgcaagaagacaatctctcttttgtggtgttcttgccaaaaaggtccaatctgaatctaataaaaaggaaacatcaggcaaacccaaattgaggaacagtctacaaaataactgacctgaagtgttcaaaaatgttaaagtaattaaagtcaagaaagncaaacttcttttaagagtggtggagactaaagagacgtaacaaaatgcaatgtgagcacttgactatgaaggacactgatgggacaactggcaacttgaacggggtctgtgggttagatggtaatataccagtgttaatttcctggttttgatcactgtgttgtggttaagtaaaagaatgtccttgtttgtagaaattacacactgaagcctttaagatcatgagacagcactggctccatggttcagggaaaaaggttcnttggaccttaacttttccnggtaagtttgggattatttcnaaattttaaaattccaaatnggatccntaaaagtaataatttttccataattaacccaggggtaacccttggttaaaaaatccgga

SEQ ID NO: 544745 - DNA, 294 bp, Homo sapiens
atttttacatttcatccagcaatcagattccactatactctattaactacagtcacatagaacttaccatggagttgcttggttctatgcttagcagaaattattttctcctactaaagtgtcatgtatgtatgattctgcactcctcttctagcttctctttttcacccctaacacgtagaatatgtttcctgacttcgtctttcaaaaatcctgtttatctaatacccctttgtgaagtcttatatgacttctcagatcagctgttggctcacgagtactgctgctggtgta

SEQ ID NO: 544746 - DNA, 794 bp, Homo sapiens
  misc_feature (18)..(18): n is a, c, g, or t
  misc_feature (62)..(62): n is a, c, g, or t
  misc_feature (68)..(68): n is a, c, g, or t
  misc_feature (106)..(106): n is a, c, g, or t
  misc_feature (133)..(133): n is a, c, g, or t
  misc_feature (187)..(187): n is a, c, g, or t
  misc_feature (190)..(190): n is a, c, g, or t
  misc_feature (203)..(203): n is a, c, g, or t
  misc_feature (210)..(211): n is a, c, g, or t
  misc_feature (217)..(218): n is a, c, g, or t
  misc_feature (220)..(220): n is a, c, g, or t
  misc_feature (223)..(223): n is a, c, g, or t
  misc_feature (230)..(232): n is a, c, g, or t
  misc_feature (234)..(234): n is a, c, g, or t
  misc_feature (247)..(247): n is a, c, g, or t
  misc_feature (250)..(252): n is a, c, g, or t
  misc_feature (260)..(260): n is a, c, g, or t
  misc_feature (264)..(264): n is a, c, g, or t
  misc_feature (273)..(274): n is a, c, g, or t
  misc_feature (288)..(288): n is a, c, g, or t
  misc_feature (290)..(290): n is a, c, g, or t
  misc_feature (294)..(294): n is a, c, g, or t
  misc_feature (314)..(314): n is a, c, g, or t
  misc_feature (342)..(342): n is a, c, g, or t
  misc_feature (346)..(346): n is a, c, g, or t
  misc_feature (373)..(373): n is a, c, g, or t
  misc_feature (394)..(394): n is a, c, g, or t
  misc_feature (396)..(396): n is a, c, g, or t
  misc_feature (400)..(400): n is a, c, g, or t
  misc_feature (434)..(434): n is a, c, g, or t
  misc_feature (723)..(723): n is a, c, g, or t
  misc_feature (772)..(772): n is a, c, g, or t
  misc_feature (776)..(776): n is a, c, g, or t
ctatttattgataacatntttcgcttcacccaggctggttaagaggtgtctgcattattggnccgaancccttctgctgtgggctatcagcctaccctggcaactnacatgggtactatgcaggaaagaattnccactaccaagaagggatctatcacctctgtacaggctatctatgtgcctgctnatnacttgactgaccntgccccnnctactnncnttngcccacnnngnatgctaccaccgnacnnncgcgtccnattnctgagctgnncatctatccagctngnggancctctagactccacctctcntaccatggatcccaacattgttggcagncgancattacgatgtgccccgtggggtgcanaagatcctgcacggactacanancccnccaggatatcattgccatcctgggctatggatgnaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctagtggcaaaagctgataagctggctgaagagcattcatcgtgaggggtctttgtcctctgtactgtctctctcnttgcccctaacccaaaaagcttcatttttctgtgtaggctgcacaagancctngattgaagatatatttcc

SEQ ID NO: 544747 - DNA, 908 bp, Homo sapiens
gattaatacccctgtgcccaaccctgttcatctactactaccatactttgcagtgcacactacatacacagctgctaaagctcgcactgatatttttacctgagctaggcctaagaaataaaacattgctaagcttttattaccagttctaaaccaaaaaaataaaaccctacgttccacagaagcttgccatacaatgtaatttcctacacgcaagcaacctgcataccataaataccttactaataagctaatacctacttacaacaataatactactaccggacaattgaaccataaaccaataactaaccaatacaataactacatacatataataaatacataaattggctaataagcaataaaaactaagtgaataagccccctttacacttactagagtacccagaggttaacccaaggcacccctacttgacatacctgtgccttgtcttactattctacacattgacaaaaactaagccccctatactacaatacataataaccaaaatactactaccctacactaaaactgtaaagccttactacctacactactactacaatacttaataccatacataagcatggcagttgaggttggatataaaccaaacccagctaacgcaaaatacttagcataactacctacaattacccacataaggatgaataatagcagttctacggtacaaccctaacataaccatatcttaatttaactatttatattatacctaataactacgtatttcctactactacaattaaactacagcaccatgacctaataatatattgcacctgaaacaagtaactatgataaaaccctttaatatcattcacctctatacctaggagggctgcccggttaatggttttttgccaaatgggcatatttg

SEQ ID NO: 544748 - DNA, 162 bp, Homo sapiens
gccctgaagcttgatggtcggaaggccatgtgcagatgcattccagaaactgttgattgtagttgtaggtaagactgtcttgatcatccttgacgtacgtcagtgtcagtaagcaagtaaattctctttgaaaagtgatttgaatgaaaatgttgatcttga

SEQ ID NO: 544749 - DNA, 717 bp, Homo sapiens
aaggaaacctaggtaatactattcaggacataagcatgggcaaagactttatgaataaagcaccaaaagcaatggcaacaaaagccagaattgacaaatgggatcgaattaaactaaagagcttctgcacagcaaaagaaactatcatcagagtgaacaagtaacctagagaatgggagaaagttttgcaatctatccctctgacaaagggctaatatccagaatctacaaggaacttaaacaaattcacaagaaaaaaaaaaacccatcagaaagtgggtgaaggatatgaacagacacttctcaaaataagacatttatgtggccaacaaacatttgaaaaaaaagctcatcagcactggtcattagagaaatgcaaatcaaaaccacaatgagataccatctcacaccagttagaatggcgatcattaaaaagtcaggaaacaacagatgctgaagaggatgtggagaaacaggaacatttttacactgtgggtgggagtgtaacattagttcaaccatgtgtggcaagacagtggtggtgactcctcagggatctagaaccagaaataccattgtgagtcaacaattccattactgcgtatatacccaagggttataaatcattctactataaaagaccccacacaccgtatgttatgtgcgccggtccacaattgaagacttgaaaccacccatgtgccattcaatatatga

SEQ ID NO: 544750 - DNA, 422 bp, Homo sapiens
tagagacagggtctcactctgtcacccaggctagagtacaatggtatgatcacagtttgctgtaaccttgaactcctgggctcaagtgatcctcttgcttcagccacccccgcaagtagctaggaccacaagcctgcatcgccacgcccagctaatttttattttttttaataaagatggggtctcgctatgttgcctagggttgtcttgaacccctgacctcaaccatcttcctacctcagcctcccaaagtgctggaattacaggcatgagccactgcacctgacccaaactatgtattttaaacaagaatgtttaaggttaaatttgaaattccatttaacaagttatttattgacccctactatgtgccagacaccattagaggtcacagattatttgtcctcctggagtttatattt

SEQ ID NO: 544751 - DNA, 381 bp, Homo sapiens
  misc_feature (1)..(1): n is a, c, g, or t
nttacgtccattttgatggctttgtactgtagactcccacctctttggtttctgcaccgtgggcactaactccgtaacttccctgtggcatccagtgggggttcccagaggttaggaactcctattctttccataatgcagcatgggcatgtaggattagataagcatacttgttatctgtatacacatttattctttttccctttcccagttctaaggctcgggaaagtgccactagttctgctaactgggcactggtccctgggggaagaggcttgctttcaagtatggttacatcactaactatggcataacctgcccttcgtatcccattctccacaaatgaacttccatcggtatataggttaaagtcaggattaa

SEQ ID NO: 544752 - DNA, 211 bp, Homo sapiens
ttgatcagaacggcttcggtcgatggacctgcacctcctgtgaggagacaggccagtgcctttcaagtgcatgcagtctcactgattgtcatcctcaagtttccgctcagtggccaccacaagttatgtccgacaatgcctggacagaacggccgatgcattcatagtatctcattgtccatgcccggggctaccgagcctcgtacatttc

SEQ ID NO: 544753 - DNA, 1236 bp, Homo sapiens
  misc_feature (778)..(778): n is a, c, g, or t
tggcaagaaaaaagagggtgtgtggcccaccacaagaagcggtgtcactcttatgggtgtataaaattcggctgtcacccgagagaagggcaaacgttttgaaactctgtcacccccttgggggttttatcaccacacagaccacgcaacacttttgtattttggggaggtataaccaagcgccacttttggggaatactttttagagacgttggccccaaaaaaggggtcaattccctgggaaattaaaaatagtcctctgttccaacgaggggacaattcattttttgttccgaaaaaggttttttgggtgttacaaaggaaaaggaaaatggtgttttgaaaggcatgttggtgtgaaaaagagagctttccacgtttctccttaaagagggtgttagccctgtgtaacccccctttttcgtggcaacttgcggaggaaaagtttctacttgttgaccccacgacacaactggggctgtgccacagctaagaacacttgttgtataaagagtgggggaatattccacggcacacacacacctctgcacaacggagaggggccctgcggtgttatatacacatatatgtggtataccttgtggtgtttatgagagacctcttatagtgtgtgttctctttgtgggctagatataatatgacaacatagtgggcttgtcacatttatatttgtagacacgccacatgtgttacacacactactagcacacactatgagaaaaggccacgctatatatactttcacctcgagatggcnttgtttttgtggggtatattaaaatacacactttttgtgtggtgtatataaatgggagcagagtttttttgtgtgagatgtatatgagaacacttgggcttgtttataataataataaaatgaggtaatatggttatagtggttggtggtataatgcctggttttcgaatctgtataaataagttaaagtgatatggaacaccgagggcacactaacttcttgagatttattgcacaagtgtcacgtgcctaaggttttaacttttatatttttaaagcacttcacgttttgctttcacaattttaatgtacccttatagttttgagagttaagagacctcgcacagaatgtgtaacacagagaataaggtcaaatttatgtattgcacattatcatgctattcagcattgatgctatattgtattaagtaaataatataaaaccatgtacagaggga

SEQ ID NO: 544754 - DNA, 655 bp, Homo sapiens
ttctgagaaattgtaagcggatcgaaatcaggatgatatgttaatgtcgcatcctaaacagtgctggcattagttcaaaccgatggatgcgcattcattcgctgatacccaagacattctaccatcagatctcctcgtgcagtcagcatgtctcattccgtcgtgatccccaaaatcagagttaggctctcatatcatgacctcgttgactgtgtggtagtcgtgtccagcgtgtagttatcatagtggcaaaggatacagtgctcgattactttgctgttggagagaatacatgtaacttaatttctcgaggctagctaacatagtgcaactgggtcctatagaagagggttaaaattgcatggacgcgatctgtctccagcggtggtatggacagctctgcggtctcaatcgttgggccaggccatctttttgatcgactgcttccagcagctgccaagacattggcgcatctgacgggcaactgggccagaaattgttgtgtccagagagctacactttggcgataatgcttcacctactgtaaggtgtgaacttacttagacaactgtatggctgtagttcgtgttccatgttgtgtctaccagagtaggtctaataccacaggtaaacacctatgtggataatgatataa

SEQ ID NO: 544755 - DNA, 120 bp, Homo sapiens
atcctagagaccacagtagagcagcaggcccatcccgcaggacgccaggtaggctcatgtaatataccaggtgagccaatccattgggggcgcaaagtagcggcggaaggtggtgtaccc

SEQ ID NO: 544756 - DNA, 793 bp, Homo sapiens
caagggtgttgggcctgtaagtgcacagaaatcaagaattgaggtttgggaatctctgcccagatttcagaggatgcatggaactgcctggatgtccaggcaaaaatttgctgcaggggtggagccctcatggagacctctgttagggcagtgtggaagggaaatgaggggtgggagcctccacacagagtctccactggagcactgcctaatggagctgtgagaagagggccaccatcttccagaccccggaatggtagatccactgacagcttgcaccgagcacctggaaaagccacagacactcaatgctagcccatgaaagcagccaggagggcagctgtaccctgcaaagccacggggtggagctgcccaaggccatgggagcccaccttttgcatcagcatgacctggatttggagcatggagttaaaaaaatactattttggaactttgagatttaatgactgtcctattggatttcggacttgcatggggcctgcagccccttcattttggccaatttctcccatttggaagaggtctatttacccaatgcctgtacccccattatatctaagaagtaactaacttgcttttgattttacaggctaatagacaaaagggacttgccttgtctcagatgagactttggacttgaacttttgagttaatgctgaaatgagttaagacgttgggggactgttggaagagtgtggtggtgttttggaaatgtgggactgagatttgggagagacaggggtgggatgatgcggttggctgtgtctcacca

SEQ ID NO: 544757 - DNA, 176 bp, Homo sapiens
ctggcgtaggtggcagttgggcctggtaagggttaggacttcagaaaccagagcccaagccccccaaagggggaacagccagccccgctctagctggttgttgccatcccggaatgtgggcctagtgttgccagatcttctgatttttcgaaaaaaactagaatgctggattctta

SEQ ID NO: 544758 - DNA, 160 bp, Homo sapiens
ataacgtgacaaaagatcagccaaatcatctgaaatgtctaccagtgcctatgaggtcagcatggactaacaactaaagcccatttgcatcaaacccacagagtaagccaggtgcttcaggtgccagctgtgaatttgcaccccatcaggccatgacggg

SEQ ID NO: 544759 - DNA, 522 bp, Homo sapiens
  misc_feature (443)..(443): n is a, c, g, or t
  misc_feature (516)..(516): n is a, c, g, or t
tcatgttccagttttagctggactactcctgtaaacagatgcttcccttcatgtgctcttgtgatttaattaccaggaaatagcagatcaatactgggtggtttccttgaattttctaattttcaggataataagctaactagtgtgctatcattctccaaaggatttttggggaaaaaaaaaatgagtatggacccatgatggaagccactccgatgaggttggatcctcggcaatttttatcctgggtggaaactcaaattttcccatctctggccagagggaaaatgaagtgggctccggggtccttgtggcccagcccttgtcgtctttcacagctttcttgctatctgaggtgacgagatgatccagcctcattttacacttgtagtgcccaagaccgggaatcaaccatttctccaagaagtctgggattggtattnctgtatgggtttcccatttattttcatcggaatatatgcggggagatgagtctcgctctgtcacccaggctgnagtgct

SEQ ID NO: 544760 - DNA, 1019 bp, Homo sapiens
ggccgcagacgcggggacgctggctcgctccctccggacctccctcgacgcgatcaaatgatgccaaaggggaaaatttcccacgacagtttgtgtggcgtaaagagaaactcccatggtcatgtgactccagatacttctggggctggttgaatgcagtgtttaataaggtggatgatgatcgtcatcaggaatgtaggcccgtgtacagggtcggcaatccagagtagtgttgcctgcagcgtgtggggcccatggttgcgcctaatctagtggtctccaggcaaaggtaggcatgaaggacttgactagatccacgcgtatccaatcgatggcccatcgtgtggagccaaatgcataagatatcacgggcgaatccgagcgtccagcggatctcgtatggtgatctattgtacgccactttgggatttgcatccactgttgggaaaacctcgaaggtatgtgtttcgttatgagtgagtcttcctggagaataggggagacaaacagaaaactctggtcgcaagccttggaaggatcagcactggccttctctggaagctagaaagtgaagctgttgacagtagatgagtaacctggtgtctgtactcttcaggtatacagggactcacttcgcaaagactggttgagttgccaggagcgatcgaacttacttatgttatactaggtcattccagagtagagatcataagggactggccagtgaatcaatgaagcacttgttagaaagatggagagtgggcgttcactcatgttaggaccactatctatcgcagaaccggtggctcattaaaatgtccactacagtgtgcgaaagctgcagaaattggcgtggaacacatctagtgcctgggggcacccgacacaaatgttgcagtacccagagtgcgagatgggggtcagggcctggtcagtcctaagcgactttggggaaggacacaaaaggggggagacatcaacctggaagggtcaggggaggttccacagaaccaaccatg

SEQ ID NO: 544761 - DNA, 458 bp, Homo sapiens
ggaaaggatcctttgtacactcgaggaatcaacaaataagaaaggcatgacccaacacccaaggaatcgagaaagagctatcactctgtcactcctgtctccacaactccacacagggacatcctcgctgttacactcaggtccccccagatcatcctcactgttacactcaggcccacggataatcctcacttttacgctcagggccccccggaataatcctcactgttacactcaggaccccccagataatcatcactgtaacactcaggcccccggataatcctcactgttacactcatactctcgggacctgcaaatgtctctctgtccaccagccaagtacagaaaagaactccagagcatcactcagcaatgggttgagctgcactgaccacactcgagtcccgtaccagccagattgaccaagctcgtagtcaagcagcaccagcaccaga

SEQ ID NO: 544762 - DNA, 218 bp, Homo sapiens
tctggatgcaagtgtcactgcatatgtatatgcaagttattaatccagtctctctttgttgttgttgttgttgttatgatacggagtctcattgtgttgcccaggctatagtggtgtgatctcagctcactgcaacctccgccccctgggttcaagtgattctcttgcctcagcctcctgagtagctgggattacaggtgcccaccaccacacccagc

SEQ ID NO: 544763 - DNA, 245 bp, Homo sapiens
ctggcgtgagtgccacccgtaatctactctaccatctttgctgtgcacagtcatcactgcgctatgttcgcgctgatctgataatcgcttgagtaggcctagaagtaaacatgctagcttttattaccagtttctaaccaaataaaatacaccctctggttccacagacagctgccatctaagtatgtccgtcaccgccaacgattgtggccttcaggcacgatacgggatacgcgatgcgtcga

SEQ ID NO: 544764 - DNA, 1070 bp, Homo sapiens
gaagacaaaaaaaaaataagcgtaacttccctcaaagcaacaacccccccccccacccttgcgccgcggtgtgccttcccttcgtgcccagccaagcttggtgccgggggtttggtgggcttgccctgtgcgcccgggcccttccagagccaagcctttcttgccgggccctgtgccggcgaaagtgggaggtgccccaagccgggaagcccggggccagaggcctcggccctcttcaactccaagacgaggcggtgttgggggtgggcgcccagagggttccggggccaacctctccggcgggccctgtccgtgcgtgggatatcttcagcagtggccttccgtggggtctccccggggtggcgggagtgtgccggcttctccttcggccggggccaaccaatcctcttcaaccccatgagacctattggcgacggacctctcgcgccggggtgcctcgggggagatgcgatgaaaacccccaaagaagagtgtcaaagggataggagacaccgcgtaggagtctatcccgcggagagagtccggcgaggacgcgccgtggaaggccaacctataatcccgagagaacctcgacagcggggtcaaatttccgtgaatctccctcccccgtgttcgattctgggaaaaactcgcgtcgcgaaaatctttctgggagtgccgaggctccttcgtggcagtggggtatttccccccaaacccctataggggaaacccgcgcaacaattgggagtgggcaagtgacagaacgttttgtggaaacaggcgcgcaaattccaaaggggcaaagccacatgaccctggagatctacaatttgccgagagaacgaggaagaccgaagttttgcgcctcaaatacaaaacggggtctcccaagggtagcaaaatagcgcacggggtgagaaccggcttggtgcgggggccaacaaagcccccccgagggcacccgagaagacagccacgcaaagatccccaaggcagggcacaagatagccggcaaagaaaagaacacagacgactcgcaaaacgcagctcgcaccagcccactccgg

SEQ ID NO: 544765 - DNA, 774 bp, Homo sapiens
  misc_feature (334)..(335): n is a, c, g, or t
ggtgctggaggcgccattggagccggcttggctggcgagcccggctgaggagcctcttgggccgcacttactgccgcgtccgctcccggtccctggcccctcagcggcatggcgtgcggggcgacgctgaagcggcccatggagttcgaggcggcgctgctgagccccggctccccgaagcggcggcgctgcgcccctctgcccggccccactccgggcctcaggcccccggacgccgagccgccgccgccgtttcagacgcagaccccaccgcagagtctgcagcagcccgccccgcccggcagcgagcggcgccttccaactccggagcaannttttcagaacattaaacaagaatatagtcgttatcagaggtggagacatttagaagtggttcttaatcacgagtgaagcttgtgcttcggaaaagtcaacctcactccttcagcacttcacagcaccttagctctccaggttcctcatggatgacagaaggaccagcccacatttacccctccgacaagttgcgcctcctcatgtgaagcgcctctttacacagactactgaacgcattcacgattcgggaggcagtactgagcccacatcctccataacaacagacttagcacaaacaactatgaattcttcggtgacacttcacacatgatcagattcatgccgacggcatgcgcccaagggccaacccacgctatgtcggtcatgacgccttgtcccatatctggggtaccagcgtcccgccctccacgagatgcg

SEQ ID NO: 544766 - DNA, 275 bp, Homo sapiens
acccaaggggaaaacatggtcgtgggtttggggttataggaacaggggggctttggtgaaaaagcaaaatggaccaatggagaaaagccctcttctggaaacatgggactcaaaaaaggggaaggaggataagtggtggccttaaagatcaagataaactttccggacaggggtaagaactttatagtatgaaaaagggtgaaacttgggggcgggtccggagaatctccaaatttggcacgtggtttgaagataatataaagctagggagaaag

SEQ ID NO: 544767 - DNA, 301 bp, Homo sapiens
  misc_feature (281)..(281): n is a, c, g, or t
cacgcgcgtaccaagcgtcgcgtgaacttctcgccgaagaggtatcgacgtttgaaccgaagattcggacttactaagggtggctgccatgtgaaagtcagtgtttatcgctacaaccctgatcaggacgctgcgccgttcatgcaggaattccaggtcgataccggtggtaaagacctgatggtgctggatgtactggcactgatcaagagcggacgagggttctcctatcgtcgctcttgccgtgaagtgtgtgcgttccgacggcatgacatcacgcnaaaacgcctggcggtaccgg

SEQ ID NO: 544768 - DNA, 359 bp, Homo sapiens
ggaacaaccaactccagacacgccacctttaagagctgtaacactaactgcaaaggtctgcagcttcactccttaagtcaagtgagaccacgaacccatcagaagggagaaactccaggcatatgtgaaggaacaaactctggacacactatctttaagaactgtaacactcactgcaagggtcggtggcttcattcttgaagtcagggagacaaagaacccactggaaggaaccaattccggacacagtagcatttgagcactgtctttgggcaaggagcttaagaaatgagaaaagcaacagaaatcattcagtgaaaggcagatcatcataaataaatgttgccaaatgaaaaaaa

SEQ ID NO: 544769 - DNA, 200 bp, Homo sapiens
tgttttacgtgaagggctatgtgtgatatgtgacatatgcaaatgagacagcatgcaaagttagcttatcatagttgattcagacctgaggtgatgctacgtacttgatttgcggcagtggcaatggacaggcatgcgctgtgtttaaaggtgatcacttaggaagtgatcagacaccgggaacgggtacggagctcgaa

SEQ ID NO: 544770 - DNA, 102 bp, Homo sapiens
atagctatttgtgttattcatttgccagaatgattcactcattccatgcctgtctctcccagtataactttgttgggtgggttttctggggcattataggcc

SEQ ID NO: 544771 - DNA, 390 bp, Homo sapiens
  misc_feature (22)..(22): n is a, c, g, or t
  misc_feature (41)..(41): n is a, c, g, or t
gtttaccttccctgccagtggnattttgaataaatggaggnaaatgcattgtctcctaacttggaaaatggcttctttttttgtgggcctttctctggtttttaggttttccattaatgttaaagtccaaggtcatagagagaaaaaggaaaaaagcaatagacatgtattttgtctgtctcagaaaaatgaagggggaaaaaaataagcaactgattagcaagttagtatatttagaaacctgtaattaaagtatagctcaaaatgacagctggcctgtggtctgtcttccatttctcagtatgtaactgaatgaccactacatggttttgttttttttttttaaactgaagtttgtacagtgttccaaaataaagttaattagataca

SEQ ID NO: 544772 - DNA, 142 bp, Homo sapiens
aaaaggggtttttgggggccccccccccccctggggggttttcccccccttttttggggggggggaatttttgggggcggggggggggggggccccctttttggcccccccttgggggttttatttttttttttttttttta

SEQ ID NO: 544773 - DNA, 162 bp, Homo sapiens
cgccacagcgttctcggcttcagaaaggctctgatgccctttcggtccccctagtcctcctagggggaagatgagtgttccaaatcctcagggtgttcctccagcaggattgtgctctgctatggagatccatgtccaggcatgtcctcagtgaagggatcg

SEQ ID NO: 544774 - DNA, 736 bp, Homo sapiens
  misc_feature (590)..(590): n is a, c, g, or t
gctaaacctagccccaaacccactccaccttactaccagacaaccttagcacctctttcataagtgagttactaagatttctatacctggaatatcatgtatgtttcatttactggatgtttacattttaggaaggaaaatagtttgtttatttaaacaactgaatacttataaactgttgttcctggaagttatttattccataaaaaatttgttcttttctcatgaatttataattcctaaatgaagaccagaaagtacaaatgctgggaggaagaataggctttattaatcaatgatgtcttgatttttctaaatgggaagatagtttatttttaacactaattatgggagcagattcttagcaaacttctttggaaaagttaatgttatgatgtgcattaggctgccccatcgtgtatataaatgaagcagatttgattttgtattcttacgtttctctgcttgtagttgtggctgtacttaaagaaatacagaatttcatatatttaacaatgtttacaatgtgacccacagaacatgtaaatgattaaaaacttaccatgaaaatatctacaactaaaagaatnctttaatttcacaagtgttttacttcgacgaatgtgcctttgatttaattggggacacttttttagaaggatacattattcgtgtttgcacggtctttgaagaggttggaactaaattctgcttaatcatcaattttctatgacgc

SEQ ID NO: 544775 - DNA, 397 bp, Homo sapiens
  misc_feature (33)..(33): n is a, c, g, or t
  misc_feature (77)..(77): n is a, c, g, or t
cccagtccagaatgggccctattattaaaaaangcccccaaaaggtaaccaggatacctgggcaagattggtgggangaaaaggggaaccaccttaccaccccggctggtgggaatggtaaattaggttccaacctattgtggaaagcagtttgggtgatttcctcgaagaaccgtaaaacagaattacccattagaccctagtaatccccattattgggtatttacccaaaggaatataaattgttctatcataaagaatgtgcacatgtatgttcatcatagcactattcacaatggcaaagatgtggaaccaacctaaatgtccatcaatgatagacgggataaggaaaatgtggtgtatatatatgccatggaacattatgcaatcattaaaa

SEQ ID NO: 544776 - DNA, 188 bp, Homo sapiens
tgtttgtagcttgtgcgtacttgaaaaaagagtcagaggaacagacaccgcagcacagaaatcatgctatattctatctgttgtaatgattctggtctagaattggcacatgtgcacatttaaggaccttcagactctgaacggagagaatccctaattcccgaagctgctggttgttgctacccacg

SEQ ID NO: 544777 - DNA, 459 bp, Homo sapiens
attaattgggaccctgggcctcaaatctcagggccactttgaagtcacttagggttaccccatctctccgggaactgcgcattgagggatattcgcttacaccttcacgttgtttaacaatttaacgcagtatttaggggccagactcaatttttcccctcaaaaaatgtactccgaactttgccaaggtccttgaaaaaaaaaccaaaattcagcctgaatccgttgtttgacacctgtattccttggccaccaagcggaaacccaccccttacaaaaaattccccaaattaggcaggcgtggtgcctgcgcctgtagtccacctacccgggaggatgggaggtgaaaggatcacctgagcctggggaggttgaggttgcagtgagctgtgacagcgccacttcactctagcctgggtgacagagtgagaacctgccttgaaaaaaacaaaaaaacaa

SEQ ID NO: 544778 - DNA, 163 bp, Homo sapiens
tggcgttctagaggagtcccggctccttatcccggctgggcgtcacgatgtacgtgtgcgtcggcagtgtggatgcgcgtgattgtggcgccatatggagcatcgagcgacgcaattcagcttaacaccagcgacgagattccctttgagcaccagacacaga

SEQ ID NO: 544779 - DNA, 643 bp, Homo sapiens
aaaaaaaaaaaagtaatatccaggaaccctgcccagagtaatactgtgggtggcataagagaatcaagccattctcaagagataacttcataaccagaatggtctgtgggctagcagctgtcacagataggcagggcactggggaatatgacctttctgtccaggtgattcacagactagaacctttcttatcctcctcctagaagtttggactggggactctagtgttaagatgatgagcccgtgcatcaggtccttctgcacttgggtggaagtctcccagggtaggtttcctatttggaaacagtgggaatcatgtttccagtgataaagtttaatggacctcatcctttttttttttcctcatctggccattggggtgtctaaaaggggttaaatggcttgaatgtggctaaggtgggttctcagaattggcgccagtatgggcccaacaatagcttctggctcggtctaactggactcaataccttaaggattggtatcagagttgggatactagtgtaagggggggtgtcaccattacttaatggggagataatgaacccaatcagggatgcggttaatggggcatgtcatctaagagaggagaaatagcggggtagggggtctaattttgaatacc

SEQ ID NO: 544780 - DNA, 828 bp, Homo sapiens
  misc_feature (771)..(771): n is a, c, g, or t
  misc_feature (786)..(786): n is a, c, g, or t
  misc_feature (798)..(798): n is a, c, g, or t
aatcaaacatagacaaatgggattacattgagctaaaaagcttttgcacagcaaagaaaacaatcagcagagtgaagagacaacctacagaattggggagggggaggaatatgcaaactatccatttcataagggattaataaccagattacataaagacatctaacaactcaatagcaaaaagccacaaataatttgatttaaaacagggaaaatgatctgaatagacatttcacaagagaagacatacaaatggccaacaagtgtaggaaaaaatgttcaacatcattaatcgtcagggaaacgaaaaccaaaacctcaatgagatattatctcacctgttaaatggctactttcaaaaacacaaaaagtaataaatgttggcaaggatgtggagaaaggggaccactcatacaccgttgctgggaatataaattagtatagccactatggaaaatagtatggaggtttcccaaaaatctgaaaacacgcctaccatatgatccagcaattccactgctgggtatatacccataagaaaataagtcagtacatcaaagagatttgcattctcatgtttataacagcagtattcacaatggtcaagatatggagtcaatctaaatatttgtcaatggatgactgttaaagaaaatgtgatatgtatacacagtggaatatcattccttcacaaaaaaggaataaaatctgtaatttgcagcaacatgaatggaaatagagtcattatgttaaagtgaaataattcaggcncacaaaggccaagtnttacacgttctnacccaaataggggaactaaatgatctcaag

SEQ ID NO: 544781 - DNA, 793 bp, Homo sapiens
cctagacctgtactctcaggtgtcctgtaccgtccgttgttggcatttgggcggtcatatccccagccatgacctatgggaaccctgctctcagtggcctcatagttacccagtgcgttcgacttggggctccgcgtcttgggtaatataggaaatagtacgagagcgaatagaagtgtattcttagtacttgctggtcatatttgtgagatacagagatgatgaatgttcaatatggggataggtataatgaaccgtactctatgaatcagatcttctggtgaacggttacactttgttgttcatgtttttaaacagaatgtcacagatgtgtgcttgataaggttctgggtatactagacaagtcaccatgatttatttcggctgaaagtcaaacagttggatcaattcagtggctcaaatcttgctggacatatgttcccaaagagccaggaataacacctgtgattttgtcattcgagaagcaacacacacttgtaaactagttcattttctgccacctctggtttatagtggtaaacggaatcctgtcagctgccagtgtttgaactaatgaatatcgatacttgtatcatcaatgctgatatttgaaatgagttggtctgttaggtttaagatggataaatgaatatcactacttgttctgaaaacatgtttgttgctttttatctcgctgcctagattgaaatattttgctatttcttctgataagtgacagtgaacaattatatgagtaagctccctgttgtcatttatacaccggttgtgtatt

SEQ ID NO: 544782 - DNA, 205 bp, Homo sapiens
gccctgttttgccggggggtacaccctcagcgccccaggagaccctaaagtggtttccttttcccaaaaaatcagacagggccccagccccctcaggcagccaggtcttttgagtttccttaaaagtagtgatgggaagattccagtttgagggcccaacgggcctgcttcctgtttttgtaaataaagttttgttgggccccca

SEQ ID NO: 544783 - DNA, 391 bp, Homo sapiens
ccaggaatgaaaggaagtaaagtacacttgaagagggccaggcgtgaatgacttgacagattcaagtccctggtttgacctttgacttggggtttcatatgctggcatgcttccagggatttacggtttgcatctcttctcccctgattcctaccttggcatgggctgtccacatgcacggtggcctgccagcacttggaggggccacaagcacagtgtgttcagtatactgaagtgcacatgctcacttaagacgttcttccctgcctcttggtgcataagcttgagcccatttacccaacttctgagatcttatcgagaagctgctgatcatcagtttcaagtgttttccatctatttggagactgcctttccctggtgctggctgcaa

SEQ ID NO: 544784 - DNA, 940 bp, Homo sapiens
  misc_feature (9)..(9): n is a, c, g, or t
  misc_feature (91)..(91): n is a, c, g, or t
  misc_feature (301)..(301): n is a, c, g, or t
  misc_feature (512)..(512): n is a, c, g, or t
  misc_feature (600)..(600): n is a, c, g, or t
gcatattgngcattggatctatttaagcctagaagtataacagataatcagttccttaagtgtaaatatgttcttaaatgtttggcctttntatctgttattcaaatgtattagtaattctcatattttgcaaacagatccttttgtgtatattataaaatatataccaaatctagttttccttttgctgtggaagatgtctttatataatattgagacttcccttgcaaatgagagacgggactctggtcacgtatagtgtgtaggcctagccccatgtattacgaactcataaactcanaaatccaaggattaaacattgtatgtctccttcatttatgcaagtcatgctttcattctacatgtacgtaaaactacaagtatgacaaaaaatacaactttccattggaattttgttcaatcaagtaatgttttaacaactttaaatcatcacttaatttgattgtattacctatcacagaaccaataaccctttctttttctgcactaanaacatgaatattctttactgtgcaaatgtatgaagcacacaatgcatataattattgaaatataacatactgtataatggatcgtaanaaatgtgaaatatacctctacattaatacatactacgtactaatgtacttaatatctgacgaaacacataattagattacccgttcttaaaattggatactcttaacttaggtctatattccttgcacgtctaactttaaagaaccattccttacaataacataggatctactaatctcaattcctttcaatattcttaatatccttgtattattgccattactctcttcaaatctgttactttaactaaggcactcccgaatataaaactgtatcttttgcacactaaagtgtattaagtcactagcttgtacatactctaccctatttactttctacg

SEQ ID NO: 544785 - DNA, 342 bp, Homo sapiens
ttaaagggcaaaaaacactgtatcagcataccctttctgtatttacgaaacataagcagccgcgcatggtggctcacgcctgtaatcccagcactctgcgagtccgaggcggatcataaggtcaggagatcaagtccatcctgggtaacacggtgaaaccccgtcttgaataaaagtacaaaaaataagctgggtgtggtggtgggcacctttagtcccacctactcgggaggctgaggcaggagaatcgcttgaacatgagagtcggagtttgcagtgaaccaaaattgcaccagtgcacactgcactccatcctgggcgacagtctgcgactttgtctca

SEQ ID NO: 544786 - DNA, 137 bp, Homo sapiens
tgaggtcgattagaggatccctatatcacataagtgtctgtagtgccatgctgagtaatctgcgctggtacttgggagctagacaggtctctaattcattcagcaagtcaagaagtgcctcctaggatggcactgtt

SEQ ID NO: 544787 - DNA, 250 bp, Homo sapiens
gggcaaatgcttctggaaaccccttccctaaaaaaaaaaaacgtgggggtgtgggtgggggttccccccctcccatccttcctgcctcctgccccaaaccccgggtttctgggtttggaagggccttctttccaagctggggggtcctgggccccccccattccctttttgtccttgctgctggcaaacagtaaaaaaactccctttccctgggggccgttatgcttcagaattaaaccaatgaagttta

SEQ ID NO: 544788 - DNA, 168 bp, Homo sapiens
ctagcggaatacctactgctgctagcatggttagatgggaacggaagtaggcatagggcggctacgtaaccccatactacagggggtaggctaggtacctgcaggacggccacatactagtatctacacaggctagagagacgcagggatatgggctatagaccatac

SEQ ID NO: 544789 - DNA, 418 bp, Homo sapiens
attataagggagctgccctatagaggtgtactattttttcttttataccgtatttttattgtatctttttggttttcaaacacaaatacttaccactgtattataactgcctacgatattcagtacagcaacatgctgtacaggattgtagcctaggagcaacaggtcataccatatggcatagatgtatagtaggctattccatctaggtgtgtgtaggtacactgtatgatgctcacacaacaaaatcacctaaagatgcatttctcagaaggtatgcccgccgttaagcaatgcatgactgtaataaaaaagaataggccagctgggcgcagtggctcagccaaaaactttaaaatagcctatgttttaaagttcttccttatctccaacatcacacttcgtatatatgatggag

SEQ ID NO: 544790 - DNA, 100 bp, Homo sapiens
tcaagcttctaacgatgtacggggacatgtgttgactctgtaatggatttatgtagcccacttcagtctgcaaataaagcaaagtaactggaaaaaaaaa

SEQ ID NO: 544791 - DNA, 106 bp, Homo sapiens
atcgggttgagccctacagcacggactccccctttggcttgagtattgtacggtatacatagtccccccagacgaaagatgaggcagaggcaccgtcccacgccgg

SEQ ID NO: 544792 - DNA, 154 bp, Homo sapiens
taggagttcaaggttgcagtgatctataatcaccactgcactccagcctgggtgacagaacaagaacctgtctcaaacaaacaaacaaacaaacaaaaatagtggagaccctccagtgtgagcctcctcatcatctctgatttcatcccccatg

SEQ ID NO: 544793 - DNA, 95 bp, Homo sapiens
ataggcatcaccaatatttcgtcctcccaccagggtcaccacgccatcgacagtgaaacttttattgtgcatacggcgattaagacgggaaaagt

SEQ ID NO: 544794 - DNA, 159 bp, Homo sapiens
gccgatcacagaatttaaaggaatcttcagtaaaagtagataatgaaagctgttgttcaagaggcaacaataaaatccagaatgccccatccaggaggtcggttttacaagacccagctaaactaaaaaggctcaacagtgggcgagccttcacacaga

SEQ ID NO: 544795 - DNA, 241 bp, Homo sapiens
tcttctgcccaatggtaccttggtccatcacatcaatgccaactacttcttggatcatcacctccgtgaagcccgaggaaatcgagagcaattctcttcagcttctcatccacctctgaagacccgtccacggccacctacatgcagttcctgtatggagggactccgtccgtggcctgccccatcctccagccctagagtgcctggacgggatcttattaaacagaccccacgcctaaga

SEQ ID NO: 544796 - DNA, 842 bp, Homo sapiens
  misc_feature (31)..(31): n is a, c, g, or t
  misc_feature (70)..(71): n is a, c, g, or t
  misc_feature (75)..(75): n is a, c, g, or t
  misc_feature (82)..(82): n is a, c, g, or t
  misc_feature (84)..(88): n is a, c, g, or t
  misc_feature (95)..(96): n is a, c, g, or t
  misc_feature (100)..(100): n is a, c, g, or t
  misc_feature (107)..(107): n is a, c, g, or t
  misc_feature (204)..(205): n is a, c, g, or t
  misc_feature (240)..(248): n is a, c, g, or t
  misc_feature (254)..(254): n is a, c, g, or t
  misc_feature (257)..(257): n is a, c, g, or t
  misc_feature (273)..(273): n is a, c, g, or t
  misc_feature (295)..(295): n is a, c, g, or t
  misc_feature (313)..(313): n is a, c, g, or t
  misc_feature (369)..(369): n is a, c, g, or t
  misc_feature (834)..(834): n is a, c, g, or t
acctcaaacctcctttcctaataagtgtgcntgcctgtggatgggttgggggggggtggagggggggggnnaacnaaatggntnnnnnaaaaaanngggnaggggcngtgggctcacaactgttatcccagcactctgggacgctgaggtgtgagggtcgcttgagcccaggagtctgagatctgcctgggcaacatagggggnncccccacctctacaaaaaaaaattgaaaaaaattnnnnnnnnntggggngcncacctgtggtcctgantctgactgtggggggctggggnaggggggtcacttgggcngggaaggtcaaggctgcgatcagctgtgattgtgtcactgcactaagccttggtgncagagtgaaaccctttttcaacaacaaaggcaaaatcttaaaaacaggaaacaggctattgaggaaaaagggttataaaactgcctaagaatcttcactaaagtaatcttctagtccttccatatccatttccagagagggatttaaagaggccagagcagatgatgcatccttggttttctggacacttggtttgggttgaggagtttctggttggataggttccttctttatgtctttaccaccatttagaatacgttggctctcacaaaagaactgattaggatgattcaaagaaaagccacaatcatccacattgtgtatcatctcaaagtatttttgacaggctacctggtaatgtgtcccctttactaaatccaaaatctggcttatccctccaggagagatcttgtatgactgccacttttgcttcagcagctctggatcactgtgacggaatgggcnccatgata

SEQ ID NO: 544797 - DNA, 356 bp, Homo sapiens
  misc_feature (312)..(312): n is a, c, g, or t
  misc_feature (331)..(331): n is a, c, g, or t
taggttcatgattcattttgagttcctttttgtgtatggtgtgaggtagggggccaactacatttttctcctgtgggtatgcaggtgtcccagcaccatttgttgacataaataggatcttaaaggacacctgggagccctttaaaacccaccacctgggggagcagggaggtaggtgggagcacctaggcgtggggcctgggctgggggaaagtgctcttgggaaaatgccctttcctgctgggaaggagcaccagtgagcagctccccagcccctgcttcttcagccttttgtgtttgatattgttacanttcttgtgttgttgttgtnaactttgctgtttcactagacccca

SEQ ID NO: 544798 - DNA, 158 bp, Homo sapiens
gacgtgcggagcaggcaccaggggagtgtgcacggtgctggctcagagcggccaaccccggctcccaggctgaagccgggcgtctgcccccatttcccttttctctaatccacccttcggcaggccctgaaatctgaagggcttagttagtaccttgc

SEQ ID NO: 544799 - DNA, 378 bp, Homo sapiens
gagtaagtgggcattggtctatggttgggtgggcatcagtggtagtagggcagtgggagggcttatatgggtttacccagctataacggggccatctggcgtcgtggtgctttccacgttataaaaggttaatatttaccagtacagcacggggcttaataaagacggcactcagaaccacacggcacagtccagtttttaaaaaagctggctacatgacagacaggtattcccacggagtgagtatggagaaccaattcaaacgaagtaaacaagaaccttaaaacccaattagcacttgattcaaagccggtcctggtaacttatccaactttggccaaattcctaccaatcaccttagtgccaatcaacataggg

SEQ ID NO: 544800 - DNA, 468 bp, Homo sapiens
agtaagaggggaatatttatcaatgagtgagaaaatagaactacattcaagcaaaccaatcattcatcattaaaaaataaatttgatcacagtctctgtataaagccaaatcggatttactatttggttgctttttaatgaccttccattttttctttaagagagtttattcctaaatgttttcacatggggaactccaggactctgtacacatgcatcagttttggccattttctgttgaagaaagtagaggaagactttttgatctgaaaaaaggagctcttgggtttgacaaaagcaagaaaattatttcacaattacatatggctttgattagtcatagttgtcaaaactcagcaatgtcttgtcattcctacaacaacttgataacttggcaaactaggtatatttatcattagtttgaagtaaggaaacagagacctaaagtatcattgcactataatgaaa

SEQ ID NO: 544801 - DNA, 169 bp, Homo sapiens
  misc_feature (69)..(69): n is a, c, g, or t
ccccacgagtacgtcgaggcaccaggcggatacagagcttaggagacatagcaactgtgtagagcaggnggttacaaacagccacaaaccggtcataggccatcacggctaacatgaacatttccataatcacaaatgtgcagccaaagaaaaactgcatcatgcaacc

SEQ ID NO: 544802 - DNA, 1037 bp, Homo sapiens
tttgttggtctttgcctcttctttgtttgtttttttccccttcagtttttttccttgttctttctatgtgttcatccttttgtgtctctttgtatgcctctccctttgttgtatttctattgttccgtcttctgtttctgcgcatttctgctgtctccctgttttttttgcatattttttcacccctttggggttcttgttccctgcctctcgtttggcccttgctatcttcctatccctttctccctttccctttcttgttgtgtacattgggccatcaggaccttttagcatcttccctagcagccgattgaagcggagaccaagtccactgtgagctggacctggtctgaggggcaccagccccagaaggtggcccggcgcgtgttctaccaacagccgggagtgctgtcggcagcagaacgttaacggatgccttcgtccgacgctgaggaatgctgcttgccgacgcacctcgcccgtagccggatatgctgagcaagcaacgaggtgctccgcctagccatgaagtacatcggcttcctggtgcggctagctgcgcgaccaatccgcagctctggccgcaggcctcacccctacccgggcctctgcaaacggccggtgcaccgggtcccagatcgacggcgcccgccggggatccggacgcagggccgaggcggcagcgcgcttcgcagcaccagcgcccccggccgaccccgacaggcagccccggatggagctggcccggcccatcaagaatggagcaaaccggcttttgagccctagaggtacagggtgaccagcacgcaggcagtaacctcctgagccaggagggcaccagggactcggccgagggccgtcaagagtaagggcagtggacgtgcggcgcaatgcttgggagcgaacatcaccccgagagaaggacgcatgctgccagacggatcaagccggtcaaggtctcgggggtcccgaaggggatcagtcgacccctcagggacccgcagacccagtaaaaaaatcacccacaaccctctgta

SEQ ID NO: 544803 - DNA, 1585 bp, Homo sapiens
tggactaaaagtgttgggttggcttttttggccccaagtactctgggaaatataaaaccaaatataatgtaaaggtgttctcttattccagaaactatatgtcaatgggtatttgggtgggggtgtttcttatccagtaatattatgggtcacagggtattaagtgggtggactggtataaatatttatatttttggagagagaaaatttgtggcttatactctaaatgtcccagagaagaccttcgcgcaggtgtgagaccgcctctttttggtccagggtcgtggcaaattccatgagactatgcgccagatggtgtgtgtgttaatatttgggtgttatacaggtgtgtgtgcgctattctttattctctatctctgtatagacaaattctcctttatatgtaatctccactcttctccccttctctgtgtgtgtttcacacactctcccctctcccgcggctctctctctctacaaaaaagagagaaacctgtgtggagacacacctgtgtgttgagaaaaccccacagagagaaaaacactctttttataagtctccttatattatcaccccctcaaagctatcacgccttttctacgaagactccgctgtgtgctgccgtgaggggtgtttatacacacatataccgacgtgtgcacgagtctacaacacaccgcacactagttgcgcgagctattattctttctcctgctgggcaccatatagaacgaacactcttctttttttcttctccaaatcatcagccacggtgtcttatatatagtggccgagaaatagagactctccctctcttttataaccccgatataagaagtagttgtcgtctccgccggttggggggcgttgtggcaacccaagctttcttctttaagaggacaccacactatcatttcacaggcggcgggggaaacgatggcaaccacgcacaaagtcgaaaaaaaagagcgcccgaggggggggcgtgcgtcccactttattggcggggaaaacaccccacgggctgtccttagaaacgtgttgtgttccccccccctaccaaaaaaagtaggtctgcggggagcacacacaaaatgtttgggcgcgccgcgtgtttcggaaacaatcatactttataagcgctacaacgaacacacttttctcgacgcgtgctcaacaagattttttacaacaggggttgggggggccccttctctcacacaaagagtatagatctgtggggatatctaccccccctcctttgtggaacaagggtaattattttccgtataacccctgtattaaaatgcccccacggtcttttataaaacacccgcagcttatttatacttacactacgccgcacttctatctaggcggcaggaaacatatacactcagagggccgccgtgacaaaacaccgctttttgttcgccacacccaccaatgtagcaacgtcataaacaattaacagacatctgttgtttcccacagggtgggacagactccccatactaaacgtgctcaaacacaatctttgcgttgtggatatcacacgctagatcgtgattgccaccacccaca

SEQ ID NO: 544804 - DNA, 230 bp, Homo sapiens
cggggggtttttttgggggggggggttcgggttcgcccgggattacataagagccccctttttttcccccccccccaaaaatttggttagggggggcggggggcccatttttccccccttttttggggggttggggcgggagtttgtttttcccccggggggcaggggtttgggtggcccagttttggcccctggccctcccgcggggccccggggggggccccctttta

SEQ ID NO: 544805 - DNA, 102 bp, Homo sapiens
tgcgcatcgacatctggccggggctcgtcgtcgccatcacgatcccgctggtgctggcgatcaccttcgtcgtcatgtactactggggcgtggggctgcaca

SEQ ID NO: 544806 - DNA, 715 bp, Homo sapiens
  misc_feature (476)..(476): n is a, c, g, or t
  misc_feature (660)..(660): n is a, c, g, or t
tgcagtggttcatgcctgtaatcccagcacttgggaggccaaggcaggtggaccacgaggtcaggagttcaagaccagcctggccaacacggtgaaaccccatctctactaaaaacacaaaaatcagccaagtgtggtggggggtgcctgtaatcccagctacttgagaggctgagacaggaggatcacttgaacccaggaggcggaggttgcagtgagccgagattgtgccattgcactccagcctgggtgacaagagcaagactgtctcaaaaaaataaaaaaaaagatttaagagcaaggttggtaggcatgagagtttggtgcatagaaacatgcagcagagagaggatattaaagcctaaaattccaaaggtatgttcagcaagatatatgcctgtgctgggccataaaacaagtctaaatacatttaagaagactgtgcagcatcattcaagttagtttcagagcatatncatcagctcaatagaaacccatgccattaaagtcacgctcattccacctcagccctaggcaaccagtaagctactgtctctatggatttgccttttctgaacatttcatataaatggagtcatacaatacatagccttttagttttggcttcttttacttagcataatattttcattatctggnttgtggctgtatcagactccattcctttttattgaggaatcgtatggatatacat

SEQ ID NO: 544807 - DNA, 914 bp, Homo sapiens
ggtattcttttgtacaaaaaagaactacttgtattctcgacgaaatatgcaatgcttacgtatataagcgggctggagattattttccaatatagtattctttgaaaatgaaaggggatcatctattttagtttaggggtctgggaactttatgaaaatttaatttgtggaccaatgttttgtgaaagctaaagagggcaggggttaaacatagggctgaatttctcattctgtatagaccagcaaacttccctgtgcaaggcaagtttacatcacaaatccaagaatgtatgcatcctaaatgctagttagcttcagcccctagttaacctcaggacttggttttgcatataaaaggtagacagctgatatgttttcatgactaaatatttgtcagccagaacaggttggtgtacaggtaatgcatatatatattaagcttggtattatataaatttttcatttagttaaattgggaatggttttcaaagaactctcagtatctgcctaggtgtaatgggggagccctgatttccatagtgtacattccatttacagaggtagtctaaaagtctttaacattaatagaaaagattttacatatccaaagagtaagtcaacattacaggataataaactttccacaacctttcctgtacgagacagcataaaaggcacaagaaaaggacacacctggaacatcatgtaacgataggacacttatccatactattggtaccctggttttataacattaattgttaggtgtatttttacattcacatgttacagatcttttagaaggggaaccgttaggaaatatggaatatagaacctggataacatgagaaagagaatttacaaaatttaccataaaaaagacacaaggatgataagggacaaagtgtcataac

SEQ ID NO: 544808 - DNA, 162 bp, Homo sapiens
  misc_feature (97)..(97): n is a, c, g, or t
ggtagaaagtgtaaaaagggatcaagaaaatcccctagaataatgaacaactattcaagatttcaaaatatacaaaagttaatcactttcctatatnccaacaatggatgagtggatttgaagttaaaaacaaagtacttctactttagcacccccaaacaa

SEQ ID NO: 544809 - DNA, 168 bp, Homo sapiens
tcagcacatggaggatgcatctataacaagttagtacctattttgcacgcatgaagactaattcaaagtctatttactggttatagctctaccagtacggccaaaaccatttctttttaagtgagaagtggggatatggtcaggttatgattccagatagaagttgtg

SEQ ID NO: 544810 - DNA, 653 bp, Homo sapiens
ttctagatcgcgagcggcgccttttttttttttggtccttaacgggtggacctcagccagggggggtccggggggaaaaaacattccaaaggaagccatcccttgggggaaatgggtttatacggggtaaattaatacttttattttttcccctatcccttccttcctagatgggggataaacatggggagaggaggttgagattagggatggctgggggaattgtcctccccttaagaaccttattcccaaaataagggcagggattatcgttcaagggttctttcaagggggcgtcattatagcgagtggaactctcatccgggggcttgggatacgagtggagaaattccccaactaaatgggaattctctgggtttatccccttctcttccttcaccatttgggactacctttgctgggtgttggagtcccaaatcagattcccgggtaatgggagacgaatgtttaagaatcttctcagggtggggataaacgtcacattgagaaacccaaacgacgaactatatatatttgcacgtgttttattgtgcttaattggagttgttgtgtccaataaaaaaaaaacaacttacattattatcaaataatttgctgcaaagtcagtgacaagacgaaaacaaaaaagaggg

SEQ ID NO: 544811 - DNA, 170 bp, Homo sapiens
gtttgggggccccaaaattccaaaatccgttggggctccccccaggtaaagccttgggcggggggcccccccctggtgcccccccggggggggccccccccccccccggggggtttttttgaaccctttttttttgggttttttcaaaaaagggttaaggccccccccca

SEQ ID NO: 544812 - DNA, 382 bp, Homo sapiens
aacgcactcaatattcagaagtttgaattctaccactctcaaacacagttcaaaagatagctgtttgagaatgcttcttaactaatactagtacaatatcttcaataatgtatgtaccttatagaaaatcttgaacagtacaagattttcataattaaggcatgcaaaactgcttgggctctttgattccaggtgtcctcttctcccttctgcttttgccatctatgttcaatataattctaacccagtctaagtatggagaaaattcctaccctgcctgcttttatagctcatcaaatttccctgtatcagctatcacttttctggtaggtgtagtctgatttctgtctgtcatgcctttgccacaatcctttctttgaag

SEQ ID NO: 544813 - DNA, 406 bp, Homo sapiens
tgagttctgctcagtgacattgctttctccttatttaccccagttaagggccggggtgtggaccggggcgtcccagagtgccagcgtttcgtcatcaactttcagtaaggtgattgagaaaccggtcatatccagtgaggtgcagtacgcgccaattaaattacgttcgatagtcaatcccgcttgctggcaacgtgtggtcaggcggttatagacgccgtacagctcagaaagcggagttgcgccaagattgttaaccagcgcaatcacccgatcgccagactggagcggttgtttggtttgttgttcttcctgccaactgccttgttgataatcccagaaacgcaaagtgcgatggtatgagccatttaccagcagggtgtcgaacatttcatcgacggtttga

SEQ ID NO: 544814 - DNA, 331 bp, Homo sapiens
aggagaacctgggactcccaggccatagtttgtcttggccatgtaactttagccatgacagtgatctcccactttgttcatttagagagtgaaacagattagtgcacaggatgaactgtaggctgggcatggtagctcacgcctgtaaacccagcactttgggaggccgaggtgggcggatcacgaagtcaggagttcaagaccagcctagccaacatagtgaaaccccgtctctactaaaaatacaaaaattagctgggcctggtggaacgtgactgtaatcccagctacttgggaggctgaggcaggataatcacttgaacctgggagt

SEQ ID NO: 544815 - DNA, 413 bp, Homo sapiens
  misc_feature (1)..(1): n is a, c, g, or t
nctgacctatccgcttgagactgatgtagatccgatgagccacgcgaaggagctcgtcgaccacgtgcctgtcctgtgacaggaatactccggagaagacgcgccgatatgagtcatgcgtgtctatcctgtatggcctcatgaccatcaccctcagagtgcctgagaatggtacaacgggaggtcttggcctagcaattatctctttggttcatggacctcaagcacattgaagatatcttcactgtgcttaagaatactactactctgattgtgtctactgattggctatcagaaccttaggctggacctaaatagattgatttcatttctaaccatccaattctgcatgtattcataattctatcaagtcatctttgattcctggacctaataaattttttttccctttc

SEQ ID NO: 544816 - DNA, 170 bp, Homo sapiens
tggagattagatacccactatgctttacttaactcaacagttaaatcagcaaaactgctcgaccagaacactacgagccacagcttaaaagtcaaaggacctggcggtgcttcatatccctctagagggcctcatgtgtatgagcctcatgtgttggagcctcaggtgta

SEQ ID NO: 544817 - DNA, 1358 bp, Homo sapiens
  misc_feature (1263)..(1263): n is a, c, g, or t
tgggagtcatgtgcccctttattaggctgacccattacttgaaagggatggaaccgtgaggatgtggtgtggccccgatgccgggccggccatgctttacgggcttgtaggtgatgggaaaatctcgcccaggtatgtggccagatcatctcgggcttgatctcacacctgggttagaagtgttcttgccgttgtgtaaacgcccacacattgtctggcccaccattctcggtgtaggatagatccattgtcccgcaggtgctgttcttcaccatcttccggttttctccatggggcggggcctctctttctgggccttgcggcagggcggtcttacaagaagggagagtgtggctgggtttccagccgaagtgccccggttacaggccgaccggccgttgtgggcgccgcactgtgtaacagttggaattcaggttggctacgataagagacattgtgtccagcaagtctggtgtacagaggggtcccacacgcccgagggtaagtgtgagacactttggggagaaagtgtcccgggattactatcgccttactggactatcaaacattgcgtaggcgcatattttagggccggagaaatattacgaaaacccggttctgggaaatcttattctcgtggcgcccggacgcaattatacaatcgcgataagatcactacaaatgcgcgcctctcccacaattaccctataagcagaattctctttttacatataaacaaagaacgaagggttcacagagagtacccttccccttatacccaattcaaacaattccaaattggggccccacccaaagggggtaagctggaaacctacagaatgataacacccgggaatataagaggagcggggacatcaaattcctttcgcaagctgtccctaaaataataatttcccccccaaatatatttacctaaaagaaaccaacggggcggacccttggggaaactccctttggactctgtgggcaaaactcgcgaggtaaagtcaactccccagaattgtgagaggccccccaatttgtgaatattagatgacctgttcacacaaggacgtttttggcagtcacttgacactggtccccccacaaatataggggataacaaacagagttgacattccccggaaggtttaaacccaaaagccccatatgtaaccggtatacaagagcgggggggcatcataaaggggaacggctcttaaagctctctgtgcagccaaccaaccgtttacttcgcccacnagctaagaataagtcccaaaaatattagaaagggcgagatatgtaataagagccacatcccctttagcagaagaaaaactgtatcttgtcgggag

SEQ ID NO: 544818 - DNA, 865 bp, Homo sapiens
gacccacgcgtcgagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaaaaaaaactcccaggaaaaagagcctaatttcgagtgtgagcttgggcttgtgaaagttaaccttgttaaccaccagggaaagcaggcacagctgtgaattaggaccagagcgggactcaagaatttctcacagaagacagggtcagcttgaggggcctgcacacacggggttgttgaggaacccacagatgggcgccgagaggcctgccttttggccgtgcccaggttcacccccaccttggcccttacctccttcaaggaagccttcccagctacccgaagctcagggggcgcttctggcgggtccccgtagccaccctgagcctgtacctgtgggtggcctggtttgctatctggtgctagccggttgtggcctcgtctcgctgtagattgtgagtccccttgggcggagacccggtcgtgcccggttgccccgcccggtcctgtcacttgtcatgaaagaacatgaccgtgttcggtcgcccagaaatgccacgtcatggggcgcgactggcggatatggccgaactcactgcacaaccgg

SEQ ID NO: 544819 - DNA, 249 bp, Homo sapiens
  misc_feature (189)..(189): n is a, c, g, or t
gaagagcccctggaagcacacagaggtgttctgctccatcccatcccgctccctgctctccccaagctactaccacagctttggagtcaccgagaactatgtcatcttccttgagcagcctttcaggttggatattctcaagatggcaaccgcatacatccggagtatgagctgggcctcctgcctggntttccacagggaggagaagacttatatccacatcatcgaccaaaggaccaggcagcctgt

SEQ ID NO: 544820 - DNA, 582 bp, Homo sapiens
gtgagaagagccctcgctgctcacaggcaatgctcctacagtgtaaccctggtaacctgatgcagattcctgactgcctcacccattaggggaaatggaagacttttaaaacacaacaatgataagtagttaagatcctaaactgcaaaatatattctatgattgattcattgaccagcagaagaaagaaacattttccctgcattgctggtgaaagagcaggaaaaatcccaagtagctcctatttcccagccccaacaagagggaagacagcagggggaaaagtgaagagaaaacaagggtgacgggaccactttgcggtagtcaaggcagggggtggcggaagggccctttatgaaaacacaggtatgatatgatggctgttcctgtgtgttcccgagtcacccaaaaacagttcaaattatgtttgacattctcattttggcacagggtgaaaaagtgtggtctattctagaaacaaaaaaaaaaaattaaaacttccaatgtgttgaagcttaagggattagcatttatccagaacgaagaatgtaaaaggactttgtagatgtcttccccaaatct

SEQ ID NO: 544821 - DNA, 348 bp, Homo sapiens
tttgagataaaggtagatctatcttttggataagctggattcagtttgctagaattttgcagaggatttttgcatcagtattcatcaaggatattggcctgaagttttcttttgtttttgtatctctgcaaagttttggtgtcaggatgatgtagcctcatagaatgagttagggaggagtttctcctcttcaatttgttggaatagtttcagtaggaatggtaccagctcttctttgtacatttggtagaattcagctgtgaagccgtctggtcctgggctttttttttttttttttttttggggggggaagcgcatattaatgggctgcgcccacatttcacaaac

SEQ ID NO: 544822 - DNA, 925 bp, Homo sapiens
attaatcccctggcccaacccgtcatctactctaccatcttagccaggccacactcatcacagcgctaagtctcgcactgattctgtttacctgagtaggcctagaaataaacttgctagcgttttagttccagttctcatcacaaataaactaagagcctcgtcacgatcagaacgcgtggctcgatctaagtattgtccctcgacagcaaatgcggaccgctatccaataatctcattctaataggcttgaatcctcttctaaagcatatatactcgtccggacatatgaaccataactcaataataccaatcaatactcatcattaataatcataatggctatggccaataagagctaggtgaataagtccaccctttaactttcttgaagtcaccagtgaggggttagcccagagaggtacaccctctgacgatccgggtctgcttgattgctcaatagtgaacaagaaaaataagtcccccatctcaatcatataaccaacatctctgcctctacatctaaatcgtaagggctttctcgctcactctctcaaatcttatccatcatagcaggcagttgacggtggattaaacccaagtccagctatgcgaaatctgaggatgactcctgcaatttaactcacacttgcgattgaataatcaggcagttctacccgtagaacccgtaacataaacattcttaagtttaactatttgtaatatccttactaataacggatgcatagtaaacaaagttaaatccaggacaccgaacctaatattaatcggaccgaaaaaggtagaatggtagaccctttaattcttcacctctcttctagagagagccccggacagtgttgcacagcgcttggatgcaaaaaaggctccccaataacaacctcattttttggaattccccaaa

SEQ ID NO: 544823 - DNA, 276 bp, Homo sapiens
  misc_feature (151)..(151): n is a, c, g, or t
  misc_feature (177)..(177): n is a, c, g, or t
  misc_feature (193)..(193): n is a, c, g, or t
  misc_feature (207)..(207): n is a, c, g, or t
gcatgaactgatccactgtcttccttcttagcaacatgtcttcaaatccactttttagagtttacttgtctctgaagtaccaaacttaaaagaggcaggtgttggaatagaagtagcaggtagacatctgttttctcgggattctgacaanggcagcacattttgtagaagctcccnctcattttggtaccanaacatgcactgcanatcccactgtacctatcctttgtagaacaaaacagattctgaacatcacgtgttaatagagttatagga

SEQ ID NO: 544824 - DNA, 779 bp, Homo sapiens
  misc_feature (426)..(426): n is a, c, g, or t
tatcagttgcttcacgattttcagaactgggagatttactggtgtaactgggtagtcttctgatggagaaaaaccttattttctttgtaagagctgggagcaaacacgttatgagtgtgtcggaatcccggtgcttcaaaatacgctctgtaaattacttgttctagtcttattttacaactgtctcattgtagtcttgtcttcaactattttatccagaaaataaacctccagaagaacagtagttttcattgtacttagctcatgttgttggtttagtgagtagtcgcgtatggatttggccaaagtaaaaaggcaaacaacatgacatttctatttggttgttaacagcagaaaatacttcttgggggagtaaaatgttgctggaggcattaggcaattaaatatgggcattctcctatttcntgtggcccgtccctgaagttacatgttcagtagagacacaaaaacaccgccaatgccatctcaaaagcacctgcttggggagcgtcggggtgaagagctgtgggagtcggaggggacctgcccaggggtcccgtgtgactctctggagtctctcaaaagacacaccagggggtccaagaggccaccacggaataaacgtttatcaaagtcaacacaatcagacatttatagctgacggaaaggaccttttagtgtatcacacttcttgattaattgtgggcatttttaagaacatttaccaagggctgggctgggcccaggtgctccagcctggtatacaggcctttggaagc

SEQ ID NO: 544825 - DNA, 962 bp, Homo sapiens
  misc_feature (27)..(27): n is a, c, g, or t
ttctaatgtgcccacgcgccttgtganccctttctacacatagttctgtcgccgatttcgtttccttgtcggattccccatgccctcgtcctccttggagtccttttcttccgtgatagatgccaactgtggggctaacacctgaggagatttgcccccaccacggccgtatatctgccccccttgtgggggccccccatcccgaaatgggggcgttctacacaggccgtgtgtgcaagccgcccacccgcgtgggacggggagcccacaatattcgattttcctcgtcggggatattaccgccgttcctttccatcctaccgccagcggtctttctcccccgccgccctagatctccccgggggtatctttgtggccaagaggcgattacttggttgaatggcttttcaacaaccgcccgtcttatcaatagccgcccaggtcgtccacccactactgttgtgcccacctggccccccatccacgatgtgtgggccaccgcaagggtccttatttttccgggctgtgggcgcaataaccctggatactactcagggccgagattacccaccatggtgctgcccactgccgctgaggggttccctggctgaccccgcggttaacattggataaccgctctcccccctttgaagatttacccccccaaaaagttctgtctcggcgctccccttaggagaggccaagaatccctcccaggtgaatttccgagcggcccctgtggtgtctcccatggaggcgagccttccaggagatatttgttcccccgggggctaagtagcgtgctccccacaagagaacgccctgggtcgtacaccaccaagtaggtacccacaaataatgggctcggcaataagccccacgacgaactgcccaccaccgaaacccccgggccctctctccgttttttaacccaaaaaaaaaccccggttttcccaaaaaaa

SEQ ID NO: 544826 - DNA, 400 bp, Homo sapiens
caagctggggcttaaagttatgtaaaatctgatttaagtttttttcctttccaaggaaaggcccctgaaaggaggggacagggagcttcctaggtctgtttataaacaaactgatgctttgtcaagtcttccaagttttccctgtaaataaaacaaccaacaaggtaattttgctgttttttaataaagaatgaatgaatatattaatgtattccatttgtttcatgataaaacagttttccctgaaactgtgaaatcctttttttcctttttagccctgcaaaaaaccctactaaataaatcattttaaacatggagggcaggtggaccctgtgtgaactgtttttggtcagttattgtaaaaattgataaatgtcccaaataaactttatgcccctta

SEQ ID NO: 544827 - DNA, 280 bp, Homo sapiens
accttgttcgaggcagtgtgatagtcatgaggtcataggagtagttaggaggaaagttaatctataatgaagatcaagttgaagaggaaaagcatcttttctggagccctagtcttttgcaacattttacaaaacaatgtaggtaaagaaaaggctaatctataatcagaggaacaaaggttacagctgcctaggttacagctgcctaccacatgactcagcctccataatcacattcctttaaggctcaaagtaatttaaagttccaacaacattgatt

SEQ ID NO: 544828 - DNA, 200 bp, Homo sapiens
ggggcatttaacagtatttaatcaatttctcattctattacatatgtctacttctataaattatccacatatggcataatttctaagaatattttcacaaagatgttcactgcattatcatttgtaattatgatcacctaaaacagattgtgaaatctgctttataaaatatctgtgagttgattgggttgacgtcaggt

SEQ ID NO: 544829 - DNA, 192 bp, Homo sapiens
  misc_feature (106)..(106): n is a, c, g, or t
cactccaccttaccaccagacaaccttagccaaaccatttacccaaataaaagtataggcgattagaaattgaatgctggcgcaatagatatagtaccgcaagganaagatgaaaaattataaccaacataatatagcaaggattaacccctataacttctgcataatgaattaactagagataactttgca

SEQ ID NO: 544830 - DNA, 356 bp, Homo sapiens
ctcccgacacatcgagaattgagtcctggatagacggcagtcagaactgccattccagaatggaaccatccagttgttaaactactaatctagcccaaatcctgactgccctcttagtcggctcttgcgtgtgtgtatagcaaatgctgtaaggaatgctaatcgatgtgccaatttcatggactatcctactttgaatgagacagaaatacagtctattcctcttctggaatatgtagttcactatgcgtgccagaggcccagatcatgaaacttgttgagagttacaggctgtccagcttaaggaattagtaccagagtctcatcagataaccttgtctcacagctattgcaaa

SEQ ID NO: 544831 - DNA, 274 bp, Homo sapiens
  misc_feature (2)..(2): n is a, c, g, or t
  misc_feature (156)..(156): n is a, c, g, or t
  misc_feature (183)..(183): n is a, c, g, or t
  misc_feature (205)..(205): n is a, c, g, or t
  misc_feature (213)..(213): n is a, c, g, or t
  misc_feature (249)..(249): n is a, c, g, or t
cntctgcgcgcagtgggcgagatctcaatcagccccaggctgcaggtgaggcttcaggggatgctgggccccactgcccctccgctgccttgccctccatccttcctctgttccttctggccgggcaccacagcactggggtcaccgctgccttgncctccatccttcctctgttccttctgnccgggcaccacagcactggggntcacctcntggttgatcctcttgtactgggagaggtgccttttntatccccaattaaaggtagaaaacc

SEQ ID NO: 544832 - DNA, 611 bp, Homo sapiens
  misc_feature (122)..(122): n is a, c, g, or t
ccacctgaccgtccctcctctggctcctacagcctctccacgtctctgcccggctgtcccgagccatgaaccactcggcacacttccacttcacctgctgcctaccccgagtccaagacccncgtaaccgccaccctctcaaaatccggaaacacattccggcccgagctccacctcgtgcgccgccgtcggaggagctggccctgaacgagctcgtgacgctgcactgcctgccacgcgcttcagccccaaggacgtgctgcttcgctggctccaggggtcacaggacctgccccgcgacaactacctgacttgggcatcccgcaggacccagcagggcaccaccaccttcctgtgaccagcatactgcgcgtggcagccgaggactggaagaagggggacaccttctcctgcatcggctgccacgcaggccctcgcgctggccttcacacagaagaccatccgcacgctctggcgggtaaaccccaccccatgctcacatgtgctctgcttgtccatggcggcaggtggcacggcacctgcctcactgagcccgccgcgcctcgtccccccaccccgtgcaataaacagtcccatgctcccccccacac

SEQ ID NO: 544833 - DNA, 523 bp, Homo sapiens
  misc_feature (52)..(52): n is a, c, g, or t
  misc_feature (262)..(262): n is a, c, g, or t
  misc_feature (299)..(299): n is a, c, g, or t
  misc_feature (342)..(342): n is a, c, g, or t
tattatcaggtccaaatcatagtttcttttatcatcaaaccagtagccatgntttttctaattctgtttttcagcttctggagccaaattttgtacacctctggctgatcgctcttaaattatcttctgaaatctctttcagtgggacgacagagatctgactgacaagctttaatagcagcatttcttacagcattatcagcaaggtggtttcctgtagcctcaagagtctaaccatggccaggcacaatggctcataccngtaatctcagcactttgggaagccaaggtgggcggancatatgaagtcagaagttccaagaccagcctggcctagatggnaaaatcccatctctactaaaaatacaaaaattagccaggcgtggtggcgcatgcctataatcccagctactcaggaggcagacaggagaacagttgaacctgggaggcagaggctacagtgagccaagatagcaccaccgcactctaccctgagcaacagggtgagattctgtaacaaaaa

SEQ ID NO: 544834 - DNA, 171 bp, Homo sapiens
cactacggctgcgctgttctgcagcagccgctggcggtcgaataccctcagccaacagcatgccggcgggcacggtctggaaagactggcgcgatcgcaagggcgagctgttccaggcggtgcgcatggagaagaacatgatggggctgctgctcagcctgatcgtggcgg

SEQ ID NO: 544835 - DNA, 353 bp, Homo sapiens
gacaacagagtagacccggtctcaaaaaaaagacaagggggtagaaaagggggtagggcatttaaagagatacagaaaaggcaaggcagaaaaaggaaggagcccagggttcagagtctgggcttaggcatcaaacagatacaggttccagggccggctgatcttagcaagttctggattccaacttcttgggaaaaaccgacgggttaaatggaggtaagtgctacaaagggggtagacacgtgtactggtgggagatcggtaacctttaaagggactaatcagacagagtaggtgcttacggacatctcacggacccaggaatctggcaggtaagcagctctgcaacggct

SEQ ID NO: 544836 - DNA, 1330 bp, Homo sapiens
agcggggtggacggatataatttacaacattttagggatagtatctaggtagcctgctgtagtttgactatccagtacactgtatgttctatatcacatatataatattgtatatattctatgtagatagaagggatagactgcaaatatagtaacttaaagtagtacaccagatattctagtttgaaagatccttcaggttttgaatataaaaaaggccgaagacagtatgggtgaagtctaacatttttgtggtttcttcatttttcttacagggactggcgctgatgatggctctggataatctctcctactcttttaaacctaactaatacctagaacctatattacttctaaccactgacctttagctatatatacgactgacttggtgacaaagcggacttactggctggtaaaaactatctacttttactctataaaactcttaagacttggtacttcgctaagacttaatgtgcccaaggagctcttttagaagaaaaacctctactaaggcgcataacttgaccaaaagggtcactgatcgacactatcggctacgactactcaactgcacttacgaaccaggtaaaagccttaaccggattactcctggactcttaactctggacttattcgctagacaaccacttaagctacagaactcttggaaacacttcttaaagactcaaactggggagggggcttactactgtccggaaactctaaactcaggactaacctctactcacaacgcggcttaaaaacgggcgacttaaaactctcttttaacggcggggaccttctcttctactttacggtccttaaaacgcggccttaaacttgcacggctaacgggcctgaaacctccttgaaactggcttccttactcggcttttcccttcctaccttacttactcacaacgctctggcaccccacgaccgcgccttaaatccttcgtggactggcccctagccggctgcgtggggcaaaacaattcttcttcttttccctgcgtgacaaaccttaccctgccttgaccttcctgcagcttctccttcgtatgccctaggagaacctctttgccttctgtcctctatgaccaaaggcgggctctgggccttatacctggcgttcctcctgagacctctcttgtgagggctttagctctctgggtcttacagacccttctttacctggcccttctctctttcgcgatcctccttttcggcgcgttgacgccgctctgtgtgcccttcctgttccccctcttctaagactcttgggggcggcggggctcgttaaacattcttgcctttagcgcgg

SEQ ID NO: 544837 - DNA, 462 bp, Homo sapiens
gctcgctgatctactccagctcccgagacaggtctgagcgcagctatctccaccttcagccctatgcggtagcgctcgagctccagctcctcctaccagctcctacgaatacgtagcctaaagctcctatgagctactaactgcagctaggctagccgagggcctagtacatacctcaataccttgcgtagagagcatatacagctcaaagtactattttatttcagccgctcatccagctagctagctttgtcattctccaggtccatgatgctctcctgggtcagctacaggtcgccctccagctaccgattcgctcgctccaggtccaagcgcacctacttctcttgctccagggatccttccagatcatccacttgctagtccaagttgattatggactaagtcagggtgagaccttgtcctcctcggcctagaggtcatccagagcctgtaggtggg

SEQ ID NO: 544838 - DNA, 877 bp, Homo sapiens
agcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgatttttttttttttttttttggggggggtagttgaataaaatggggcagctaaattttttcagtttcctatgtgcctcccaaataaaaaacaggaaaataagctagttttggtgaatggcacttgcagaacaaagtaaaaaactgtgctgcatgatgttatttggtaacacagatgcactttttctgaccggggcacttgccatccaattttctgtcaatcacactgttgttttaacgcagcagaactgagggggaaaaatgacttcgttgtataccctgaatggcttggcagggtctcattggagataatggatgtaagaatcctgactttttatattgggaacacttcaattaacatgggcaacatgacaacacacaaccacaacaacaaaaaaacgacaagatcaacaagcggcaagcacaacaaaagcggcggccgcacgaacaacacctaagaagcacaccaatgatcgaggacaacgggcattatagcaagaaaggccccaacaagagcgacatacagtaaccagcgggtcataaaaaaccctgagggagaacggacagagcaactcagggagccaagatgcgggcagacccggagacacccagcaaacagaggcaaagagagctggcaaccgaagccaggagtacatcacgaac

SEQ ID NO: 544839 - DNA, 544 bp, Homo sapiens
  misc_feature (1)..(1): n is a, c, g, or t
  misc_feature (3)..(4): n is a, c, g, or t
  misc_feature (8)..(8): n is a, c, g, or t
  misc_feature (14)..(14): n is a, c, g, or t
  misc_feature (22)..(22): n is a, c, g, or t
  misc_feature (114)..(114): n is a, c, g, or t
  misc_feature (220)..(220): n is a, c, g, or t
  misc_feature (242)..(242): n is a, c, g, or t
  misc_feature (294)..(294): n is a, c, g, or t
  misc_feature (307)..(307): n is a, c, g, or t
  misc_feature (332)..(332): n is a, c, g, or t
  misc_feature (339)..(339): n is a, c, g, or t
  misc_feature (357)..(357): n is a, c, g, or t
  misc_feature (366)..(366): n is a, c, g, or t
  misc_feature (382)..(382): n is a, c, g, or t
  misc_feature (405)..(405): n is a, c, g, or t
  misc_feature (411)..(411): n is a, c, g, or t
  misc_feature (430)..(430): n is a, c, g, or t
  misc_feature (435)..(435): n is a, c, g, or t
  misc_feature (438)..(438): n is a, c, g, or t
  misc_feature (443)..(443): n is a, c, g, or t
  misc_feature (457)..(457): n is a, c, g, or t
  misc_feature (462)..(462): n is a, c, g, or t
  misc_feature (467)..(467): n is a, c, g, or t
  misc_feature (470)..(470): n is a, c, g, or t
  misc_feature (503)..(503): n is a, c, g, or t
  misc_feature (534)..(534): n is a, c, g, or t
ngnntgcngtgtgngtaggtangtcatgatcatcctctcttcagtgagactgagcctgatgtgtaacaaataggtgaagaaagtctggtgctgtatcctaatcaaaagacttantatatggaagtaacacttttttagtaagcaagatacctttttatttcaattcacagaagggaattttttggtttcatgtctcagatttatttggtatttctttttnaacactctacatttccctggtnttttaactcatgcacatgtgctcttggtacagttttaaaaggtgtattaaantctgacatgtcantgtggctagtttaattttcctggtntggcatnatgtgtatggccggaagngtgggactngcaaaaggggaagaanggaatggcgaatacttgtaaaangtcacnagacattggtataattttnatcanganatcangttttgctctgatngtccngaaangtnctaaatactcttattttgaatgcccaaaatganttaaaccattcatatcatgtttcctttgcgntcagccaatt

SEQ ID NO: 544840 - DNA, 280 bp, Homo sapiens
  misc_feature (80)..(81): n is a, c, g, or t
  misc_feature (237)..(237): n is a, c, g, or t
taaatcataatgttcaggctgttgccaggtttgtgcaatattttctctaaacgttgtcatccactcatctgcgttagaannaactttaccaacgctgattaactgaataaaaacaaaggaaaagatagcgacatatttactcacgttcatttgtgaccataaaacatttatcaaaaatctactactagcatagcaaagctacaattaacataaccttaatagacccagcataaggantaatctggaatagctgctctatttatttccgcttgttcaagtt

SEQ ID NO: 544841 - DNA, 562 bp, Homo sapiens
aagaacaaacagtgtatcaagttgggttcatatcagaaatcagcataccaaacaactgcatcgtataggacgtttgcattcagactgcctaatattcctggcttcaaatcttactcacagtatatattattagagagtttggtaagtgtaacaaatgggtactcattgctagagcaggatataagaatgtgctgatcaccaagtatgagatttacattacattaaattaaaattatataatgttggaaatagacaatatagggagtacccggatcctagaaaatattatggctaaggaaacagagaactcaagaaatgaatctacctccaagaaactaattcagtatagtaaaatagaattaagtgccctgtctcaggaaaaagtttattaagaataaggaacaagtgggacatcatacatcgtttctttggagattaaagtgcaggctatgaaatggcatataaaataatgcataaaatagtgcaatcttaaggtgccattatctttattacacatagcctagttttatgtccattttctctcatagatccagctgtagtg

SEQ ID NO: 544842 - DNA, 210 bp, Homo sapiens
agtgactttaccaaggtaggtatgagcctggatcataaagagcctgagtccacataagacgaaagtatgaaccgggaagcgttggaatttatgatgtgatgtgatgtgatttatgttttaaagatatcactggtgctactactatgtaaaatgcgcacagtaagggacaagcatgtgaaatagacagtaaaggaggttattagggttagt

SEQ ID NO: 544843 - DNA, 973 bp, Homo sapiens
agaagggccacgccgaaggcctcccggcaagcttcggggaaggaccgccaggacgaaccccgctgtgcgcaggatcaccaccggtggactccccgaccctcgctctggcccacccaaaagattactggagaggaccacccgcggccagaccgggcactaggaggacgtgcaaagaccgccatcgccgctaggggtccactgcccacaagagcgaatataactcagtcatgcatacaacagacccggcaaccctgtgcgtcaccgccattcacgaagctagggattgacaccattatccagaaggcgcttctcgcggcaaggcacgggaacgcctgcaaagaggggaccggcaaacagccccgtgccatcagctatacgtcagcttctctaaccagaaagagttcgtatgctgtactgcggaggttagcaagctggacgcggatggagtgctaccaagtctggacgaaacggctggagaccaagccaggagaaccacaagcctgcggcaggagctgggcgtggatccggacgacatccctgtgacctcgcgccatgccctcacccaagcgctctaccgcatccagaccagccaccacagtgtgctccctcaagcatccaggatcccacctagctgtacagtgccgtcaaagctgagaggaaggattcttatgaaccccgcaccagacccgcgtaaaggcgtgctggtggatcacagtagcgcggctgctggctccagtcacgaagacaatgagagactcccgcacagctctctcggatcccttggaacaccttcttaagttcataacctgtctccagacctgttacctttcaaaacatttgcttggagcttcagcgctggaagctagaaagccttgcaactgccgccaaaatgtggtcctggagatcagcaactgaacatcatattcgaagcctccgttaaagagtgcactgtcatacctaccgaatcagatgt

SEQ ID NO: 544844 - DNA, 145 bp, Homo sapiens
gagactgagcaggcgctctagctcgcgcgcccgctgcatccgtggagaccgggcgccagcaacatcatgctggcaattacagaaggcttcgctgctcgtcaacaaccgttccgaccagtaattgacgacgatccgacctttcgag

SEQ ID NO: 544845 - DNA, 260 bp, Homo sapiens
  misc_feature (198)..(198): n is a, c, g, or t
  misc_feature (206)..(206): n is a, c, g, or t
aagtagcttggactacaggcgcccgccaccacgcctggctaatgtttgtatttttggtagtgacagggtttcaccacattggccaggttggtcttgaactcctgacctcaggtgattcacccacctcggcctcccaaagtgccgagattacaggcatgagccactgcatccgggcgtgggttctaaattcttaatatnctcatcancatttattgctgtctttttaattttagcctgtaatcccagctactagggcgact

SEQ ID NO: 544846 - DNA, 351 bp, Homo sapiens
gggtttttttttaacccccccatttccgggggggcccccccccccttttttttttccccttttggggccccggggggcccccccccccccggttttttcctggggcgggggggggggtcttttttttccccgggggcgggttttcccctttgcccctttcccaaggttttttttgggcccctttttgggggggcccccggggggccggttgggttttttcggggggccccccggggggcgagggtttttcccccccccttttttttttaaaaagaaaagaggaggggagaagggcagaaattgcggggtaaatccaaaattaaaaaaaaaataagtccacccaagttaata

SEQ ID NO: 544847 - DNA, 91 bp, Homo sapiens
gctcacacatgcacaggaatgtggagctacagcaaaaagccagcagtggtccgtggggagtaagagttaataaacacactcacgaaaagtt

SEQ ID NO: 544848 - DNA, 304 bp, Homo sapiens
tacctcatcacagccggaacaacaaaaagtgaacagcatacatggcgaaacacccgtgacagagcaatcgtggggttattcatggtcgccggcctgaaggtatcggaagttgcatccctgactgttaattgcatcaacctaaaagacggtccctggataaacatccgctatccagactcgcagatttcgcaccgcacacgacctgtcgagtgggctgttcaattgctgaaggattggctggccatcatggcagcggctgggactgatggagatctaacgttttcaacagacgatgcttcgcggt

SEQ ID NO: 544849 - DNA, 1036 bp, Homo sapiens
  misc_feature (73)..(73): n is a, c, g, or t
agttgccttagcagcgattcgtatgccggcgcgagccctaggtaagttacattgtgaacagtcgcgtgcattngcttcgtatccttcactgggatcttcatcgagtctatgagttaggctcgactgttgcattcttctcctatatctatacaagactcgaccggcgtcgaacatattctgatcgcgtacatagaaacccagtccacggacttggacgttcgtgcacgcgatcagttttacccgtggggaagtccgtgactcagagcgaagggcagggtcacaggcggcggaaggcgtgctgactagtcaaagactcttaccgacaccgccgcgcacctggggggacgagccatgctcggacccttccgtggaaattgaacccttgcctgaaccggggacaggaaacattcaataaacgggggggaccaatgggagaaccaggcgttttgccctaccggaaatagggaaagcccccaggaactaacaagacatcgccacggaaggccacctgtgcaacatccaactttcaatccgggttacatctgagggagacggggttggcaccttgtccaagcggcgaaaagagcgtctaagtgcctcggcaagcgaacgggaacattcttcctctcaaacggtactcatgcagctagtggaggaacaaggaccccagggtattctggcacacttgagcgagggacagaatttttcgactttctccgctacattacgccaacttcagtttgaatatggctcgacttggtaggaccccccgtgaacgttcgtccaggcatccctgagtacggcccccgaggagcttagagaatgtatgcaaagattaggcgacacccagaaataccttccgaggctaacaacttttgggcaaaaactcttcccccgaccccttcaccccgggcgcgttttaacaaaacagcccacaattatcacggagacttggacccttaccaagcacaccgttccgccagagcgagttcgacagcctgagaggagaacctgaaacaaaagggcctgccgcacg

SEQ ID NO: 544850 - DNA, 928 bp, Homo sapiens
gcacaattaacactgaattgctgaaagcaggaaatgtatgccctttactgtgctgctgttgctgctgttgttgctgctgttgttgctgctgttgctgctgcggcaggtgctgctgctgctgctgctgctgctgctatatggtcttcttagatttgtacttattgtactctcttcattcaacccatccatgttagctctaaggaggtttgaataacgccatctgaaaccttacttcacttccttggagctcaccaacagtgctcgatcttcttcttacccatcggtagctcttaacaagacacttgctcgtctgcgggctcaaagacctccacagtaccttccttctggaactgggtttggttcgaccgtcatacttctacaaggctgatatagaccgctgccgacgctccggcaccttctggaacacgtctggtccagctccgtcaggaactgctcgctctccaacaacagcatcgccagaacaagaactgtatctgaaatccaacgcaggcaacagcctgagccaagtattcagaagaaaactgcccctgaggcatgcgtcagaagacgtacttctcccagccacctgcagacaatagctccagacagtacaggaagacctcgacgggaccatttctagggcactctgtcgaccagtaagactcttccaacccagtggaagctgattccagttactggggataccaactcaatgtagtccacgcaaccagcttcacacagcccggaccagagtctaagcctccaatctccagatctccacgcaaaaacagacactcaaccaggatccacacacctgcaagaaaccaccactacactattccctccacaaaggggaaccagaagcaacccgagcaggcacgtgaccccaggtgaccatgaaccccccaagaacgcggccaaccctcaa

SEQ ID NO: 544851 - DNA, 619 bp, Homo sapiens
agcgggggtctggcggctagcaccggttcgcggtcggcgcgagaacaagcagggtggcgcgggtccgggcgcatgaagctgggtccgggccgtgcgtgggcctgctgctgctggcgcccgtcccctggtgcagcggtggagcccatcacctgggactgcctggcgggtctcccggtactctaccggcgtctctactgctccgcgatcgcgggcgaacggagcttaccgggaggcctggaaggatctggacgacaactcttggacagcatctgcaaagaaaatcatcttaaatgctggttggtttcataaaaaccaagccaagaaactctcacgctctccctgcacgggtggacaggcaccggaaaaatttcgtcagcaagatcatgcagagaatattacgagggtggtctgaacagtgactatgtcacctgttgtggccacatgactttccacatgcttcaaacatcacttgtacaaggatcagttacagttgtggattcgaggcaacgtgagtgcctgtgcgaggtccatcttcatatttgatgaacatggataagatgcatgcaggcctcatagatgccatcaagcctttcctcgactattatgacctggtggatgg

SEQ ID NO: 544852 - DNA, 437 bp, Homo sapiens
agtatagactcttagaagaaaacctaagagaaaattctcgtgactttgggttaggcaaagcttcttaacaaaaacaaacaaacaaaatagacaatcggactttatcaaaagtaaaaacttttgtttcaaaagacaccatcaagaaagcaaaaagaggctgagtgtggtggctcacgtctgtaatcctagcactttgggaggcccaggcggacggatcacgaggtcaagagatcgagactatcctggccaacatggtgaaaccccgtctctactaaaaatacaaaaattagccagtcatggtggcacacacctgtaatcccggctacttgggaggctgaggcatgagaatcacttgaacctgggctgcggaggtagtagtaagctgagatcatgccactgtactccagcctgggtgacagggagacattctctctctc

SEQ ID NO: 544853 - DNA, 328 bp, Homo sapiens
tgctgaggtgatctagaggatcccgcaggaacagggttcggtggggtcatctgatgatggcgtcgtgagatctgacgtcttcaaattgaaagagttctggagttctcaagagggatcgtagaacttgaaggggtccagggcggcgggggcgagccggttcttggggtacttcttcttggtaatcctttatgggcttctcgatggcgcagttgggaggggcccgcacacgctccttgaagggttccagctcgtcgttgaagccctccatgtactggggaatcgggtggcttaatcctaggtgaagaactggcggaagcagggccggggg

SEQ ID NO: 544854 - DNA, 130 bp, Homo sapiens
atggatgtaaacagaccccaacattttttcaggatgaggcaacttccctttgaaggttccccctccaaatttggcatttatttattagatggcaaataaaaatgagcaacattttcctgcctagggaaga

SEQ ID NO: 544855 - DNA, 1374 bp, Homo sapiens
ggcactctccatccagctgtgcgctctcgtcgggagtcccagccatgttcgacgagagtagaggtagccgaggcagcgaccggggagagacgcctcttcggctgcctccgtaataaccgaggcagtcgtagcgactccccaggcatcccgcggcctccgacacggggccgtcgccgccggcgcctcgccgtcactgatgtgctgcctagtgctcaccggctttggaggctacgtacaaggtgaagctgcagagccggccggttagcgcaccctcggaacctctgtggcccggcctagcttgacgtctgctgtcttgcgggtcctgcgtggcttcaacttcgacagacgctcatggctaggcatggaggctgtacgacctgtctcccgccttctgccttgtcattctccgcggcatggcgcagggccgcggcgctgtgtgtgaatcgcagtgggcgaggcgagtcagcgcgaccgtgaaggtcaggagacccgggatgatggtgtttgaaccggctgcaggcgattctggcaggcaacgaggtgccttgttgctcctcggaatccacgagcctttcccctggagttcgcttggagcggccattgagcgcttcttgacgcggaactgcttagctttgctcttagcaaccgctccttattcctaccgtttaccctagccctactcgttggtccctgctaatgaactttgcagcgtcgatccctactcaagtcgcatgcgtccaacaaagccgcccctaaggggtaacactcattgcggccttagcccaaggtgggggttggctgagcggttacttaccgcccttgtccctgtcgcccaaccccttgggttgcccccggataacaatgtcgtgacgacgggagaacctggcttgcaccaaggatgttgccggggcactgactgcgctcgttccacgaccacatgccggatgtgccacacccgaaccggcaactatgagaccgcgccgtaacacgtcgggggatagcacacaacaaggttccagcgcaaattcgacatcgtatatctacacacgcccagacctggaacactaagcgtgtgccgacttggacgacctccaccgtgcagaggaagtatatcaccccgtatacaacagggtacagtcttggtcatccctcttggggtcctcttggctaatcccctatcctggaggacgtgcgggcataacagcacaataaccctgctccactgtggggtacagcaaagacgcctgcgcttgtcataaacacccactgcggcgcacaaacatgacacgggctacaccaatatgtgtgcatcatggccgcccagcccatacgttaactgtggcccccacaaaacggacaacgcctcgtgacatg

SEQ ID NO: 544856 - DNA, 173 bp, Homo sapiens
tccagggcctgaaaatgtttatcccatgcccaaggcagcacaaacctggcaaacagcagtaccacagggcaaagagggaaggcagtgtcaaatgaacccaggggggcggccaggcccaggccagcaggaggctcaggccaggggcacaaaagggggggtgaggtaggcagaag

SEQ ID NO: 544857 - DNA, 467 bp, Homo sapiens
  misc_feature (187)..(187): n is a, c, g, or t
cccctacccccattttgggagggcgttggccccacacgggatccccccggtaataccccctagaggtccccctcctaacccattcggtatattcggcacgaggagtatcaatcccctgggctccccttatgtttaataggaaccccccgaaaccaaataattcaagcccggcttatccacattttanggggttttttttttcccctcctccaacccccagaggatttggggtttcccttccccatttccggggggatttaggggtcaacattttttgtacccccaggtttccccggacttcccgtcattattgggtcaactttccccccaatttgttttacccccccaataatatttccctttacatcccaacatccctttggttttgaaccccccccctgaaatgggccttttgtaaatggggtttgactatttttgtatgtccccctctattgatgggggtttta

SEQ ID NO: 544858 - DNA, 1149 bp, Homo sapiens
  misc_feature (215)..(215): n is a, c, g, or t
  misc_feature (393)..(393): n is a, c, g, or t
  misc_feature (485)..(485): n is a, c, g, or t
  misc_feature (630)..(630): n is a, c, g, or t
gtctcttactttgaatgcagtgaaattgacctgtccggtgaagaggcgggcatgacacagcaagacgagaagaccctattggagcttgtaattttagttaagtgctgacacatgtacctaacaaaccctatcaggttcctgaaactaccaaaccgtgcacttatagaaatttctggttggggtcgaccttcggagcagaatcccaacctccgagncgagttactagtgtcgtaatgactttcgatcctagtgcagaagcgaagctactagtactccaattgagtccaatagacttgaccgaacgggaacaagttaccctagggataacagcggcaggtcctattgctagtgagagtcctatgatcgaactaatgagggatttacggacctcgnatggttggcatcgaggtgactatcccgaactgtggtgcagaccgactgtcattcaacagagttcgattggtctcaaaggaaattcagacagntccgtagcgtgatctgaggttcagacgcgggagtaatgccagtgtcgagtttctagtctaactgtcaaattccgtccgctgtacgagaaggtacaagtaggaaagtaaggtcctagcttgcacaaagagcgccgttccgccgcgntaaatgatactcgagtctcaacatgtagtcattatacgccacgagccatccaagaacagggttggtgaataactcaactgcatttaaaacaagaccacaagttccgggactgtctacgcggcgaagtgaaaaccgtagtgaagcaagatggcccagatgactgctaacagcggtcgggcagcagacccaatctcaccagaggggcgcacccaggaacagacaccgggtcacggggaagcaggaggcgcgacaaaccaaggggctggaccagagacagaaagggagacacaccgagggggcggagacccaagagcaaccctggacgcgaggaggcaagcgcacgcacacgtggacaccaccctacggcgaagacagcacccccacgggcgcggggggaccaaaatgagaccacgccacaagcaaagacagacactcggcgcagctgacaaacacagacccgaggtgacggagcaccacagccaggacgtggcgggaaaattgctcggccatcatacaacg

SEQ ID NO: 544859 - DNA, 279 bp, Homo sapiens
cgttctagaggatccctttcttgccacgattggtcactgtaactccgactcccaggttcatgccagtctacctgactcaccctctcgagcagctgggactacaggtgcctgccagcactgcccagctaattttttgtaattattagtagagacggggtttcaccgtgtatagccaggctggtcttgatctcctgacctcgtgactctgccgaatcggcctcccaaagtgctgggattacaggtgagccaccgtgcctggacttgattttcttttcatat

SEQ ID NO: 544860 - DNA, 135 bp, Homo sapiens
ggtgttggcggcctgggtgtttgcccattgggggtgggtcgcagtgtgcgggcttggcatggccatcagcgcggtagcgctgggctactggctatggctgcaacgtgcgagggcggccgaagccgccctgccgtg

SEQ ID NO: 544861 - DNA, 158 bp, Homo sapiens
actctactcatgcgcctaatagcacgcgcgacgctagcagtatcaactcatacaacgcttgcctctacacttatcatcttgacacatctctaattctaccgactatcctagaaatcgctggcgccttaatccaagcctacgttttcacacttctagta

SEQ ID NO: 544862 - DNA, 309 bp, Homo sapiens
acacggatgacatctatgcaataaggccatctacaaaccaataataagctggaagtagccagattcttaagcatataggctaaaatacttctaggcgcatgaccaccaaccaaaggtgaaggtagagcaacatgatggaatcttctggtgctatagtacaacttgtgtgaatagtaagtgctcagagagtcttttcttacctttgtaagagttggggtgctttatttggttgttgtgtatgtctccaaaggaacctttcatagttagtattatgcttaatatagctcagtataaggcagccctaattct

SEQ ID NO: 544863 - DNA, 450 bp, Homo sapiens
  misc_feature (367)..(367): n is a, c, g, or t
tgcccaggtggattgttaaccaaaggggtttaaaagccctcccattaaaatttaagccttttggattttttaaaaaaggggttgttctataaaaaaaaaattcttttaaacaatattacagagacgtggggaaaatttggttttttacaacacaatcaaaccggcacttgccgtttttcgccattaagggggggcctctgggaaaaccccttttgcggggccttcgggagaagggggcctctgggtgcttgaagtgtaaccccttctcttttgcccggagaagaaaaattaagtcccgcccctggagtcccttgggccgaaatctagatagaaaacacacccctttgtgggggggggggggccgaangcgttggttatcatagagaaatcgaaacctgttggtaattaagagccagtcgttttttcttcttatgttaccgcgggtggggg

SEQ ID NO: 544864 - DNA, 670 bp, Homo sapiens
  misc_feature (646)..(646): n is a, c, g, or t
cacgtatcctgaaagactggagggccttcaaggctctcatcgctgctcagtacagcggggctcaggtccgggtgctctccgcaccatcccatgttccattttggccaagaccaaccgcacccctgaatttctccgcaaatttcctgccggcaaggtcccagcatttgagggtgatgatggattctgtgtgtttgagagctaacggccattgcctaactatgtgagctaatgaggagcatgctggggaagtactccagaggccagcgagccctaggtggtgcaggtgggtgagcgttgctgattccggatatagtgccccctagcctagtacctgggtgttccccgaccttgggcatcatgcatcacaacaaacaggccactggagaatgcccaaggaggaagtagaggcgaattctggggctgctggatgcttacttgaagacgaggacttttctggtgggcgaacgagtgacatcggctgagatcgacagttgtctgcgagcctgttgtggctctatagagcaggttctagtagccttctttgccggcgaggccttatccgcaatagcgaacctgcgtggttcctcgaccgtgcgattaaccgagccccgagttcgcgggctagtcttggaggggaaggtgaaanctgtgttgaagaatgattggccga

SEQ ID NO: 544865 - DNA, 479 bp, Homo sapiens
gtgtgcagggcaggtgggctggggttgggaagggtggatgccttggggaggggatggaagagattgaactcctggcccaagtctgatggggatggtgcatggtgcagcccctgcccttctttgggtagaggctgagagcttggggtcccttagagtcctctaaggggctcacgactgtttgtggaaggtggtaggggcttggagctaacagattgttcataggttctattctgccccagctctccgtgtggaggccctagggtcctgctcagcatagctctcagagccaagtcacaaggagaggactgggggactgcctggcacagagcagttgctgatcaacacagctgcagccagggctgagaagatgacaagcatttcctctgtcaggagagacatccatgccactccagggccctccccatcccaggaaggcccctccaagcacccagtctctaacacagcccacttcctcacag

SEQ ID NO: 544866 - DNA, 224 bp, Homo sapiens
ggcctgtgaggtgcagggagagcatttgctgtgtcaattgaaccactcactggttttgtgacctcagactttggaatggagctggaagctgtcatcctcagcacactaacgcaggaacagaaaaccaagcactgcatgttcccacttataagtgagagctgaacgagcagaacacatttacctatgtaacaaaccttgacatcctgcacatgtaccccggaact

SEQ ID NO: 544867 - DNA, 683 bp, Homo sapiens
catccctgcacagatgaggaaagcaaggcatggagcagtacccagagtcgaatctagatctcatctgtcatccgggtcttatcctttgctctgttatatctcgtatcgaggctctgggaagatagtcagatcgtgtgacttaattcttccgtctccctggacctcacccatgttagttgctttttcattcctgcgtcccatacttaagctcctgctcccactgaccctgatcgcgcaggcccaggcttgtacaaccgggtgctcagacttccccatcagtgaaaaggggtggcgtagagtaactaagctcagcaggtcgtccagtcctgatagtctgtggatttcggatccttctcaggaagcttcatgtctaatggagactatcattataacgtccatggtctgcatagagcatttgcatcaagaggctttccatacccctaccatcccctggtcctcataagatccttgaagcaggttgctattcctcatgggcgacatggcgaagcagatcacaggagtcgaagggccttgctcaaggtccccaggttcagtcccaggccctaagccagcgtcagaacagtcaatctgcatttttcatcagtcattctatagtgacatcatcccagactgccttctgtattcccctgtgtacagtctccttctgtttctaggtttagaag

SEQ ID NO: 544868 - DNA, 891 bp, Homo sapiens
agggctcggggcggcggcgggggcccggccgaggcaataagagcggcggcggcggagcggggggcagctcccgcagctcctgctctggtccgcctcggccccggcgggcgggccatcagccccccttcggcctcggctcgagggggcggggaagcctgcgcgcgccccatcggtcccgaccgggaaaacccttcccccttcccgggagcccccgcacgccggcacgccgcacggaacagtgggctgtgccttcggggaaacaaggtaaaggacccgaggtacccaagcgggcaaacggaaggaaagaacgggccgcaaggtggtgacgggccaaaccacaaaaaggattcgaagaaagcaagtctggcaagaaaggggacaaacagcaggtgtcttaccgcgggcggcctagcggcacccggccgtggcgtggcttggcaggggaggttggcctggggaaccacctctgggttaaagagggccacccaattgtgttgaaccggcaggagtgcaggggcctcctgcgccatttgtttacaagggggtttactaacgggagaaaagggtgagcgagaaatcaaggggaccccggacgagggtcgtgcaatcgtgacgcaaaccagcactgtcttggtaggaggaaaggggcaaacccaacaaggtggcgatggacatcttcgaacaagcaccgcgctggaaagagcagggcagactgtgagaacctcatatttgggtgggccgggccttgtagcaacccgtgggctgccccccgggggggagagctggcacaaacccgcaggagaaccaaggttcaaggaggggcgaactacccttccagtggaaggtggtgacgacacggctgccgtggtcatttggactttccgcctcccg

SEQ ID NO: 544869 - DNA, 381 bp, Homo sapiens
gccacctggagttgtgagctcatggaaatgctttacctgacttgtcaccactggatacccagtgctgcatctggtgcgtgccactagatctgacacaaagccagtgctcaataaacatcttaaattaattaacagaatggagggattagctcctagagtcaggcatgacggaaaaaagagctgcacttgtgagtgctttattccatgcaaacaatttgcatccggagatttatgaagctatatctctttctactttactactattttctacccctaaccataacgggtataggatggggcatataatccatggatttagtgaacttcccagctatcccaacttttaaaacaaagtccatccatctgagtatatgctgacga

SEQ ID NO: 544870 - DNA, 198 bp, Homo sapiens
tcacgcccactaggacgcagtcagttggagagtgcatagtcccgtctgtgaatacgactgccagattctggcatactccagctggtaacagagtgagactctgtctctcaaaaaaagtttcaatgttgactctctggacaagccaaaaatccatatttgtatataaggtcttaccattttaaaagattggcagctctt

SEQ ID NO: 544871 - DNA, 574 bp, Homo sapiens
cggaccatggaaacctgatccataatcagatcgcgtgtggtgctatagctgcaatataccaccgactaacattgatggccgaaataatgcatgtactcttggttaagcttaacaggagagagacacctttgctggctggtgcagttacagtgctattaccctatacttaacctgttagcagctctaacttgttcagtgtgccagtctcttcatttatggtgcattcagcaacatatatggcattctatactgttaacatatagggtgtctaccacaaacttgactattaccatctagagactgtatcctgcagattcagtcgtgataactgttagtactatacaaggtgaggagacagtattgtctttggaccaagaccgatgatggactgactgcgtcagtaccacttgttgtcagttttctagaagagagaaagcagagaagaacggactctcttttttcaaatgcacaaggataactcatataccaagtaggcaaaccacattgtgtggtgattactccacacaaagtgtgggttcccttttgcttataggggggggggacggctctcctt

SEQ ID NO: 544872 - DNA, 249 bp, Homo sapiens
tgttatggcgtggagagggagtgatgtcttccagattcggtgctgtactcgcctagcaggacccagtgcaccatacaggataatagtttccagtacactctccctcatgatgactccttaagtgttacatcgtctgcatcttcgagtaaaccacgtagtgattttccagcatcttaccgacaatctacctactgaatgcagactagaagaatcacgccagatgctacttctcatgtccaaaggtcaggt

SEQ ID NO: 544873 - DNA, 565 bp, Homo sapiens
cacgaggattttttttagagacagggtctcactctgtctcccaggctggagttcagtgacacaatcactgttcactgcagcctcaacctcttgggctgaagtggacctcctgcctcagccactggagtagctggggctacaggtgtgcaccaccatgcccagctaattaaaaatctttttttgtaaagatggggtcctgctatgttgcccaggctggtctcaaacttctggcctcaagcaatcctcctgcctcagcctcccacagtactgggatggttgggccttgggctgagaaggagacagggaagggtgctataggagctgtgtgatcctaggtgagctgtctgacctctcagatttgttctcatcaacagaatggggataatggaatctgcctcctgggactgtcacgagaattagatgagggattttggaaagaacatggcccacggttgagttccggagaggctgcttcctctctgggcgaccttattccacttctctgatcttgagtttcccaatctgcagaacagggggaaggaaaactgccccctgggactgctgg

SEQ ID NO: 544874 - DNA, 159 bp, Homo sapiens
ctaactaacaagaatccagataaataatttgagttagtggtaatgtaccaacattggttccttaacggtgacgaatttaacattgaaatgtcagacactggcaacatgacgagacccccatttcttacaaaaaaacaaaaaaataggggaaccggggtg

SEQ ID NO: 544875 - DNA, 245 bp, Homo sapiens
  misc_feature (159)..(159): n is a, c, g, or t
  misc_feature (197)..(197): n is a, c, g, or t
tgctatatcaggtggcggggaaatctgcctttctgtactgggcagtggcatcacgcttccgcaagacatgctggatgcttgggataactgcttgatcacgtctcagcaattgtcccaaccattttgagggtcactaccagtacaatgagcatccctgtnggaggacaaccacaatggcagacatacagctcctggtntcaacgaaggccatttgacttctatagactccatacaagaaatgctgg

SEQ ID NO: 544876 - DNA, 394 bp, Homo sapiens
tcggggctgagacagccctggcaggcagttaccaggacggtctccggaggcgggattcgcggagggtccaccagcaggaagaaaccccaggaggaagaaacctcagacagatcgccggggaggcagcgcgggatcccagcctcaggcgtgcgcggacggtgtgcgggtgagtctccccaaaagtggcgcccttgttgatgtcgaggacaggtctccctgtgtgcccgtgggctgctgtctcaccggtggctcgtagtcgcggagaccagaaacccggcagcttcaggggctgcctggggggtggggtgttacctgctgtatgtctgtgtccattaatgggtgtgtgtgtgtgtgtgtgtgtgtgtgtgtctgtgtgtctgcgtgtgtgtgcgcg

SEQ ID NO: 544877 - DNA, 735 bp, Homo sapiens
  misc_feature (385)..(385): n is a, c, g, or t
cggtacctctccctacggtatctagggaacgtgaggaccagatgtagtcagtgctcgggaagggatgggacaagacaggcaccagaaagccactggaattctaggcggcttcctgcttattctgcgtgcttgcacttgtttgtttgcttctctgtccagagggcaggaggaagacaccacctctcagcaaccagtgtgtatcaagtccatcccagacacagcccagattcaacctgaccctcttagcacaattcccaagtctctgagtaatccaccaacacttatatagtgtacatggtgggtggggctccttcgggtgagtgaagggaggtaattagggggatacatctgaattaggaagccctcctttctcccttcttcattngtctgaatcagactggaaggacagtaggatatacgtgaagagagaagatatctcgattgaacagtaagtgcttcagagtcaaacacgaagggaacatatatggaacagtatagatcctcctggcactgagggggtgtgaaccccaaatatctgagactactctcagttaatttagaaagtttattttgcctaggttgaggatgcatgcccatgacacagcctcaggaggtcctgacaacatgtgcccacggtggtcagggcaggggttttttcattaatttttgaaacggagtctcactcttgtcgcaccagtgcactccaccctgggcgacagagcaagactctgtctc

SEQ ID NO: 544878 - DNA, 779 bp, Homo sapiens
  misc_feature (20)..(20): n is a, c, g, or t
  misc_feature (22)..(22): n is a, c, g, or t
  misc_feature (25)..(25): n is a, c, g, or t
  misc_feature (393)..(393): n is a, c, g, or t
ctcttcctttgatctcaganangangcctcccaaagtgaggtttctggggagaatgagggcaacttgccatccccagaggaagatggtttcactatctcatgtcccacgttgcagttcctggatccccagaccaaagagacacagtcaccacacctctgagagaagtcagtgcagacggcccaatccaggtgaccagcactgtgaaaaacggtcatgctgtcccaggagaggatcctagggggcagttaggcacgcatgctgaatatgcttctggactcatgtctcccctcaccatgtccctcctggagaacccagacaacgaagggtctcctccctcggagcagctggtccaggatggggctacgcacagtctagtggcagagagcacaggnggcccagttgtgagccacacagtgccatctggtgatcaagaggcagccttgccagtgtcttcagcaactaggcacctgtggctgtcctcatctccccctgataataagcctggtggtgatcttccagctctgtccccatcacccatccgtcagcacccagctgacaagctgcccagcagggaggcagacctaggagaggcctgccagagcagagagactgtacttttctcccacgaacacatgggtagtgagcagtatgatgctgatgcagaggagacgggctggatggctcctggggtttcccaggaaagcccttcaccacatacatatgggggtacccccattctggacctacactcacccacgaacaggaagtagtgatgtgc

SEQ ID NO: 544879 - DNA, 454 bp, Homo sapiens
ctatgtcaagatcacaaggtataacaacctaacataaattacattttattttaaaataaaaattttctcatagcataacatttttagtacaacattttcttataacaaataaaagcagacaaatcacaagtgtatgagctcagtgaatgctcacaattgcataacctccacttagatcaaaatatagactattgctagcaccctagtaattccttgttctttttcgtaatcattatctgtcttttttcaaatttatccactatcttggcttctaagacatagattggctttagccttttaaaaatataaacattttaattaaagtgtaacaaatatacaaaaagcacccaaatcataagcacacaaccaacaaattttcataaactgaacatctatatctaaccacgaccaatgatatgaaaaaccatcgttgtatttcaactacaagaaccca

SEQ ID NO: 544880 - DNA, 208 bp, Homo sapiens
taactaggatacaggctcatgccacataagcccatctaattgaattgttatttaagtacagacaggcttcaccatgctggccaggctggtctcaaactccagacctcaggtgatccacccacctcgacctcccaaagcgctgggattacaggcatgagccactgtgcctggtctggattacatcttaacctacaatatttcatgaagt

SEQ ID NO: 544881 - DNA, 872 bp, Homo sapiens
  misc_feature (20)..(20): n is a, c, g, or t
  misc_feature (22)..(22): n is a, c, g, or t
  misc_feature (25)..(25): n is a, c, g, or t
  misc_feature (393)..(393): n is a, c, g, or t
ctcttcctttgatctcaganangangcctcccaaagtgaggtttctggggagaatgagggcaacttgccatccccagaggaagatggtttcactatctcatgtcccacgttgcagttcctggatccccagaccaaagagacacagtcaccacacctctgagagaagtcagtgcagacggcccaatccaggtgaccagcactgtgaaaaacggtcatgctgtcccaggagaggatcctagggggcagttaggcacgcatgctgaatatgcttctggactcatgtctcccctcaccatgtccctcctggagaacccagacaacgaagggtctcctccctcggagcagctggtccaggatggggctacgcacagtctagtggcagagagcacaggnggcccagttgtgagccacacagtgccatctggtgatcaagaggcagccttgccagtgtcttcagcaactaggcacctgtggctgtcctcatctccccctgataataagcctggtggtgatcttccagctctgggccaggagagaaaacatcctacaaggcttggttggcaggagttggtttgtccacagaccccatcaagttgccctgcaacagttgaaaatgtcaccatggctcaaaacccaggccgatctcaaggtgcttagcaaggccaagttctcccttggttacccaagtgtcttccaagatggcgggacactccgttcagcccaaccctggagcaaggcgccgcagggtgtcatccgagcacaccaggacagcgtgatgaatgggtgacctcggttcagggaggagagcctgatagacacagtggtcttaatgaatggaagattgggccaggtggtaaacagggcggaacacg

SEQ ID NO: 544882 - DNA, 170 bp, Homo sapiens
gagggaacgcactactgggaggggatttacacttgcttgggtcaagcgtatctacataaaaacctgctatgggcaaaaactaaaaggcatacttcctctttctcctttcatttcatttgatcatcgccttcaaaacatagcctataaaattaatcccatgcccttatcat

SEQ ID NO: 544883 - DNA, 117 bp, Homo sapiens
aaagtaggaaagttactgagcgtgaatatttttgacgagattttaatgtatccaatcaaggtaatcagatgcttcttcttttaaggcgagggtaattgtcgttccccgtcctagagt

SEQ ID NO: 544884 - DNA, 951 bp, Homo sapiens
  misc_feature (1)..(1): n is a, c, g, or t
  misc_feature (15)..(15): n is a, c, g, or t
  misc_feature (810)..(810): n is a, c, g, or t
  misc_feature (818)..(819): n is a, c, g, or t
  misc_feature (834)..(834): n is a, c, g, or t
  misc_feature (853)..(853): n is a, c, g, or t
  misc_feature (855)..(855): n is a, c, g, or t
  misc_feature (872)..(872): n is a, c, g, or t
  misc_feature (932)..(932): n is a, c, g, or t
ntgaatcggccgagngcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggctgaggagcagcccatggagacgacgtggctgccacctgagaactggacatgaagtgcctgtcccctgaaggctgagtcgccgtgccggtgtgctggcactggtgctgcctgctgtgctggggtgcttggaggcgcgaccgcggcgccccccgagccgggaatcagaacggctgccgaggggcgaccagatcaacgccagcaagaacgaggaggacgcggggaaaaatgttcgttggtggcctgagctgggatactagcaaaaaagatttaaaagactattttactaaatttggagaggtcgttgactgtacaataaaaatggatcccaacactggacggtcaagagggttggggtttatcctgttcaaagatgcagccagtgtggagaaggtcctagaccagaaggagcacaggctggatggccgtgtcattgaccctaaaaaggccatggctatgaagaaggacccggtgaagaaatcttcgtgggggtctgaatctgaagccatgaggaaaagatcagggagtaatttggggagttggggagattgagggcattgaattgcnaatggatnnaaagttgaaaaaaanaagaggttttgtgtttatnanctttaaagaagaagaanccgtgaagaaggttttggagaaaaagtttcataatgttagtggaagaagtgtgagataangtggccaggcaaagaagtt

SEQ ID NO: 544885 - DNA, 148 bp, Homo sapiens
cgaatactagaattcaaccagtatatactagggatgactgataattaggcagagggaaatcatacaataataattgtctccaaaggatctgctagtaactgaggacaagttaacaagtggtcttaaatttcacgtcctccggccatat

SEQ ID NO: 544886 - DNA, 839 bp, Homo sapiens
  misc_feature (1)..(1): n is a, c, g, or t
  misc_feature (15)..(15): n is a, c, g, or t
ntgaatcggccgagngcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggctgaggagcagcccatggagacgacgtggctgccacctgagaactggacatgaagtgcctgtcccctgaaggctgagtcgccgtgccggtgtgctggcactggtgctgcctgctgtgctggggtgcttggaggcgcgaccgcggcgccccccgagccgggaatcagaacggctgccgaggggcgaccagatcaacgccagcaagaacgaggaggacgcggggaaaaatgttcgttgggtggggccccttggaaggccttgggggggaaaattaacctaaggcaaaaaaaaagaatttttaaaaagactattttactaaatttggagaggtcgttgactgtacaataaaaatggatcccaacactggacggtcaagagggttggggtttatcctgttcaaagatgcagccagtgtggagaaggtcctagaccagaaggagcacaggctggatggccgtgtcattgaccctaaaaaggccatggctatgaagaaggacccggtgaaagaaaatcttcgttgggggtctggaatcctgaagccacttgaggaaaaagatcagggggagtacttttgggcgaagttgggggagcaatg

SEQ ID NO: 544887 - DNA, 923 bp, Homo sapiens
  misc_feature (1)..(1): n is a, c, g, or t
  misc_feature (15)..(15): n is a, c, g, or t
  misc_feature (297)..(297): n is a, c, g, or t
  misc_feature (301)..(301): n is a, c, g, or t
  misc_feature (316)..(316): n is a, c, g, or t
  misc_feature (320)..(321): n is a, c, g, or t
  misc_feature (339)..(339): n is a, c, g, or t
  misc_feature (350)..(350): n is a, c, g, or t
  misc_feature (359)..(359): n is a, c, g, or t
  misc_feature (369)..(370): n is a, c, g, or t
  misc_feature (384)..(384): n is a, c, g, or t
  misc_feature (395)..(395): n is a, c, g, or t
  misc_feature (401)..(401): n is a, c, g, or t
  misc_feature (782)..(782): n is a, c, g, or t
  misc_feature (790)..(791): n is a, c, g, or t
  misc_feature (806)..(806): n is a, c, g, or t
  misc_feature (825)..(825): n is a, c, g, or t
  misc_feature (827)..(827): n is a, c, g, or t
  misc_feature (844)..(844): n is a, c, g, or t
  misc_feature (904)..(904): n is a, c, g, or t
ntgaatcggccgagngcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggctgaggagcagcccatggagaagaagggggcaaacgagaaaggaaatgaggnggtncccgaagggagttgngggnnggggttggaaagggggcngcggcgggggntggaggggngaaggggggnncccgagggggaatnagaaaggggtngagggngatcagattaaagaaagaaagaaggaggaggaagagggaaaaatgttagttggtggcctgagctgggatactagcaaaaaagatttaaaagactattttactaaatttggagaggtcgttgactgtacaataaaaatggatcccaacactggacggtcaagagggttggggtttatcctgttcaaagatgcagccagtgtggagaaggtcctagaccagaaggagcacaggctggatggccgtgtcattgaccctaaaaaggccatggctatgaagaaggacccggtgaagaaatcttcgtgggggtctgaatctgaagccatgaggaaaagatcagggagtaatttggggagttggggagattgagggcattgaattgcnaatggatnnaaagttgaaaaaaanaagaggttttgtgtttatnanctttaaagaagaagaanccgtgaagaaggttttggagaaaaagtttcataatgttagtggaagaagtgtgagataangtggccaggcaaagaagtt

SEQ ID NO: 544888 - DNA, 1151 bp, Homo sapiens
  misc_feature (1151)..(1151): n is a, c, g, or t
gactagttctagatcgcgagtggccgccctttttttatttgttttacacctttaaaaggcgaatttattaaagttaaagaacaattcgtgtattatattaataggtgtacaatagtgttcttattgtaaggagtgtagaaataagggaaaacgtggcctctcagagtgaaaacaggaaatgggtgtcgtgagcagtataatagaaagcgatgtgtccctttaacacgagggagctaaaaatattcaaatttctccttttcaagacacgatttctcacaaatttatttctcgtggtgtccaataattctccactgtacagcttcaacacacgccacatagaggcacttttagtgaaataaccgcttccgcctatatcactatattgcagagatatatatcacatattagatgggctaaacacttgtgcggtggacacccgaatcctaagaacaccttaaaatacaccaaatttcccaaactatgggttgtgacactgtgtttgaaaaaaagagatctttaatcgtatagacacaatatacaccccacccgtcttgtgtggacagagcccattagaccactatattgtcgtggaccacacggacttgtggagaaaactcacaccgcgtggtaatcttcctagacagcacatgttacaaatctcgttaccattataacgcaaagcaaccctctcacaagagtgtgggcctctacaagcgtgcgcttgagcgagaacatttgggaaagcctattgtgcttgtagaccagggggccaactgggttatatatccacatggggtgcgaatacatattaaatgggcgtttctccaaccgcagggccactattcattatgggatgggatcacattcattatatctctaaatcttcaacgaaaggttacatgtgttgaggagcacgacatatacgggcatttacgacagaatctaaaacagggatgtccacttcactgaatcatgggaattattgtagatacgccccactctggggaacaacgaatttcaccgtcatgcaaacttgtgggggaagcctaccttggggcacttttaacagtgggtggggcgacacaactatgtccctcaccaggtgcaacaacggggagtgatgacatgcctctagaaacgattttaccaan

SEQ ID NO: 544889 - DNA, 223 bp, Homo sapiens
tctagaggatcctacatgatgctccacgctcccgtgcacagcaaactttggcctggatttccaggcattttcatacatcttctgaaatctaggcggaggttcatgaacgttaattcttcggtgcatctgcaggcttaacaccacctagaacctgaaaggcttggaacttgcaccctctgaagccatggcctgaggtgtaccttggccccttttacctgtggca

SEQ ID NO: 544890 - DNA, 796 bp, Homo sapiens
  misc_feature (1)..(1): n is a, c, g, or t
  misc_feature (15)..(15): n is a, c, g, or t
  misc_feature (735)..(735): n is a, c, g, or t
ntgaatcggccgagngcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggctgaggagcagcccatggagacgacgtggctgccacctgagaactggacatgaagtgcctgtcccctgaaggctgagtcgccgtgccggtgtgctggcactggtgctgcctgctgtgctggggtgcttggaggcgcgaccgcggcgccccccgagccgggaatcagaacggctgccgaggggcgaccagatcaacgccagcaagaacgaggaggacgcggggaaaaatgttcgttggtggcctgagctgggatactagcaaaaaagatttaaaagactattttactaaatttggagaggtcgttgactgtacaataaaaatggatcccaacactggacggtcaagagggttggggtttatcctgttcaaagatgcagccagtgtggagaaggtcctagaccagaaggagcacaggctggatggccgtgtcattgaccctaaaaaggccatggctatgaagaaggacccggccatccagcctgtgctcctnctggtctaaggaccttgcttccacacttgcttcaatcgacgtaacaggataaacccaacac

SEQ ID NO: 544891 - DNA, 877 bp, Homo sapiens
  misc_feature (1)..(1): n is a, c, g, or t
  misc_feature (15)..(15): n is a, c, g, or t
  misc_feature (816)..(816): n is a, c, g, or t
ntgaatcggccgagngcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggtgagcggcggcctggcgggcgggacgctctgtgctgggatgccgcacctggcctgacgcgctgtcgccgctggtttgcaggagccgccgcgcctcggcctagcatgtcggaagcgggctgaggagcagcccatggagacgacgtggctgccacctgagaactggacatgaagtgcctgtcccctgaaggctgagtcgccgtgccggtgtgctggcactggtgctgcctgctgtgctggggtgcttggaggcgcgaccgcggcgccccccgagccgggaatcagaacggctgccgaggggcgaccagatcaacgccagcaagaacgaggaggacgcggggaaaaatgttcgttggtggcctgagctgggatactagcaaaaaagatttaaaagactattttactaaatttggagaggtcgttgactgtacaataaaaatggatcccaacactggacggtcaagagggttggggtttatcctgttcaaagatgcagccagtgtggagaaggtcctagaccagaaggagcacaggctggatggccgtgtcattgaccctaaaaaggccatggctatgaagaaggacccggccatccagcctgtgctcctnctggtctaaggaccttgcttccacacttgcttcaatcgacgtaacaggataaacccaacac

SEQ ID NO: 544892 - DNA, 493 bp, Homo sapiens
  misc_feature (154)..(154): n is a, c, g, or t
  misc_feature (171)..(172): n is a, c, g, or t
  misc_feature (296)..(296): n is a, c, g, or t
aaacctccccctcttctcctttttgcatgccaccagtggttaaagttttaaagtgtttacagatgctgaaggcaagggaaggagcagaagcacttatgtttcgggatttttaaactctgttagagagcagcctttgaaaatccccatttggttntgctttttgcctctctnnacttttcaagggtaatctttgtggcacaaacgatagcatttccaagctttagagttttctgaattcctgcgccttcctgacgtgagccctgagcgatcttttatacagttttcccaagcgcccnggtggtctctctgtgttctttgttacttgggggcaatagcaacttccctaccccgggcattccatctttcatgttgtgtaaagttcttcccttttttctctaagggctgggggttgggggagccagcatgattattttttaatgtagaaaatgggccctctggaaataaaatgaaaataaatgttaaattaaatgga

SEQ ID NO: 544893 - DNA, 341 bp, Homo sapiens
gtcaccatgggtgatcacgcttgcagctttctaaaggacttcctggccggggacgtcatcgctgacgactccaagaccgcgagcatcctcatccagagggtcaaactgctgctgcaagtccatcatgccgttcagatcaatgctgtattactatcattgtggtagggtaacctggacaacgtgatgcggaacttatccaaccaagctcacaactctaggttctaggactacttccagcccttctgactaagatgatccaatatgtattagccctgatgacgctatactggacagaacctatctttcggtcgatcctgtgatgccctgccttagctgtggct

SEQ ID NO: 544894 - DNA, 270 bp, Homo sapiens
  misc_feature (209)..(209): n is a, c, g, or t
caaacgtcaagagggtttccctgcatctttgaacaggataaacccaaaccctcttgaccgtccagtgttgggtttatcctgttcaaagatgcagccagtgtggagaaggtcctagaccagaaggagcacaggctggatggccgtgtccttcttcatatgccatggcctttttatgggtcaatgacacggccatccagcctgtgctcctnctggtctaaggaccttgcttccacacttgcttcaatcgacgtaacaggataaacccaacac

SEQ ID NO: 544895 - DNA, 331 bp, Homo sapiens
cccggatcacaccaggcatgctctcacctcagggcctttgcactagctctgtttctctccactggaacactcttcctccagcagtctatgtaatttacccttacctctttccaatctttgctcaaatgccacttcctcagtgaggcccacctgaccaccccatttaaaatagtaaccccgccccaaatctctggatcaccttcaccttgctctagtttctttttgcccacaacacttactacctcctaacatgttttgtaatttcgtcaaatgtattgtgtttattatttaggatttgtctctctccattgaaacagaaggtccaggtatg

SEQ ID NO: 544896 - DNA, 183 bp, Homo sapiens
agtcagcatggcgataaacaaggggtgccatgggtagctagagttcttcaaaagtgtccacgagcaacttaaaacatcacaagtcttctttccaattgggagcacctgagttaaagtggggatgcatcaaatagatcattaaaactgtcgatttctcgttgtgcagcaagcaccatgtctcca

SEQ ID NO: 544897 - DNA, 637 bp, Homo sapiens
  misc_feature (637)..(637): n is a, c, g, or t
tgatacctaccatatctatgctcaggaggtgctaagctgttgaatgggctggtagtttgcctccatagattctagtcacccattcttcccactgctaagtttgcctttcagagataatgatatctggtatgcgtgtctgtgtgaagagaccaccaaacaggctttgtgtgaggaacaaggctgtctgattcactatgggtgcaagtgggttgagtccagaaaagagagtcagtgaagggagatcaggagcaggggcagccttcatagggcttgagtaggcagtggaaagttcacagttaaaggtggttatttattgtcagccggggagggggtcccaaggtgcatggtggagagatcttgggactcattgtccagaagaagaatgtcacaaggtcgattgatcagttggggcagggcagaacaagtcataatggtggactgtcgtaccgttggtcagtcagttacggccggagctgtttcacttctgtggttttttagctggctcctgcaggccatctggccgtctatatgcaggttacgggggttacaccggctgagcttcggctcagagcgctgacaatatccagaccatgatgtgcccacaatttggctgagggcacccctttggacatcggcn

SEQ ID NO: 544898 - DNA, 310 bp, Homo sapiens
  misc_feature (7)..(7): n is a, c, g, or t
  misc_feature (18)..(18): n is a, c, g, or t
  misc_feature (26)..(26): n is a, c, g, or t
  misc_feature (31)..(31): n is a, c, g, or t
  misc_feature (44)..(44): n is a, c, g, or t
  misc_feature (70)..(70): n is a, c, g, or t
  misc_feature (99)..(99): n is a, c, g, or t
  misc_feature (153)..(153): n is a, c, g, or t
  misc_feature (159)..(159): n is a, c, g, or t
  misc_feature (264)..(264): n is a, c, g, or t
  misc_feature (268)..(268): n is a, c, g, or t
  misc_feature (271)..(271): n is a, c, g, or t
cttatgnccttcagattnttaattgncctangtaccctaaaacngtttttaagtggattgcccgtgaagnagggtcctgttggttgagcacaagggaancagagagctggatggagccattatctcagacttaagtcaagcgctgattgaaanttctcntgtcccaaactcctagtggtcctgcactcaggagatagggaaggtcgctgacgatactgagtcttttccacagtgcttgcttcctttttagcagcctcagatggntccnctncctaaactggggctgtttctctccttctcaaccctaatt

SEQ ID NO: 544899 - DNA, 109 bp, Homo sapiens
cccacacatataacaggactcctcacaccaattggacaatctatcaccctatagaagaactaatgttagtataagtaacatgaaaacattctaccccgcgttaaactcg

SEQ ID NO: 544900 - DNA, 138 bp, Homo sapiens
ctaagtccgtgaggtacacacataacagatgggagattgtttgtctgtgtcttaacagagtcacagattctgtgccttgagagatagatctaaatggacaaggaagatacaatacaaggttcacaattcctgtgtaaa

SEQ ID NO: 544901 - DNA, 560 bp, Homo sapiens
  misc_feature (51)..(51): n is a, c, g, or t
gcactaggccttagactgattactttaatattttataaagaataacaagcnatataagccatacaccatattttttaatacaaataaaaatttcaagaatatattcaaattatttatttataatgcactttcctcaaatttattattatttgaactattgtctaaggatttaaatttttgtttttttttttaaaatgcaatctcccatgctagaatataataaccacattatgccactacactccatcctatacaacatatctaaactctatatcaaaaataaataactacatcaaaaaaaaaattatttaagtacattttccctacattttacaaattatcacactaatcactttctacttaccctcttcacatacaaacttaaaaaagttttataatcactaattacccatcaaagactatttgtcatatcaagacttttttaagcctttaacaacttttataaccacatctaatttttttaaaatccccaattatccaataccaactttacctaacccattaaattctcttttctcaatcaatttgccttttttcgc

SEQ ID NO: 544902 - DNA, 90 bp, Homo sapiens
  misc_feature (32)..(32): n is a, c, g, or t
gagaaccacgggctccatcctggcctcctgtncaccttcgaacagatgcggattagcaagcaggagcacacgaatcaagcccctccagcc

SEQ ID NO: 544903 - DNA, 541 bp, Homo sapiens
  misc_feature (414)..(414): n is a, c, g, or t
tctagaaggatccccggtcccatgcacagttggtgttgtgtccccatctcaagtctcatctgcatttatagcgtcccataattcccatatgtgaggggagggaccgggtgggagataatggaatcatgggggcagtttcccccatagggtgctcagggtagtgaataagtctcatgagatctgatggttttataaggagttttccttttcacatggctctcattctctctggccggcggccatgtaagacatcgttctgggctacctggtacttcggccaggatggtgaggcctcccagagccagagggatgggtgagtccattgaaacctctttcctttataaattacccagtctcgggtatgtctggcagcgggagaccagactaatacggggtgacatgaagagttacggncaaacgagggtggaaccataggccggatcgataaaacataaaaaggcttctaaggggggaggatggctggagtgcagagtccaagaccagcctgggcaacacagtgggacccggtatctacgaaaaa

SEQ ID NO: 544904 - DNA, 354 bp, Homo sapiens
  misc_feature (335)..(335): n is a, c, g, or t
gcaccgggcgcaacagagccatatttctcttctttcaaaagcaaatgggagaaagatcgctgaattccattttctcagcaaggaacgcccctgagaaagagaatgcgtccctgaggccagccctctgaaatgcccacttggcgggcggctgtattttacaaccacagcatgcgggcggattacaaccgccggcggtgtagcgctccccaggcttattaggatgaggaaattcccacctaataaattttggtcagaccggttgtctgctctcaaaccctgtctcctgataagatgttatcagtgacaatgcatgcccaaaacttcattagcaattntaatttcgccccggtgacc

SEQ ID NO: 544905 - DNA, 167 bp, Homo sapiens
tgggtccagcaatgtcctcattcgaggcgtggccggggggcttggttccctcaccagcagcaaattccggttgcacggggttagcagggtacagcgcggcgccccggacccctgcacggtgacgggtaattcaaattgtggaggaaaatccgggacgttggcagcca

SEQ ID NO: 544906 - DNA, 260 bp, Homo sapiens
ggcggaccctgtacgctcagccactaaaaacatgtactgaccatgtgctccgtgccagctctagtgagcagcctcgggaggtttcattctgacttccctcgtgatcctggcatgtgggagactactccttgctaaggagagtccaatgcctgggggagtagaaaaatctcattcccagagtcagaggacaagagacatgtaccttggaccatctgatccttcgctctcaatgctagccatgagggtgggagcgctaagga

SEQ ID NO: 544907 - DNA, 580 bp, Homo sapiens
ctcaacgctttatacattcgaaagcgaggacaacactcatacttggaaagcgagggcaacactcatacttggaaatcaaggacaacactcatacttgtgaaaccgaggacaacactcatacttggaaaccgaggacaacactcatacttggcaactgaggacaacactcatacttggaaaccgaggacaacactcatacttggcaactgaggacaatattcatacttggaaagcgaggacaacactcatacttggaaagcgaggacaacactcatacttggaaatcgaggacaacactcatacttggaaatcgaggacaacactcatacttggcaactgaggacaacactcatacttggaaaccgaggacaacactcatacttggcaaccgaggacaacactcatacttggaaaccgaggacaacactcatacttggaagtatagggcgttgaggaagtataaagcgttgagctcaaggatttatagttcagctgcgagcagatccagctaatttggatagtgtaagtagctatggggttcaccgtgtaagccaggatggtctcgatctgctgagcttgt

SEQ ID NO: 544908 - DNA, 187 bp, Homo sapiens
gtcatcattatgacatgcagtagagattgagaatatgtacaccggattggccgcaccgggcgtctcgagacaatcacaggcatcgccactagcttcatcaacaacgcgtgtgatgagtcagtgctgatggacctcaaagcgctgttgctagaagcccaagcagaaggtgccgcccgtgctgcaggtg

SEQ ID NO: 544909 - DNA, 255 bp, Homo sapiens
catgtgtgtgcaatgatatgactgtgtccagaacatctcccgcctacacatagaaacctggggtctcctccctgtgctcgatcactgtgtgacttcaggcagaggtcaccaccctctctgggccctttcattctctgctatggactgagtgggaacagctggatcaaaatcctcaaacctcatacacacactgtcagcagcttttcctgtatctgcctgttaccgtcgacactattacacagttttctttaaatc

SEQ ID NO: 544910 - DNA, 368 bp, Homo sapiens
  misc_feature (353)..(353): n is a, c, g, or t
agaggatccccacgttgacacttcagtacaagtttaaaaattttagcagaaagttaaaaagtaaaaacaggccaggcaggatgtttcacccctgtaattccagtactctaggaggccgaggcagatgaatcatttgaggcaagaaacttgagaccagcctggcccacatggcaaaaccctgtctctactacaaatacaaaaattaactgggcatggtagcacatgcctgtggtcccagctactcaggaggttgagacagaagaatcgcttcaacccgggtggtggaggttgcagtgagccgagattgccccactgcatttcagcctgggcgacagagcaagacaccatctcanaaaaaaaaataagta

SEQ ID NO: 544911 - DNA, 89 bp, Homo sapiens
tgaacagccagacatgagggacacattttttgagttcatgggtattcagacttttcaactgggttttgggtcgacgcggccgcgatttt

SEQ ID NO: 544912 - DNA, 337 bp, Homo sapiens
gtcaaaaggacaagaatacgttcaagacacaggaaaaaactcctaaaacaccagaaggacctagttctgtagaagacattcaagcaaaaatgcaagcacgtctagaaaaaggtggttctcttccctaagtggaagccaaattcatcacttatgtcaagaattgcttccggcatactgaccaagaggctattcaagactctctggcagtggacgagaacgtctctttaagacaactacgtttcaacactatgtataaaaaattttccgtcttatttcactttctgtacaattgatatctggctgtcctttatataatgcagagtgagaactttcccta

SEQ ID NO: 544913 - DNA, 199 bp, Homo sapiens
gcggcatacagcacaagacttcttcacctatatgttacacatcagagctccgtctcactgaagagaggatgaatcatgacctaaccttagcagccacaggcaggcaactagtctgtgcatggatatggtacaacgtctgtgaggtattacaatacataaatctttattacgtgttcactcaagccagcagtggaagtaa

SEQ ID NO: 544914 - DNA, 478 bp, Homo sapiens
  misc_feature (374)..(374): n is a, c, g, or t
  misc_feature (380)..(380): n is a, c, g, or t
taatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagagaatgagatcctgttctgtcagctgcaccctgagcaaaaacttgccacatttggggataacaattaaacccaggctttggaacggaccctgaggaagcctgggaggcgttaggatgacacgtatgtcttgctcagatatgactccagacgntgcaantgtgtgactgcgttaagccaagtcaaccacatcctgcctagctgacatattaatcatcgggacacagcctgcatggtaccgagctcgagttgtatagt

SEQ ID NO: 544915 - DNA, 583 bp, Homo sapiens
  misc_feature (388)..(388): n is a, c, g, or t
  misc_feature (456)..(456): n is a, c, g, or t
  misc_feature (553)..(553): n is a, c, g, or t
  misc_feature (565)..(565): n is a, c, g, or t
taatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagagaatgagatcctgttctgtcagctgcaccctgagcaaaaacttgccacatttggggataacaattaaacccaggctttggaacggaccctgaggaagcctgggaggcgttgggcagcacagtaagtcttgtccaaaaagttccagagggtgcccaattgtgtgtntgttcggacccgaagcattcctcctgccatgaaattccaattaaccgcctagcgctcctaaataaaanaaaaaaaagaacccacattacccggatatgttttatttttttggtttacacattcactacatgtgacctcccagtttggtggaggtcgcctgtaagnttagggaaaaanaaaatatacttccccaaa

SEQ ID NO: 544916 - DNA, 265 bp, Homo sapiens
  misc_feature (189)..(189): n is a, c, g, or t
  misc_feature (229)..(229): n is a, c, g, or t
  misc_feature (242)..(242): n is a, c, g, or t
agatatagtggaccatctcgtgaccggcgatatatgggtatactatgaagaagattatacaaatgcatgggctgtgatgataacgttgtagatgtggtcgttacctagaaggttgcctggctggcccagctcggctcgaataaggaggcttagatgctgtgcctatggactccatgcccagtgcgccgnaatagataggtatacgtgttccagatgtcttatgtggttntgtacgagaatcnaatcgccgtgtcacgagcgggac

SEQ ID NO: 544917 - DNA, 310 bp, Homo sapiens
gcccccccctttttttttaaaaaaaaggaaagggaaattttttaaggggggtttccaattttttcccccaagccaaggcccctgggttttccttttggaaattaacccccccagtttttttctgggggggccaaaaaaaaagtaactaaatttgctttttttaaaaaaggggcaacaaaaaatttttccccccatttttaaaaaaaaaaggggaaaattaattttccccgggggcccccccaattgaagggaatttttttgggggttttcaaaaaaggttaaattttaaaaaaaaaaaatttttttttta

SEQ ID NO: 544918 - DNA, 1136 bp, Homo sapiens
  misc_feature (1136)..(1136): n is a, c, g, or t
gccatcatgatgaactaaacttctggaaccacacaacgcaggtaagttctccctcccttaattggctctgtcagacacgttgtcggatactccgtttggtgtgcctccttctggacatatcctccaaggagatggctctcagagccatcccggtcccggccgattcacagcagcttggctcctaagagccttcattcagagacatccaaatgcccaccagctgatggacagagacagtgactgacctctccgtgcagtggcaatcggccagctacccgggtccctcccagcctgcagcacagcctcagctctttccagcaccaccagctggcccctcctctgagaatgtcactgctagaccccacagtcacacacactcccttcagccttctcatgaccactccatgggagggctctccccccacctcccccctctatctccactcctgcctgggccacaccaccacaacactcaaacagcttttgcgcttttgcaggtttcggcacctcctagctcatcagggagcccaaggctcttcctgtcttagtggcaccttctcccccttcctcctgtttacccagcttggccaccttgagcctcacctctcctctccttgtcttacccctggaagacttcccaatccctagggtgagtattcccaactttggcatacattctgcagaattccaactttccaagaggggccctgggtgtctaactgaagggccagaaactgtgtccattacggaccggaaccggaccggtctttccgaaggaacggcagagttgcgcgggcccgaggaaccacaggggaaatcctagaagaaggcaagttctcccccgtgagttgtgcgcatgcgctcacacagggagagcgacacacgggggccaacccccgcggggggggacacgaggggccatagataggcacccggaaagaccacacggacaagtgatgctacccccgcggaatgaaggtgggcgggggcacacgacagagatgtagtgatgaggcgagcaactaacaggaagagaggaggaggaggagccaacaaaagcgcgacgcgacagcggcgaagacgaaagctgaacgagagagacaaaccgacacggtggcaggcaacgaccagagatn

SEQ ID NO: 544919 - DNA, 979 bp, Homo sapiens
  misc_feature (128)..(128): n is a, c, g, or t
tgctgctggtgtatgaacggattgtgtctgggcccggcggcccacggtggcgcgttagatctgtgatcggtgaaccccccgttgtgtgtacagcccctgtgcacaccccggggccggtatgcgccgcntctttatattttgagcgcccctttatatctcaaagcgtgtggttcaaggccagggcacactttttgcggggacataaccattgaaaggaagcacgtgatataattgcgagagtactgccctgtggtccgctttccgtttccaaatgtgggggatcccaccccgcctgtacttcccccaatatggaggaaaaaactcttcctgcctgctgtagtagaagccggtcctccgacacgtgcccccaagaatggtcgttcgtactacgaacaggatgttgaaggtccgcgaagaatcgtccccgaaaagagttcgtgaaatacattcttctgtcaatagcatgaccccgtgctccacttacagagataattctctgtcgcgccccccctgcccgtctgtcaacaagaattctggcgcaggcaagaattgtgggatactatatgattcctccctgtaacggaggactggacgctgtatcgcttcttggcgcgcccaaccacccatggacgccactaccttcttccaccaccttgcgttaagagaggagggagtatatactcctcacaaacccttcttctgaataattagagtgcccccccgcgagtcgtctggtaagaagactggagcggcttcatcgaccattgacgggtgatgaggataataatagtcggcccacacatttcttcccagagggatactcttcgagatcgcatggtagggtatcaactcttactttctgagataatataatcatacacagccggagagttctttctgttatatagcaaataatagtggcccccaacacaactttgtccccacaggttcaaaaaaaacccctttcccccacataaca

SEQ ID NO: 544920 - DNA, 778 bp, Homo sapiens
agcggggggataaaaaattgtaatggtaaagttgaatatcttgtcggctttgtgttcgctcctgatattcagtgagcaggagggagtggcactcagtgagtttcttcactcaccacaagctcggtgagcgggagggagtgtaacagctcttttactcctgccatctgcagcttggttagcaggagcatgactgctctttcactccgcacatgttctacgaatgttcttgatgttctctgtttgcccaacctaatgacagacataatggttacatgaggatcatcacgtagaagtcgatgtaagggcaaatttagaatctgattggacgtcgagtgagtaaaaaagctctcagataagtctctcaaggcgagctaggtggagtacgccgaaaaagagcggttggcctgctactgtggaaggctaaggtcctggggctattataagggctctcagaatggggtgcaatgtatgagaatccatagtagtgcggcatatgtgaaaaacggcaaccattcaagttgaggttaaaaggggaattcaatacattcggatatcatataggagacgagacgtcgggttaatgaatcgagagactcgaaagttcttcgatgactgaggtcgtcggactgcgtaatctcggaacccttggacagtctatgagttctgtcagaggctttcaggaagatagtccttttgatcgcatgaacgggtcagagttctcaatgcaagaggaacccttggtccactggttcatgtcactattgaaacttgggtcatg

SEQ ID NO: 544921 - DNA, 176 bp, Homo sapiens
tttttccggaaggtcccctttgggaaaacttattgttgtgacctgaaaatgttaatttgaaaatgtggggcagggacagtgacatttttgtagtcccaaatgcacaaaattatgggaaaaaatgttgatttttaaacagtgtggcgcgcttttttaataatcctttaatcttggga

SEQ ID NO: 544922 - DNA, 337 bp, Homo sapiens
ccgagtcataatcacattcctcgttccacgctgcttcgaaagacgcagacccctatcactaagggccaccttatttactaactccttcaggccacacacctcccagctaaagcaggagttatacactggttgaggacatcgaacaggttcagatgaaatctcgaggcaacagaaagggcgatgaggcagcaaaagaagcctccctttcttctggctctggccctctcctttcctgtggtcccagcaatcctacccaagaaattctccaccgagaaagctttggtatacagcaaggaggctcctttcaaggggactggatggtcagaaatctgtagag

SEQ ID NO: 544923 - DNA, 121 bp, Homo sapiens
cccaggctcggaggcccctggaaaacaaacgggtgtgaaactaaaatttttttaccagctcccagggtggacttcagtgtgtgtatttgtgtaaataagtaaaaccttttatttcttttta

SEQ ID NO: 544924 - DNA, 353 bp, Homo sapiens
attatatgtttgggttattaatagttataatctaatgtttaaatgttagatataaaaggggcaaatagctcaagcatggtggtcactcctgtatcccagtacttgggaggctgaggcgggcagattacttgaggccaggagtttgagaccagcctggccaaaatggcaaaaccccctcactactgaaaatacaaaaattagccgggtgtggtggaacacacctgtaatcccagctacccgggaggctgaggcatgagaattacttgaacctgggaggtggaggttgcaataagctgagattgcacctctgcacttcaggctgggcaacagagtgagactctgtctcaaaaaag

SEQ ID NO: 544925 - DNA, 467 bp, Homo sapiens
  misc_feature (118)..(118): n is a, c, g, or t
cagctgctgctaaaaccacagaagtctgtcatgaactaacgcgccgacataacatccacgtccagccaatcaatctacccacggtcccccggcgagaagagccctacggattcgcccncaccctctaccacacaccccagatcatgaactacttccttgagcacctcctagccacatgccagcaactggccctggaactgagcccccatccctcagccgagtgccacttctgcaggaggcccctgcattttgaagtgccgactgaacgagagacctcctatttcccaggcttgagcaagccgtcatctcctcaggcctgacgcatgacctcaattattccacttcaccccaggccattaccatctccagaccgtcttcagacttgtccttcatatgcgaattacgttctattaacctttaatctatagtaccaacatagtcctggaccaacaaaaaaccaaaaaaaa

SEQ ID NO: 544926 - DNA, 408 bp, Homo sapiens
  misc_feature (201)..(201): n is a, c, g, or t
ccccgagtccccgtcacgccctggaaacaaacggtgttttacatggaggactacctgcccgtgaaaacgggcgaggagatttttggccccctcggcattcggcccaacgccaaaaacaaccggggcctgggcttccccctcgacctgggcttcaagggccaactgtgcgagctgtcctgctcccccgactaccggatgggnttagggccggcttttcccccctgcacgagcccagggggtgagggtttctagggggttttgggggtcccccttcctttccctccctcccccaaaaaggggtttttggggcctgggctggggggatggggagggcccctcgggactgtgttttttataacttatgtttttttatggttgccttttcgcccattaatcctcagctgggga

SEQ ID NO: 544927 - DNA, 202 bp, Homo sapiens
acacacgcacggagagggtctcagtttcctactccattgaaaggagaaaaacacgttctacctgttggggagattaatgagatgagttcacaatgtccagagggtctagcacattgtggtgcccagggactattgggattagggttcctcccagctctgggctcctggctggctggtgcactcccttctccggtggcgtggt

SEQ ID NO: 544928 - DNA, 379 bp, Homo sapiens
gtaccaatgactacatgaggtctggctccaacctcatttcatggctctaataatataatggggtggccaggcacagtggctcaggcactttgggaggccaaggttggtggatcacaaggtcaggagttcaagaccagcctggccaatatggtgaagccctgtctctactcagaatacaaaaattagccagatatggcggggtgtgcctgtggtcccggctacttgggaggctgaggcatgagaatcggttgatcccgggaggtggaggatgccatgagctgagatcgtgccactgcactccagccttggagacagagcatgactcttgctaaaatgaagaaaaaaagaaaaaaagaaatattcctgagacattaactgg

SEQ ID NO: 544929 - DNA, 732 bp, Homo sapiens
gggcatgaatatgggcatggaggggcagggcactacatgtaaccttcatctagttaacccaatcgcaaagcaagggggaaggctgcaatagttatgccagaggagtatgtagcccggggtgggtccaatgggtgtgagtgatgggagcagcgcgatagttatgaccacaagccgagatgctcgccccatcctgtcgcagctgagtgatggggccccgcatggcgatgaacgtaacagttccgtggaaaccactcatcgatccaacagtgatcgatgcgatggaggaccgcgccatcctcggggaatgccaatgtcggcatcaagtcgccacagttcttaataaatggagacccgaacaggatgactggggagcaatgtcatggagcatgttacatgcatcagtagcgttaatgggaagtatgcattgtctggcaataggtgacgtgattgtcaaactcatgttgattctcgggaaatgacggtggagattcgattcttgtggatctattcattggaacaaggagggatcccgtaatctcttcatcagggaacgtttgaaaaaggcgaggaaatgaccaactggaagtcaatgggggggacatgctagataacatatataagacattaagagaacgaagagtgaagtgattgtgaatgttattatactgttatgcatataacggtggtctcaatagattttgggacaaagaactgggaagtttgcaaacaagt

SEQ ID NO: 544930 - DNA, 797 bp, Homo sapiens
  misc_feature (348)..(348): n is a, c, g, or t
gcgccatgtggactccatgaatgtcatccctccctggaactggtggagcccattaagaagtatgatgtcccaggcatagtctgatgtctactgtgaggtgtgtgaattcctggtgaaagacagtgaccatgctgattgacaaacaactagattgacaaagacatactcgtacgctttggacacaatgtgtctcgaaggctgtcgaagtccctgtcggaagagtgccagaggtgtgtggacgcgtctggcaggcatccatcctgttccatcctgcctgataggaggtcaagagcctgtatctggtgtgcaagcattgctgtagcttctgattcttgcacgcggctgctncactgaccgttcacgtgactcagccaaaggacggtggcttctgcgaagtgtgcaagaagctggtgggttatttggatcgcaacctggagaaaaacagcaccaagcaggagatcctggctgctcttgaaaaggctgcagcttcctgccagacccttaccagaagcagtgtgatcagtttgtggcagagtacgagcccgtgctgatcgagatcctggtggaggtgatggatccttcccttcgtgtgcttgaaaattggagcctgcccctcggccataagcccttgttgggaactgagaagtgtatatggggcccaagctactggtgccagaacaccagagacagcagccagtggcaaatgatgtcgagcattgccaacgccatgtgtggaactaggaggaggaatattccttctggagaaacacagcattggtttttctacttgtgtgtcg

SEQ ID NO: 544931 - DNA, 299 bp, Homo sapiens
  misc_feature (53)..(53): n is a, c, g, or t
  misc_feature (253)..(253): n is a, c, g, or t
  misc_feature (258)..(258): n is a, c, g, or t
aggccaacttccaaggtttgagaggactgactttaattttgaaagctctactntgagtaaaatgtgattaaacaacattgcatgctacaaagaaatctttcatgaaaggaagtcaattaatgcagcaaacttcattgccatcttattttaaggaattgtcacagccacctcagtcttcatgagccatcactctgatccaacagcagccttcaacatcgaggcaagaccacccacctttctggcctcatctgancactntcccatcctgctgtgtgtcctgttccatgttccggttccat

SEQ ID NO: 544932 - DNA, 1090 bp, Homo sapiens
tcttccaaaaatttattaaggtggtttacttttaaaggtggaaacaagtgtttttaagagggtgatataaagaaagtgcccccacgtgtaatccctaccatatgttgattctatgtgggtgggagggaggggagaagtgattcctttgtctagaatcgagaagaaattgtggaaagtttatctaagaaaagaataataacagaaaagcgtatgaaatagaagttggtgcttgtggaagaatgaatgggagtgaaatggttatgtgaagaagggatttttccaaagtgtgcagaacccaggattccgtggtccaaaagctgtgaaaagcgttctctttcttacgggttctctaggacctaggcagcatttcttccagtgttctgcaaacaacataagaaacaacagcccaaacagcagcagcaaacattcatctgcttgggatccatgacagtcatggggtctccgggggagttgatggaagaagaaatactggtataagtcatcaagtagacgggctccaggcgactccagcttggatccaaaagttgactgtctgtccctttctccaggggctcaggacctaagtgatattgaggggctgcaacaggctcaataactcctccatgatgggcctgggctttcactgcccgtgaattgcgcccaggggtacacaaggtgttctgcgggtcagagtcacttacccagactgtgttggcgaaactttacccttttgtacacggataaactggggagggaccacaatcccctgggtattctggaccaaaaacacacgcaaaaacttatggtagggagcgagattttatacagagaggttctccaatataaggaccagggaacaaaaagcacccgcgaaaacacaggtggaaataatgagagaaaaagtttgtgatattgccaagatttgtaagagaaaaagcaaaaatagggatgtagccacatataggacagtcaccatggagaacacgatttctcacaaaggaatgatcaccattaacttatgaggagtcatagtaacagccgtaccttttctttttatatttcttattctgttttatataaacaggggcgt

SEQ ID NO: 544933 - DNA, 769 bp, Homo sapiens
ggaggcgtggtggagcggctgaagccgctgtaccccgccgagttcggcgtcgtggcggctacgccgagagctaccaccagcacttctgcgggccacctggccgacgtggcgcagttcgagctgtgctgagcgcgacacctacatgctgctgctctggagtggagaacctctaccccaatgacatcatcaacagaccccaagctggtgggtgatgctgcagggtatggggctcgtggagcctcctgccccccaggcatgatccagacatgctggagtgccacattcctgtccagtgaggcggcaatgtgagggagttgatggacctgatgctctggagctagagtgcactggcgctgggctgaggatgtgcctccccagaggctggacggcacatgccacatgcgagctggccatcgacatcatccagatcacactcaccaggcccaggccaaatggccagagagcatcacagctggacatatgggctcacagataaagcgggtgctgctggtgagagctgcctgcgatacctgaggagctaccagcgcgccatttactgaatttctaggagagaggcaaacaaactgaacgaattacagggccacaagtaattggcaacataaacaactgacatgtccttacaggatgtacatggaagcagaattggcaggaaccccgaggaaaccctgcaccatcctgactggagcgcctggggtgagctccacagcaaagagctatgacacacatgatccagaaactgcttgaggca

SEQ ID NO: 544934 - DNA, 256 bp, Homo sapiens
  misc_feature (189)..(189): n is a, c, g, or t
  misc_feature (211)..(211): n is a, c, g, or t
  misc_feature (214)..(214): n is a, c, g, or t
cccccctgggcttttcaaccccagtccgcgagttttttttttgaaggtgtggggggtagattcattcacgtggtttgtaatgaaataatccaaaaaatagggccaaagcgccccctggcaggagcgagggcggggggccgcgctctataattattttttaaaatgatgggggaggtttgttgcccccgncagccccctgaggaggcggggnccnagctacaacccggttcggatttggcgggggtttttttcctta

SEQ ID NO: 544935 - DNA, 282 bp, Homo sapiens
gagctgtcttggtctgaggcagagatgtgacatctagtaacgtttagtaactttccctagtagatccatatcagaaaaaattgcagtattatgactagcacttgcatatagcatgtggaaaacccgatgccaccagagtgaaggatttccttaggagttgaaacaaaacaaaacaaaacaaaccaaaacaaacagatctttccacctcatttgcaaaattgcttccgttataaggcatcaatgacaccaacatgcaaattcaccttcttttccacataggtg

SEQ ID NO: 544936 - DNA, 259 bp, Homo sapiens
agtccgtctagagtcgagcaggctcagcttaacgatatttggaggtcagcactggtgctcacgtgtcgacgagaacttgtacagtgcaggcatgcacctgcagatggtgaatacacgtcagatcaggctccatcttaacggatattgggagtgtcagcacggtgctcactgtgtcgacggaacttgtccagtggaggcatgcaccgcagtggtgaatacacgtcgacctggatgcatgcatgcatgctcgggtactgca

SEQ ID NO: 544937 - DNA, 834 bp, Homo sapiens
  misc_feature (13)..(13): n is a, c, g, or t
  misc_feature (15)..(15): n is a, c, g, or t
  misc_feature (17)..(17): n is a, c, g, or t
  misc_feature (19)..(19): n is a, c, g, or t
  misc_feature (25)..(26): n is a, c, g, or t
  misc_feature (29)..(29): n is a, c, g, or t
  misc_feature (40)..(40): n is a, c, g, or t
  misc_feature (42)..(42): n is a, c, g, or t
  misc_feature (46)..(46): n is a, c, g, or t
  misc_feature (68)..(68): n is a, c, g, or t
  misc_feature (72)..(72): n is a, c, g, or t
  misc_feature (77)..(77): n is a, c, g, or t
  misc_feature (83)..(83): n is a, c, g, or t
  misc_feature (125)..(125): n is a, c, g, or t
  misc_feature (135)..(135): n is a, c, g, or t
  misc_feature (173)..(173): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (191)..(191): n is a, c, g, or t
  misc_feature (200)..(200): n is a, c, g, or t
  misc_feature (206)..(206): n is a, c, g, or t
  misc_feature (212)..(212): n is a, c, g, or t
  misc_feature (222)..(222): n is a, c, g, or t
  misc_feature (224)..(224): n is a, c, g, or t
  misc_feature (227)..(227): n is a, c, g, or t
  misc_feature (229)..(229): n is a, c, g, or t
  misc_feature (250)..(250): n is a, c, g, or t
  misc_feature (278)..(278): n is a, c, g, or t
  misc_feature (281)..(281): n is a, c, g, or t
  misc_feature (287)..(287): n is a, c, g, or t
  misc_feature (290)..(290): n is a, c, g, or t
  misc_feature (308)..(308): n is a, c, g, or t
  misc_feature (323)..(323): n is a, c, g, or t
  misc_feature (325)..(325): n is a, c, g, or t
  misc_feature (330)..(330): n is a, c, g, or t
  misc_feature (368)..(368): n is a, c, g, or t
  misc_feature (505)..(505): n is a, c, g, or t
  misc_feature (544)..(544): n is a, c, g, or t
  misc_feature (553)..(553): n is a, c, g, or t
  misc_feature (561)..(561): n is a, c, g, or t
  misc_feature (563)..(563): n is a, c, g, or t
  misc_feature (567)..(567): n is a, c, g, or t
  misc_feature (580)..(580): n is a, c, g, or t
  misc_feature (641)..(641): n is a, c, g, or t
  misc_feature (647)..(647): n is a, c, g, or t
  misc_feature (681)..(681): n is a, c, g, or t
  misc_feature (732)..(732): n is a, c, g, or t
  misc_feature (760)..(760): n is a, c, g, or t
  misc_feature (765)..(765): n is a, c, g, or t
  misc_feature (828)..(828): n is a, c, g, or t
tctgtgtaaaaanantnanttttannaangtttaaaaaanangaanaaaaaaaaaaaaaaaaaaaaanaccncaacnccaaancgacagtgagtaagggcctgcccacggccaagggggaaggcnaccccagggngtcctggcatggactgtccccccactacttaatgtcantgccacnaancanaaaanttgaggaancagggngtgaanaccttaccancngcnancgagcgtgcaagggaaaaaanggatgtctatgtggcttccccatgagcnganagccanganacacggggcaggtggcanaggctcccaattcantnaaaancaggaggctgaatgcccaggtccaggaaaaacaaaaangggattttggaggtaggcttttttgttgtgttaaaaaacaagcacattatccatctccttgtggcccccgagctgctggcctggccccctgatccttcccctctccccacaaaaccaaaaggagttggaagggaggnagaagatgagaaattccaagggtggggaatgcttcagtnactggagancgaccgtnanagtnagccaggagagcnatgggaataacaaggtgaagctactgttccccctggggtggggtggaatgggacagggcanaaccangagggtgaccgagaacatcctgactccagaaaanaacactctgtagcaggaacacagggccgcagagagccactctggaggaaanaggtgaggctatgcggcacaggggcatnaaaanctccttgtggacgtggcctcagcttgctcgctcccagctccctggcctggcttgcctctagangacagg

SEQ ID NO: 544938 - DNA, 244 bp, Homo sapiens
ggatgtaccatcgtctaaatcctttagttttcccatcctatttgaatatctagatctccgcagcatcttcaaacacttctttcaattcatcctgagatgactttgtaagggaggtgtttagccaaaagtgttctcgcatctcgctcctttctatactgtcttttcctttaggtttctctagtttaatttacattgccaaagactttctaacccagtgagttccaagcgctttctccgaggtctt

SEQ ID NO: 544939 - DNA, 462 bp, Homo sapiens
gccatcctattgtgcccagaactgaataccctgggtatcttaatgaacatggcatttaaaatctgtaatttcaaacatgaaccacaatgccgtatgatctgaatggtgttgcctgggttttcttctggggtttttatggttttaggtcttgcgtttaagtctttaatccatcttgagttgatttttgtgtaggtgtgaggaaggggtccagtttcagttttctgcatatggctggctagttttcccaacaccatttgttaaatggggaatcctttccccattggttgtttttgtaaggtttgtcacagatcagatggttgtgggtgtgtggtgttatctctgaggcctctgttctgttctgttggtctagatatctgttttggtaccactaacaatgctgtactgtatcactggtagccttgtagtatagtctgaagtcaggtagcatgatgcctataactt

SEQ ID NO: 544940 - DNA, 462 bp, Homo sapiens
tccactagtgtaggcagattacttgaggaccagagttcgagaccagcctggcctcagttgatccacccatctcggcctcccaaagtgctaggattagaggcataagccaccatgcctggcccaggatggtgagggggatggtttctaggtgattcaagtgcattacatttattgtgcactttatttctatcattacattgtaatctacaatgaaataattttatacaactcaccataatgtagaatcagtgggagcccagagcttgttttcctgagactagacggtcccatctgggagtgatgggagacagtgacagatcatcaggcattagttagagtttcataaggagcatacatcctatatccctccaatgcagttcacaacagggttcatgctcctatgagaatctaatgccaccgctgatctgataggaggcggagctcaggcaagtatgctagcaa

SEQ ID NO: 544941 - DNA, 155 bp, Homo sapiens
  misc_feature (131)..(131): n is a, c, g, or t
aacagcagtgtgaaacccgcgtctgtactacaagaatacgagaaaatgagctggatatggtgaacgggtgcatgtagtgcctagctaatcaagaggattgatggcagcgagaatcggcatgaacccaggantaagtacggttgccgtggccgagg

SEQ ID NO: 544942 - DNA, 647 bp, Homo sapiens
  misc_feature (52)..(52): n is a, c, g, or t
  misc_feature (92)..(92): n is a, c, g, or t
  misc_feature (126)..(126): n is a, c, g, or t
  misc_feature (149)..(150): n is a, c, g, or t
  misc_feature (168)..(168): n is a, c, g, or t
  misc_feature (180)..(180): n is a, c, g, or t
  misc_feature (217)..(217): n is a, c, g, or t
ctgaagattagggtctaaaacttagtctggacctgtacctgtaacagccatnactctctgaatgggcttagcctgggcctacccaacttganttggcctggggagttatagccagcatggcaaaanagtatccagggctactagagtgnnggcaaactggggtctaantttgcacctgcnacgttgagcaagtgcaatctgagtgtcagtattctcntgtaaaatggggcaaagcacttgcctcccagccttcccagtacctgacgcggagttagtactcagctaacagcaactgctcctaataataacgacaacgatacaatggtaaccccactggaaaatggcacctgcggtaaaccagaagaggaaaaaaaaatctgatcatttcatggaataccctttggagataaatggttcagcaagcagaggtttctggccccaggtgacagctgccttcccttccctgagtgtccctgcctacggacccctccctgagtctctctgtgtccacaggtgatgaggagctgctgcgcttctccaactgacaactggccggtctgcaagtcaaaggatggccagtgtctgtcccggggtcctgtggcaggcagcgccaagcaacctgggtccaaataaaaactaaattgtaa

SEQ ID NO: 544943 - DNA, 158 bp, Homo sapiens
cccctggcagccacgaggagcagaggccctggagtaatttggcttggggacgtccccaccccaggcccaggcgcttctgggaacggctgtcggctcggcaatgtcgaatctatgagcttcgaaataagcaacgctatctcttccaacgctatctttcc

SEQ ID NO: 544944 - DNA, 1118 bp, Homo sapiens
  misc_feature (687)..(687): n is a, c, g, or t
  misc_feature (762)..(762): n is a, c, g, or t
tgtgtggccctcgtggtcaccacgccccagtgcggtgtcggtgggtggtgacgtgaggcgcgagctgaccttctgtaggacgacgggcttgcgtggtgatgggaatcgtggagaatatgagcggcttcacgtgcccacactgcacggagtgacaccaggcgtacttctccaggggcggagaggagctggcccagactcgccgtgtgtttgcacttcattaggctccgtgcccctggaaccctgcgctcatgaggaccctggaggatgggccacgacttcatccaggagtaccccgggagccccgacattcgcgtgcacgtcaccatccatagcccagaagattctggacgcgactgccctgcgtgccatcccacgtgacgtaaggccaccattgcagactgcttatccatgtggcccacacaaggggctcgtgatccaggcgtctcaagaagaacaaaaggaaggccatggcgctccgggtccccccgggggccacttgcaagggagccacgggccgcaagtgcaagccgtaaaagcctggaacgaggcttacatcccacagacacaagacccaaggccaccaagagaattgttgtcagcacccgaggcgacagcatcctgacctcgggaagggcacatagcaaggatggcgcgggcgggggatcataggccggatgggctttcttncaaaagacatttgatgaagcacacggaagtggcagggaccctgtggggcattcgatacatatcaccaattgcggnatgatatgcacgtaccacattgtggccaccagtggaacgagaccgtcgagatgtcacaaccacaaggtcaaggcggaacaggcaagggaacattagttggaacgtacccatccagtggtggaccccaggggggacgatccaaagcaacaccatggggcagccggcagagcacagatggagaagaaaggcacagggagaaggaggcaccctaagggggggcccaatacgaaccatcagaggcaatggcacgagaagacagagacagaacgagaggcaaggcgccaaacaaaaccgatgaccccggaggcagtatgacgcacagaaacacaaacaacacagaaccggggcacgacggc

SEQ ID NO: 544945 - DNA, 142 bp, Homo sapiens
catcgagctcggcccctgtctctgaacttagggaaatgttcatcatattctctgatgacatccttcagcatgtctgcgcgcttgatggggatcttcttgtagtccttaatcatcaggtatttcaccaacttatttgccctct

SEQ ID NO: 544946 - DNA, 152 bp, Homo sapiens
gatcttatgaggctgcctcctgccctcgctctgaatgacagaaaatacatctcagcatacttcctctcactacgctccagctgctccttgtagaaggtgtcctggcgtcttagttctgcctctctgctctccagctcactggccagccggcc

SEQ ID NO: 544947 - DNA, 120 bp, Homo sapiens
  misc_feature (87)..(87): n is a, c, g, or t
ggccggcctctggctccttcttcctctgcatgtggctggcggccgcagagcagttcagttcgctcactcctcgccggccgtccctcntcgggctctcctcgcgacactggagccatggcg

SEQ ID NO: 544948 - DNA, 466 bp, Homo sapiens
  misc_feature (22)..(22): n is a, c, g, or t
  misc_feature (399)..(399): n is a, c, g, or t
  misc_feature (439)..(439): n is a, c, g, or t
  misc_feature (445)..(445): n is a, c, g, or t
gcaggagaacctcttgaatctnggaggaggaggttgctgtgagctgagatcgtgccactgcactccagcctgggtaacaagatagaaactccgtctcaaaaaatatagatatacatgtatagactggctgaatggattaaagtacaggacccaactctatgttgcctacaagaaactcacttcacttgtgaagacacatatagactgaaagtgaagagatgaacaaagatattctatgcaaatgaaacccaaaagtgagcaggaatagctatacttagataaatcagactttaagtcaaaactataaagagagacaaagaaggtcattatataatgataaagtgatcaatttaagcaagatggtaaagcaattcttaatatatatgcatccacactggngcacccgatatataagtaatgttattagtctaaagggggnggtagnttcgatacggtaatagttagg

SEQ ID NO: 544949 - DNA, 134 bp, Homo sapiens
gggccggccagtgttctacatacactattatagaactactaagcaaagatggaaaaagaatcacttgtctgtttaacaagatgtgcctactcataatgtcctattaccccagtttatatatacctgggtcaaag

SEQ ID NO: 544950 - DNA, 206 bp, Homo sapiens
ttgactctagaggaccccgagagacgtgttgaatggtgcaatcttggctcactgcaacttccgcctcccgggctcaagcagttctcccccctcggcctcctgagtagctggacctcatcatcagtcactttctctctcattatcctgctttcgtttcgtctgacttcattgccacacgggtctctccagggtacccggagctcgaa

SEQ ID NO: 544951 - DNA, 291 bp, Homo sapiens
  misc_feature (24)..(24): n is a, c, g, or t
  misc_feature (108)..(108): n is a, c, g, or t
  misc_feature (114)..(114): n is a, c, g, or t
  misc_feature (238)..(238): n is a, c, g, or t
  misc_feature (290)..(290): n is a, c, g, or t
tcgtgcggcccagtctcccagaantccttttcatcttgcaaaacaaaccccgaaccccattaaacaatttcctcattcgcccattttcccagctagccttggtaaccnccattnctagttctgtctctgtgaatttgactgtgtaccccgtgtaagtggtatcatacagtatttgtatttttgtgactggcatatttcacatagcataatctccttgtggtttatccatcttgtagcntgtgtcagaatttccttcccttttaagactaaataatattccattgtgtgtnt

SEQ ID NO: 544952 - DNA, 174 bp, Homo sapiens
aatcattgcctccgatggaacccacagggaagaaggaaaggaagaagacacctgagttaccctgctcatgagcactgagtttgggcgagctgtgggacatgcttggggagtgtctaaaggaactagaggaatcccatgaccagcatgcggtgctagtgctacagcctcctgtcg

SEQ ID NO: 544953 - DNA, 722 bp, Homo sapiens
cggggtaccgaccctgcacgcgcgcgtcctactgaacgctggggcggagatccattgctgaacaacgaggagccgctggggctcgcggccttcacgccgcactaactcggatagggactcggactcagaagggccgtgagaaggacacgcgaagcagcgtccggggacacactgcctcttgatgctcgacgttgtcagacaacaaggtgtaaggagcttgctgctagatgcggctcgagaagcgaccatggtagccacccctgaccccgttccagcgccaacagggccgggactgtgcacttggtgatacaggtctgctgaacctggagcagatgctagacgggccagaagccgcaggacagctgggcagagctggcgagagcgtctggggctgcgcaggctggtaagacacgtaccgagcagacaacctgagccagtggcagcctcctgcgcagctacgagctggctaggcggggacctggcaggtcctactggaggccctgtctgacatgggcctagcaggagggagtgaggctgctgaggggtccagaaacccgagacaagctgcccagcacagacagaggtgacggaagacagtgcgtacgggaaaccagtcagtggaggcagggaggcagagaacgctgggaccaacccctgagccaccaggaagggctctagacagagggcaacccacaggctcaaggggcggtgacaggtggcgg

SEQ ID NO: 544954 - DNA, 865 bp, Homo sapiens
  misc_feature (34)..(34): n is a, c, g, or t
  misc_feature (41)..(41): n is a, c, g, or t
  misc_feature (52)..(52): n is a, c, g, or t
  misc_feature (57)..(57): n is a, c, g, or t
  misc_feature (65)..(66): n is a, c, g, or t
gacgtgatatgcgccaagactgcgaaacaacagngaaagancctgcgggggnaactnaccaactnncttttaggcgaggagacccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacttttttaccaaatggagctgactcagtgaaaactggaattaaaaggaaagtcaagaagaatgaactatgtcgatgcacagtatcttttctttcaaaagtagagcaaacctataggtttttggttccacaatctttacgactaatcacctacttaatgcctggagacagatgcataagtgtgctttttgtatgatctttaagcagtcttactgcagccttatttccaagtaagagtactgggaaaaccactgggaactaatataaaacccatttgggacctcagtgccttgcacatcgggtggccctcaacacgcaattcaaatagaatctcacttttcctgccccgctaccccacaatatttcacggctcaatcaccacatcctctttgttcgtccccccaccaatattcccttcattctggccaaacctgtttaccatctccataaaatatcggaatattaaatcacgttccaaaacggagacgcctttatcatttaatggcggggccatagctcatttccccattccgcctcctcaacccatcataatccaatctaaacttttcaccccatttccgagcccgcccttcca

SEQ ID NO: 544955 - DNA, 127 bp, Homo sapiens
ttcagtaccctctcagctccaggtggctctgaggtagctgtaccacccccacccccagctcaatggactgtaaggggaagggacacacaatgaagaaggagcacctagttctacctcaggcagctca

SEQ ID NO: 544956 - DNA, 383 bp, Homo sapiens
gcggccgcctactactactaaattcgcggccgcgtcgacgcagggttaaccatattagctcatgaattagcagagaactctgaggttgataatggtctaacaaattggtttgatagtgtgtttgggaaatggaaaaaagtcataatcatggtgttgtgggcaattttcacctgtatgagtgttttggttctgtgtggatattgtttgattccgtgtatgagagggttggttaccaggactctggagcggtcaatgacgcaacagatggtgaggtacggaccgattccgagctccggccagtgggatgacgaatataggcctccaggcctaggagatggctccgtttcttttaactacgaggagccaatgttgggccccagtcc

SEQ ID NO: 544957 - DNA, 426 bp, Homo sapiens
  misc_feature (257)..(257): n is a, c, g, or t
  misc_feature (262)..(262): n is a, c, g, or t
  misc_feature (266)..(267): n is a, c, g, or t
  misc_feature (270)..(270): n is a, c, g, or t
  misc_feature (277)..(278): n is a, c, g, or t
  misc_feature (283)..(283): n is a, c, g, or t
  misc_feature (287)..(287): n is a, c, g, or t
  misc_feature (294)..(294): n is a, c, g, or t
aagaagtcagaactcatgctgagattaaagcattttctactcagatgagcataaacggaggtcaaagactggctttaaaagccaacattgctggtgccactgatgtgaaatgggtactgactggcgtagagcttaccaactctgaggagtaccgatatggtgtctcaggcagcgatcagaccctaaccatcaagcaagccagtcacagagatgagggatctcacctgcataagcaaaaccagggagggatcgtcagngtcantatnnttngacattnncaagnactntcagtgntccagccttcacttacagcctagactcaaatattatgagacaaatgtctcttctgtggaatcagtgcgacaccctgaatcgatggttaaacactgctatcttatctcaatgcgctagcgtcgaagttacctg

SEQ ID NO: 544958 - DNA, 219 bp, Homo sapiens
taacgagccggtgagatctaggcgagctggtggatactcatgtacctaagaccagaggatggttggtttgttagtcttgtattcttaggggtttaatgaggttttagagacaaggtctcgctttgtcacccagactggagtacagtggcacgatagtagttcactgcagcctcaacctcctgggctcaagcaatcctcctgagtcactggaattatagg

SEQ ID NO: 544959 - DNA, 651 bp, Homo sapiens
  misc_feature (651)..(651): n is a, c, g, or t
gccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctgcccaggatgctattggtaatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaaagaccaaggaagctgttttgctccttaagaaacttaaagcctggaatgatatcaaaaaggtctatgcctccaactgatagctcgcaaggcactgccgcctcctttccaccgcatgatccaggcatn

SEQ ID NO: 544960 - DNA, 123 bp, Homo sapiens
tgccggtacaaaatacaggcacataacactagccaaagatatacctgattacattcccaaaaggcagatatgctgcaaacatgcagataataggaacaaaatgtagttcccatgtgccaaaca

SEQ ID NO: 544961 - DNA, 414 bp, Homo sapiens
gccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagtttctgagtgttgtgttggtacttctactcgctctgtgccacggtgtcttcttttggggagaacatagtgatgtcgttgggaggccgtatagtgtttggtcacccacccaaaaacctctgcgccgttttgcatttgttag

SEQ ID NO: 544962 - DNA, 341 bp, Homo sapiens
gccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagtcgaggtgtggctacgtttgcaggtctttgacatgttcgtgagcgatgttgacacaaactgcctgat

SEQ ID NO: 544963 - DNA, 1037 bp, Homo sapiens
cattgtgttgccaggacgatctccccttttggaggtccaggctaatttccacgccgcggttcccttttcggggccttggggagatttaaaggcacttggcatgttcacaagggccctcgctttccaaatgctgtttctttgtggccaagtccaatcttcctagccctgttgttaatttaccgaaaggtgttttgttcaagtttaaggggccttgaaagagaagggagcttgctgcggtcctttgcccttgtcacacctatatggtttacaagcaccttaagcttagccgtcccagggccgcccactctctcaccagctgaatgtgtgagctgacagcgtcccaccaggtttcacaggaccaatttcgagactggaagctacactcaaagacactcccaccaggctctttctcccttttccttcttgctcaactggcactggaatcaacaggctggttgaatcggcttagatctttcctgaaacacggaggtaaaattttttccttatggcagaggcccctaagcaacggagaggggtgtctcggagagtccagtgccccttaagactggagaaagctgcaatttaccaagttgccttttgccatctgtagtctgacacaggtgactagggttgtagaggtgggaaggcacccctcctgggctgatcttgtgccattcttgacatcggacctgcttggttaaggagggaagtgggccagacccagagtgccaggagctaatggagccaggcctgactctctaggagtggtccaaaggccttcagcatagaaggtgcaaagctggggcagccagtgctcaccggcaccctcacatgtgacaccaagacccaccccaatcccagacatcacacagattctcccccacgccgtcctagaccaaaggcacctgccaggtgtgggccacagcagacaggatgagtgaaagcaacgtagccgccccgcggatgcagtgcgctagccaactacctcccatttctagccaagcctgtccctcgaaaccttcggcacgaacaaatgc

SEQ ID NO: 544964 - DNA, 232 bp, Homo sapiens
gaaagtttaacactttctcttggacttcatgcgggccacaggttggacaagcttgccctaggcatttgtgtgccttccgtaacttctagttgtatttcgtatccatgactctccagtgtcttcctcgttggacaaacccgtaacagttcacagttccaaacagaaatttcccagcctattctaaatctgttaatgacgagagtccaatgtatctcattatttgtagccaatt

SEQ ID NO: 544965 - DNA, 868 bp, Homo sapiens
atggtgtgggcgagcatatgagtatgtggtatagcgtgcatctattcggcgtgctatctgatcgaaacatctgagcactcgaagatggtcacgtaaatcctgtgatgtcgtctcccacccatgtataaaggtgtgctagttattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccacggtggtgggactcaccgcgtctggccaggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaaagaccaagacaaggaggctgtttgctccttagaaacttaaggctggactgatatcaaaagttatgctctcagcgatgggagctggcaaggcaaatggaaccgtcgcgttccagcgcagggcggcatcatcttagagggataggttttaagggctcgaaatccggatatcggtatgaggcgtgaagtttgagtgcctgggggagtgacagtgcatggagaaggtcgaaataaaaagcagcgggagcggccaagaattcgcagagaaagttgatacggaaactcgaaaggtgaaattatgagggacatgtgttagatggggaataatg

SEQ ID NO: 544966 - DNA, 991 bp, Homo sapiens
aggccaggcggttgtgatgagaggataggggagataatatcagcatcaaattcttggggtatctctctaagaattaacataactcttttctagcttaatatttgaacttctaacttcaagagcaactctgaggctttcggtttcattagctaatagttgaggaataactatactagcacaagaatggcctaatgtttgtcataactgtcacatggatgaaattttttaaacgatacaaccatgataaccattataaatgatctatgatcaaaatctacaagtgatcgaattatttcgtacggaatgtcttcctaatggggaagaattgcataggagcattatgcaaatctacacaagctttcataaatgtagctgctgggtagctccacagtgttcataaggccatcctgttatcccccaactcccccatttaagggaaagaaactttttaaatatgggtagagtacttacgtgttgatctaacagttcacttccatttttctagtctggagtacacgagtatataggaacagagagctatcaaaaactctggggatttctcaatgtgactaactctaatctgctattatactgcctttacataacatactatgaacctttaggctgaggttatgaagattactaaccccaaatgtccccttatataaaaagggacggtatgctactgtgactactgaccaggtcacactatgacatcactgccaatgcaagtccagaaggtacacactctgtgaaatgcgatggaaaaaaacgacaaccaatggcacagacatgtaaaccagcaacagaagacaccaacataagaacaaaggatacagacaatggagaggagcacccaacaatatacagaaagggagaagtcatcgaacgaagggataccgccgaactaacagccactcgaaccaagacaccgcgtcaccccacatattacaggcacagagaggaacacccaaagaacaagccatattga

SEQ ID NO: 544967 - DNA, 1415 bp, Homo sapiens
gccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaaacca

SEQ ID NO: 544968 - DNA, 603 bp, Homo sapiens
tggaaagggagtctcgctctgttgcccaggcgggattgcaattgctcgatctcaacccattgaacctccgcctccggggttcgagcaattcttctgcctcacctcctgaatactggaactacggtgcgcgccaccatgcccaataatttgggtatttttagagacggggtttctccatgtgggtcaggctgttctcaagctcccaacctcaggtgatcagcccgtctcggcctcccaaagtgttgagattacgggtgtgagccactgtgcctggccgatacttcttaaactcttacgccttacgttgggggactgccaactgaactgtccagcagcagagctactcaggagccaagggctctccacggcatcttgtccagtctctcaggagttagcagggtttacacacgaggagacagagggctcagaggatacgggtgcccggggttacgtgggattacggggcaagacgttgtgattaacactctagtggggaacttcaaaacccaggttcgccctttccaggaaatgggtcagatcccaggaatatcggcaccgggaatcctgggagatatgggcaacccagttttagtctcccactgg

SEQ ID NO: 544969 - DNA, 597 bp, Homo sapiens
ggcccgcctccgttgtgcaggggctttattaggtgtggcccggtcccccgtgggtttagtctcttgttccttgttttcgtctttggggctccctccgtggactgtcggggggtggttgttgtctttgagcgcccccgcgcatatgtggcggcgggcgaccttagtgcgtctgggtggccactctgcccgtgctctgcaaggggcgctacttcccggtcgtcgcccacgatccacccacgttcaggttgcagcagtacgtcagtaacgtggttacaaagaacgtgtacttcttgtttatgcataaatccacgccctgttctcgcaagtgtggagtattgacacccctctttgttattacgtgcgccatcattatgtgggggagaacatacattgatgaggaactctcctcctctttttaaatgcaggctcctgaatcacacttttataatacttctttaaagagtcacccccctatccacaataccttttctttttctaaacccacgggatatccttccacaacaccaaatgatgctcgaggagccacccaaccaaaccacaagaaaagttcttttacaacccatcaaagacaaaaaa

SEQ ID NO: 544970 - DNA, 1809 bp, Homo sapiens
gccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaaaccaaaaaaaaaaaaaaaaaaaaaagggggggggcggtaaaaattttccttgggggggccccatttaaaggggttacccggtttttttgtttaaaggggggccccataggggggggggttttaaaagcagagaggcaagggggcggccgatgtgtttataacaaaggtctgcgtggtggggggaaaagcgtgttagctgggggaaatctgtggagaagagaaccattattttcgggggggggaaataatgtgggcaaacaataccttaaagaaatttaaaggtccaggggaacattctaaattttgaggtgttatgagggtgtaaccaggggaatatgttgctgtgaaagattggggaaggaattatattcgaaattttatcgatggtttataaacaa

SEQ ID NO: 544971 - DNA, 327 bp, Homo sapiens
ctgaggcggaggttgtggcgagccgagattgcatcactgctctctagcctgggcaacaagagcgaaactcaggggcagaaaaaaaaaaaaaaaatttccagcctcacagattttagtgctggatgcagagaggaaagtggacagtttggggtctcatggggaggaacttgcccctttgggacccacagtcttgggtgtccatgaggaggcacgggcttcttgttttgggcatggtttcatgtcctagagaggtttggccgtttctgctttggctttcctaagcctgcttaagcccttttagacccttacggcctggttgggaacaca

SEQ ID NO: 544972 - DNA, 497 bp, Homo sapiens
tgctgcgtcagaatagactgaagaggtagggagcagatgtgaagcacacagaccatttttggaggctggtgaaacaatttaagtccaggtcaggatggtttggggggctgggctgggtcctggtgcaagcctgaggagtggtcaaattccaggtctcttccaaaagtagaaacaatgtaacttgctgatgtactgaaggtggatgagagagaggtcaggatattgacaagataggtggccagaacagcaggactgatggagttaggaaataataaaaggtgagtaggctctgagggagatctgtgacgtggtgagtttgagaagcctctcagaaaccccaggtacatgtcgggtaggcagctgtatagaaaacttcagggaagcagtctctgcacagatgaagccagaaggctggatgacgtcatgcgaggtacaagcacagaagacgagaggtccaggattagcagggatggcacgcatgaggaggcagagctggc

SEQ ID NO: 544973 - DNA, 280 bp, Homo sapiens
gtaatctctgccttctttgctcagtgcagctgtgtttggtgctttgttgatctttaggcctttttcagcagcgttgtccctggagagcaggataggagctgatggcttctcagcatcttttaactcagtttaaagatgactatcaacaacatctagtcagcatctgttgctctcggcagctgggacttcatttcctttctctttctccacttctctaacctcttgaagactctgtctttgtcatgggtacagcatcacctgtgtggcccttaggctctct

SEQ ID NO: 544974 - DNA, 1416 bp, Homo sapiens
  misc_feature (1276)..(1276): n is a, c, g, or t
  misc_feature (1288)..(1288): n is a, c, g, or t
  misc_feature (1297)..(1297): n is a, c, g, or t
  misc_feature (1318)..(1318): n is a, c, g, or t
  misc_feature (1326)..(1326): n is a, c, g, or t
  misc_feature (1366)..(1366): n is a, c, g, or t
gccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgtgtatatntatgtatatgtntctgtgtcnatgtatgtatatgtatatgtntgctgtanctatatctatgtatgtgtatgtatatgtatatgtctctgngtctgtgtctatatatatatgtgtgtatatatatatatatgtgatatgat

SEQ ID NO: 544975 - DNA, 2243 bp, Homo sapiens
tttgcttgcctgcataacttctgtatatgcatacattatactgaatgttatttgatcatgtgccaaatctgtgcctgatgctctgaattctgtctgatgatgcttgattctccctcccttccttcaagtacacaataaagcaacaacataacacaaccacatacaggcaacaacacaaaaccacatacacaacaaattaaacaacccaaaatcattacaaacaaccacacatagacacacaacaacaaacacctcactaccacaaaatataatacaccatattgtcaattaaatagtgatatacactcaaaacttaaaccacacacaaactagagaaataaacaacactcaccacacaagcatataacaaacaagatgatcaaagcaccaccaacaagcccattaccacacactagacaccacacataacaatatatacgtaaataagaaaaagccaacctagacaagagcccacaacaacccacacaactcacacatatacatacacaaaaacaactcattaataaccacatcaaacaacacacacaacatatacatagctcctacccctcaatacaaaactatgcacacataaatagagaagtaataatgtaaactccacatattctataaaaacactagcaaccacaatctacaccaacaccataaaaaacacaagtacataaaccaaacaatatacacataacaactcaccacacacacacacagaaaaaccataactcatacaatcatcgccaatcaacacaaacaatcactcacatcacgacacaccaccaacgaccacgatagtcacacattaattcactgatacatacatacatcactaatacattatacaaggtcaatcactccgacaatacacatctgttatctctaactcaacccaccatacatagcacttacaatcaaacaatacaaaccatgtatagctaaccacacgcctcacactaactcactacacaaacagagggacttcaataaaacactacattacaactaaatcacgctacatcacatacataaacgactatgacccacaccaacacaaccactacatccaaacacacatcatacaaacaacaatacatacctcacacactccacacgaaaacgaacacatcactacataccatcctacacccacacataaccacaacaatacaccactaaacatacatagtgtacgattactacaaaccacaacagaggactacacatactatactaatactaagtctagacacaacgtgacatccattatactataacttacaacaagtacacactaacccaataagttccgtcaccatacccaacatgcatgagcaaatgactaccaaccatacaacaaaccacgcacacccatccactcatacctccatacgaaataatcatcatacaaaaccacaccaaggcgcatccaacgcaccgcatccactgcaacagtagcacagatacatcgaccagccgttgaacatacacttcgtagagctaatcacgatataccatactcaacagcatgatacagcccaataacaagtagtacaagataagaaccaaaatagctcacaccaccatattccacacgcacactgatcacagatcacagaactcaacatcacacaatcttcaatactaatctcaacaacgcgaatcataacaagtccccagacacactcgcatacatagacacacaacgatacgatcctccacttcgcatatcacagacaatcatacacgcaccaccacagacagcatcaacaaaagccacagcgatcccataacacagccaataccaaaacataataataaaacaccacaaacagcaccaccactacgcatcagcacactgacgagaaacgatcacataacaacaacatacagtccaccacagtataactaatatccacgcatcaatcctctatcccaaacatcatcgctacatcatacacgtcattagtcatactataaaccatatccacacaataacacgatacaacaaagcagtacacatcaccgacaccgaagagccgacacagcaatcaacagctatgaaataccacactaggacatgacacgaacacctcagcaagactaaataactcacctagtaggtgtgctaatcgaataacatcacagccacgacgtacgtcaagtggagagacaatccacaacaaacacagaactaaagaaagatagtagataacaaccaggacaaatac

SEQ ID NO: 544976 - DNA, 857 bp, Homo sapiens
accttaacttaatggatcccttattcaatcagggcttctgtctttatgtctgtggcatatcaaaatggtttctgttcctagaaaagtaataacatatgcttatctttattctttttccaggtgatttgttttcaaatgctccttgtgaaaacacctagtgtgtagaaaggaaagtggccagaaagaacaatgtgggaccatgagtaggtcattaaatagcttagtgatttaccctcatatagggcttataaaccctgtatgtgttatatgtgcttcacagagttcgtgtcaggctcaaaggagatatgtataagaaagtggttgtaaattatgttccatttcataaatatgaagactatatacaaatataatctctaatacaaacaccagagtgtaattaaagtgttggttatacaaggaggtatcatagcagggaaaacacactaattttcatacagtagaggtatgaaaatgaaaatggaaggcacttgaagtcatgtattggtgacactgtttaatacatctcattattgccacatatgtcatctggtattgatttcaagggaaaccaagtgaattctaggttagtatactacaaggtggtcaccatattccatgtaccaactagggtctgtgtccatagccttgtacgaggatactgatgtatccgcacattattttaacacacttcacttatctggcttaggggggtacacgcacacgcgttcaataaacacatgagggtgtcgagggccacagcgcacctcacgaatatcttttcgggacacgcctgggatatggggcccaaaaaacggggcacggactgctcacacacaccgacgactctctcccccaac

SEQ ID NO: 544977 - DNA, 1541 bp, Homo sapiens
gccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggagcaagatgcgccagtcttctcccatcagccttcaaagttctcgtttgaatatttgctactaccaccaagatcctgatgggagaagatggccagtcttctcccatcagggtagttaaatgataagtgttgagagcagttcagaatgacattcactgaaggttctggggggatatattcccatggagtcgagggacggagatcaagaagacttcctagaagaaatgggagacatttcagctgaattttctaggatgagtacagtacagtcacttaaataaaaacagatgctgatgggagaagatggcca

SEQ ID NO: 544978 - DNA, 1047 bp, Homo sapiens
  misc_feature (1)..(1): n is a, c, g, or t
  misc_feature (790)..(790): n is a, c, g, or t
  misc_feature (869)..(869): n is a, c, g, or t
nccgtctgtgaccgccgccagtggatcccttgttgcccgtgtttgtctactctctccttcgcgattctttggtcgttttcctcttttttcccgcttgttctctccccccctgcctggggtgttaccccccgggttaggtatgttctccgcccccccattttggccccgcctttgtccttggggactcctctcgattttatggtgggcttgacacttttagtatcttggacccgtctccccctcgaggtgttcacaggtcccccgagaaagtaaacctgcctctgatgaagttgcttccgattgatgataagagattactattgaacgatgagtggatgatgaagagatttgatgatgaggaagcctgaagcaaacgccgcccttgtagacatcttatacgagatactcccgcccgaatgcccacaagtctcaatccgaatggaaaagactccgaccatcatcgacccccagatcccaaggcccagaatccttccagaaaccggttaaactccttgaccccccaaggacctagttctgtagaagacctttaacccccaatgccacccagtatagaaaaaggtggttctcttccccaagtggaagcccaattcctccaattatgtgaagaattgcttcccggatgacctgcaccccagaggctattccagatctctgcgccagtggaggaagtctcctttaagaaaatagtttaacaccaatttgttaaaaaattttccctcttatttcactttctgtaaccacgttgatatctggctgtcccttttataantgccacgagtgagaacctttccctacccgctggtttgagtaaaatgttgtcccacggtttctatttgccccagaaagtngttgtcccaaatgccgctttagtttttaaagatggaactcccccctcttgcttggttttaagtatgtatggaatgttatgataggaccactagtagtagccgcgtggtcagaccctggaaatggtggggagccccaaaatatacatgtgaaattaaactccgtattttaataaagtta

SEQ ID NO: 544979 - DNA, 1279 bp, Homo sapiens
gccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaggtctcctttggttaagagcggagaggcctcgttggaaaaggaaccttccaggacccgcctgaaggactgcaggaggacctcacaggggagag

SEQ ID NO: 544980 - DNA, 2344 bp, Homo sapiens
gccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaacagataagaaaagcaagaatgactgacaaagaagccttattgagaataatataaagaagaacggctacattaatcacctaacaacgaaccacgaatgaaagagagaaaacgagcaataaagctaaaaatgccaagcccgaagggtagtcctgaccagagtaagaaaccttactacagtagggagatgaagcctgcttggcttaaaacttctttttgattgagtgattccagaagtgaagtgataaacaatggaaactgctaacgaaatataataaaagaccaattaaaaaggtagtatgaagaataatgaataaatattgataaatatgaaaatggaatataacaaaattgttgaaaaatgtataatgaattgaattgaatgtaatgaattgcaacgtacgaacatcaagggggtggatgcactcttggttcaatgggtcacactcctcgtctaattgtgcgcactcttcattgctgtaatctctgttccaccacgttcgaaattcatcgcacaatttgctctcccgtctcaatatcaaacccatctgcgcgtagattcagaccgatcgtcggcgctcttcgtcattttttccatctcctcgacacaaggcgacgcgcgcgcgcccaacggcaacaccacctggcggctcacattgctccatccacaacatcacaattccaccacccttcacaccccaatctccacagctgcaattccacatttgcggcgcggcacgctcgcgctttctaacattgctcgccgccccactcccatcgcatttccacgcaatttccgcatccccacggccacttgcaaactgcgggcgtcagggctgtctctactttacttggtttgtcaatttgttaattgctagtcactgtacatgctacttttcttcccaactcgtgaagtctggccactgcaaaattgctaagtgaaactgcgtatggcatttttgttgccaatttgtttatccacacgtcgcgcgccggccttttacaaccttggctacttcctttgccacatttcaaccctttaacttgcttgccttcgcccttttttccatttctttttccttcttctccttgcggcctgccctgtcacccctgttcacctctgcgcccttgcgttacctggctttcgcctctttctttcccttcccctgtggtttgtctctctttgttctgcccgtcgccgtcgcggcctttcgc

SEQ ID NO: 544981 - DNA, 158 bp, Homo sapiens
gtctaagctcattctgtttgaattatgaccaagtagcccatgttttccagcatcgaaagtaaacagcagcacatcctgtgtgagtagggcactgtgagagccactcacaagcgacaatattcaactttctgattgtctaggaagtataaggcgttgag

SEQ ID NO: 544982 - DNA, 140 bp, Homo sapiens
tacagaggattatatctccttcgcttatgaaaggttatgttggtgcatatgaaatactgggttgaaaacttctttatctattacagaatgtagtatatgggctcccactctattctggcttgtagggtttctggcagaga

SEQ ID NO: 544983 - DNA, 319 bp, Homo sapiens
gaagtataccctccccatttgactgtgaactttttggctggattctggagaacattactgaaggggtgagttgccctccacacctgggagtgttctcgttaggtggaatgagagacttggaagagagacatagagacaaagtatagagaaagagaaaagggggccaggggaccgcgttcagcacacggaggatcccaccggcctctgagttcccttagtatttattgatcattatggggtgtttcgtcggagagggggatgtggcagggtcataggataatagtggagagaaggtcagcaggagaacgcgtcaaaatcg

SEQ ID NO: 544984 - DNA, 1477 bp, Homo sapiens
  misc_feature (1477)..(1477): n is a, c, g, or t
ggcagggagagagtgtccggctggcagtgccgagagttgccgaggacagggcgccgctaagccgaggaggttctgctgggagaatctacgggatgccctggtggaggaggctgggccagaatgtacgcatagagtgaccggtattcagggtggacggccctgatcgctagtagactgaagtgcaggccgcagtggacagcaatggtggacgccgaaggtgaatgccgcgtatagcggccaacggggctcgtatgctgcgtcaagtgactctacagtcatatgtggtaccgggactagccacgtgcaaaggagttcctgacctgcaggagcaagtactatcaccgtaccgatggctgatccagggtcaaaacggtttggccgtaccgttctcgtagcagatgtgaccattccggaagacgacctgtcggccgaaggtgcttcaagtagcgccttgtgacagagggacttgtggatccaaccgagtcgcctattcagagacagacaaccgctatcctatcgcccttaatgcgcacagtggagatcactcctgttgagtcaacttgggacgaagccctaccaaggggccctaacttgaacaactcggtggatcagcttagctttcgttgctcctgtgctttggcgaaatttgagcgcgacagaactacacttgtattacccctaatacattggtgtcgttacatctcgtggagactgggttttagagaggcattggcgaacttctaaagaatccaactccaaggagggtgaccacctcggtaaggcaagcaaacgtcgtatgcataccgtaacaaggtgtttcgcgatggcgggatttgaaggcctttacatcggttggcctcactgtggggcatctctttgtgacacgccccgtctctgtgggacggtctcaaagcggattcgaactcttgggccgttggggggatccggtgtctgcagaacccttgctccaggggtagactttgcggggggaccaaggtggaccaagggattacgttcacctaagaaggggaattgggggcgcccatgagggtcaattcccacacaagagcttgtgaacataacacgcggaacctacagggcaaacataacacagcttggtggttgcccaaggttaccgaaacatgtggatcgttgtgtggacaaaacaaatcgacggcctacacagggctcaacagtttttagggaagtaggggtagtagaacccacgtggtcctgaagtgcactaatatgtaagtaacgggtcctgagcctacggtaccacgtactgattacacacaccagcttcgcgctgtttgctctgcgtcgtgttcttcgactacacagacagcacatagccgcaccccaaactacacaatactcaaatgatattagtagtagagacagatacattgcttgaaacaaaagagtcaactaagacttaactaatcatagtagcagactacccactaacagaaan

SEQ ID NO: 544985 - DNA, 182 bp, Homo sapiens
agacctagaggacccatgtctcatggaacactcttctttcttagccttacttgaatcttgcctataataaagtagatgcacacacattgaaagcttcttgatcaccggcctgaaatttcatcttgaatgtctttgtattaaactgaatttcttttaagctaacaaagatcataattttccat

SEQ ID NO: 544986 - DNA, 622 bp, Homo sapiens
cccccaaaatacaagaaagacctattctctttaacggctaagcaaacttctcttgctttcgtctgtcattttaaatttaattacttagaatcagagtctagtggcaaagtttcacctcaaatatttaaatagcatgttttttaactggcaataccttttaaacaataatttgtggactttaaaacaaagatgatgactgactcttccaacagagacattctgggagaatttaatttggtatcatcctgaactcgctgcattatcatgcagctcagggtagaattgctactctgcacacattagagatgtggccaagatgtagctcaggtgaagtgaaataattaagccaataatgtatgaccctccaggatgtgtctcttgaatagatggaattagaatacggaaattaatccatttccagcatggattgagttaatgaactttatattgtaatgaagactacttacattgtctgaaaatttagagttctaactatgcacaattggattaacctatatgcagggcctgatatgtgctcataaaaccgctcaccaatgttttcatgtgaccaaagataaacatgcaaatagagtaaattggccaaatgctgtgcgcttacata

SEQ ID NO: 544987 - DNA, 263 bp, Homo sapiens
  misc_feature (7)..(7): n is a, c, g, or t
  misc_feature (69)..(69): n is a, c, g, or t
gagtagncagaaacttgcaaggatatgtggatatttggaaatggttgtttcccaagacaggatggaagncttttaagcaagaaacttggcccatgctatgaagtcatgaaatgaattgttggcatcatgtgctcactgaggctttggggaaatggataagttgtcattgaaaaattttaaacagaattctggagtggtcaagaggggaatgcttttgatacccatgtataacatggagaataatgatcttaaaacttcaattt

SEQ ID NO: 544988 - DNA, 405 bp, Homo sapiens
  misc_feature (108)..(108): n is a, c, g, or t
cagacccaaagtaaaataaagaaaaattatgttacccttagccattaacagaaaaagactagagttcctagtgtaagcatcctaataaaagaagaagttcaagaaccnctatccagaaccagtatttcagactttttatgatgaaataaatgtgccagtacccgagattccaggaaaaactaaaaatttgtttttgcaattagccgaacacatagcccagtctttacaagtcacttcacgttatgtttgtggaaaaaccgtaacaggagatcaatggccatgggaagccccaaaattagttcctaaagacccagttcctgatgaattcccagaccaaaaaaatccccctgatcatctttaggttttaaaagtctcaattattagacagtattgcatatttaaaga

SEQ ID NO: 544989 - DNA, 1020 bp, Homo sapiens
gacactgtggtgttcgagaagtcaggcacgtagctcagtggtggacggggcgcgtgcgtttgtgcctctgacgcgggtctccatggtcctttctgccatcatgccgcatgttcatctgatatcacacttcaacgctgccccagcgcctccgctgccctgagacggagatccgtcgtcctgaattcgtccaccccatagatcttgggccgcgagcgtgcacccggcagagccctcccccagtatacatctgacgtgatgtcatcgatgtgctcccagagaccatgattcgatgtgaccattcagcgctgagcatccaagcctgaagacccgtttgctgccgcatcgtgtcaagcacctgacaatcagtccatcagagcaaatgtatcagtgcaggtcagccgacatggaacctgcatctctttaccagacaaaaggactgcatgatgtctgtgcactgccatggaccagaagccagccctgcagcactcaagtctcctgtgaacagtggatctacctactcacatcattatttatcagaaccatggataccagcgagacccaactgttagtgtgtctgggtagatctacactcacacccttttctgccttcggaagcccgcctaagaggaaccccacccgcttgctcattgtgcttagggcttcccatgcccgtggcataccccggtcgaccacgtctgtggttcatagcggcaccgccacatttcctccacaggcttcctgcgtgtgggtgaagagaataaagcaggtttttacgcatgatctttataactaaatcttccccttaccaagatctcctttaatatattaacatttcagcgaggccaacagaacgtgagtcgagtagtaaaataagtcctttcttttcggaaggcccacagtttattccccccagctttggggtaatcaattcaccccgattgaggcacaacgagggcaagaaacgccttggaacgccaggcacagtacttttccctatttctaacacccctaagggagggc

SEQ ID NO: 544990 - DNA, 388 bp, Homo sapiens
  misc_feature (65)..(65): n is a, c, g, or t
  misc_feature (72)..(72): n is a, c, g, or t
  misc_feature (77)..(77): n is a, c, g, or t
  misc_feature (98)..(98): n is a, c, g, or t
  misc_feature (137)..(137): n is a, c, g, or t
  misc_feature (157)..(157): n is a, c, g, or t
  misc_feature (231)..(231): n is a, c, g, or t
  misc_feature (233)..(233): n is a, c, g, or t
  misc_feature (253)..(253): n is a, c, g, or t
cacgaggcggcacgctgctgttcgatggcgaggcgcgcgtgctgcatctggcgctgcccgagcangccgacnagcancagatcaaggaccgcgtgcangcgtggctgcagcatcaggccaagcgcctgctggccgancggctggacatctacgcggnaaagctcggcgtgcggcatcgcgcgttcgcgctgagctcggccaatacgcgctggggcagttgcacttccgacngnaagatccgcctgagctggcngctgatgcatttcccgttgtcggtgatcgactatgtggccgcgcaccacctggggcacctgaatgaaatgaaccacagtccgcgcttctgggacacggtggcgtcgattttcccggagttccgcgacgcacgcgc

SEQ ID NO: 544991 - DNA, 431 bp, Homo sapiens
tatcagagcataccctagagcactgggtaactagcagtcccagcccgacttgtccctagctgccattctcagccctgtgggaggagacagaaagacctgaagaaaaaccaaaggaccaggtcaggaggggcgggggtggcatgagcaatcaggacagggaaggatggacagatgggggaatggagggaagaaggaatgaatgaaaaggtgaatgaatgaacagagagagagagcaggcactcctcccttgctttaatttacaaagcactgggatcctcccaacagcctgcaagacagaacttctgggaagcagaccaggtggctggcagggaggggaggcttgccctggcttttgtgggcccagtgggaggcagggagcaggaaggggcatcctgtatgtgtcctctgcagcagcagcagcggaggcctcc

SEQ ID NO: 544992 - DNA, 610 bp, Homo sapiens
cactttagtttcgcgacggtcgtgtatcgtggcgctgttttttgtttcctgctttcggtgtggcccccttttgtgtcgtctctactggtgggtggcgaagctcgcccttggccccccctctcggtgcccccggtttttcccctcttggcgtgtccccccctagcggcccgctttttggggacctcccactttgtgcgaccctattaggttccttgcggtccgtcattcctggtttccctcccccgggcttgtaatatgcgccccggtggagggaactctggccccctggggtatatataacccgttcccccgcctcctcccctctttccccccctcttgtattccacgtgcacacattggcctcctccccccctaataaatctctgtcttgacaaaaaaacactctaccaaacaagcatttgtcttacactattggccgaaacaacagagatctttatggggaaaatttcttcgccgctattcaagaccacttttctaaaaccatttttaccccttattttctcaataaaaatcttttataccccctattttttcacccccttcctaatctatatcaccaaaaacaaaaactccccccaaataaacaaaa

SEQ ID NO: 544993 - DNA, 323 bp, Homo sapiens
agaagccggcggatcgacatgtccgcccgcctgcgtagttggcgaggaacagattattgagaatgcccgtggtttggccgttgcagtgatgctcatcaagcacgcccaaagtggcactgctcatctcgctgataaaacgcaattttgcggcgtctggttcggtcgcgtccgggtaactgcccgatacgctgcagcctcccagaatcaatacaaaagccacggtgcccagtgcacggcccgcaaaaaaactactcatgatggggtgtcatccttaacgctgaaggtgagaaatgccgcattataatgggcgagtcacattttgt

SEQ ID NO: 544994 - DNA, 549 bp, Homo sapiens
ggggaaggtagtctggattcacgccctctggttgactacccatctgcaagaagggacactgtctgattaggaacggtggaagctagagatggacaggttatccaacgaagacttctcagcatcacggagtgaccttgtaataccatacatggcacacactcagtgcaggaatatattgaccagtcaagaatgaaaaaagaaatcgcatatcttaaagaatactagctttcaagtgcctttctgcggtcttttcaggagcggaagatagattgggaataggaatagaggctctagttcttagacaatccgacactctctagctaagattgtatgaaaacaagagttgacaagcatagtctagtttacagaaggagtcttgtggctaggaatacgtttttaaagaggtatgtggaatacatattaaaacgtgcttgctttgttttccatggctaagttgtccaaacgcaatctgtgggtgttcggctcccagatgaaattctttgggcaaagacactaagaaagaacataatgttcacaagagaaagacgg

SEQ ID NO: 544995 - DNA, 527 bp, Homo sapiens
  misc_feature (280)..(280): n is a, c, g, or t
  misc_feature (350)..(350): n is a, c, g, or t
  misc_feature (364)..(364): n is a, c, g, or t
  misc_feature (501)..(501): n is a, c, g, or t
  misc_feature (513)..(513): n is a, c, g, or t
aggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcatacttaacacagtataaagatgaaaagacaacaaaaatatcttcatacttcctcatcccctcatggaacaaaacctaaactgggagaaccttagtcccctctcttcctcttcctcctccacttcccactattgtcacntgtaatatcagagagcactggattaggatctgaatagagaatgcttacagataatcatagcccactaccntaactaaagatggnggagttgtaaagtgctttataataccatataatgttaaagcaggtgacccttgtttatttgacaggcagtcctgaaataatatgatcatacgaaaaagtcgacgcggcggattcgtatcagctatcgtacgtcgacncgagggggccgnaccattcgcccatg

SEQ ID NO: 544996 - DNA, 100 bp, Homo sapiens
atcccctccccgacgcccaatctgactgcttctaccacctcctctgtcatcacctaggtccaggtttctatcatgtctcccacagattaaccttctgtgt

SEQ ID NO: 544997 - DNA, 135 bp, Homo sapiens
tccaaaaaacatataaggaaacaaaaaacaaaaaaaccgactgttactcattgtgatggagtcacaatagtctatttggagaatatcaggcccacagcttctattgtctatttaatagcttgcccacagtcttcg

SEQ ID NO: 544998 - DNA, 165 bp, Homo sapiens
actcaacagtcatacatagctaggtgcagatggttcagcctataatcccagctctttgggtggctgaggtgggaggatggtttgagtccagagttggagaccagcctaggcaatatagggagaccccatctactgtgctcccagttactcaggaggctgaaatag

SEQ ID NO: 544999 - DNA, 897 bp, Homo sapiens
ggcagataattgagaggcttagggcctggtggctaggtcggtctgctctcctttgccagtctggagacctctgccgaaactatgctcttcgcatgatcatgcggtcaggccaagaagcatccgatgcttgatccccctcttgtatttgatggaactggcgctagtggagcagcactgtatctcttgcgtctggtcgattgtgcaatccagagtgtatgtagggacagaaataaccgcagagccctgtgaacaaatctgggtcccaagttgatcaatgacacagttctgactcagttgactgtggattacagcagctgaagaaggaacgtgccagattactaaagtgatgatgtcaatataacgttgcttgagaatgaaggtctttcaggaagccaatccgagaatgtgtcatacttaaccaggatatatttcatcttctaaatgcatgaaatcgatgtgggagatctctattgtaatctctatggagatttaggatgatttaagtcataacttaaatgatgccagaattaggggttctaaccttcggtgcatgtgggagaccttgaaatcttgaaagaaaagttctcggggtctggggggctttgtcaggaattcatcgacgaagagatctcttgaccgggttaggctgggccggctaaagggtgggtaacgcgcaacatggacagcccggctgcccgtggaagccatccggggggtttggcgcctgcgggtcaccacggctcgccactgcaaatgagcggccgggcgagcttgggaacggaaggcgcccctttctgaaggtgacccaactgtcagaaaaggcggcacaaaagaaagagaagaggcagaaccagcgagcaacaaaaagcgcagacgaaatcaacagaccatcaacac

SEQ ID NO: 545000 - DNA, 372 bp, Homo sapiens
ctaagttctaatctcaggtgatctgcccgcttcagcttcccaagtagctagggattacaggcatgtgccactatgcccagcgtaatctttctttcttttcttttcttttcttttctcttctcttctcttctcttttctttctttttcattttttgagacagagttgctctgttgcccaggctggaatgcagtgatctgatcacagctcactgtaacctccaactcaagcgatcctcctgccctcagcctcctgagcagctgggactacaggcacgtgccaccatgcctggccaattttttattttttatacagccggagtctcattatgtttctcaggctggtctcgaactcctggccattcaacgcctccg

SEQ ID NO: 545001 - DNA, 230 bp, Homo sapiens
cattttttttccagcccccccccttttaaaaattcttgaccaaagatcccagccaggccctggaggtttgacagcccctccctcccaaagggggttcctccctgggagggcaatttaagggggggcccccccccgggttccccatccccagttgaagtttaatgaattaaagtggggcctttatcccaacgggttcctttttttttcaaaaaatgttgggtttggtaata

SEQ ID NO: 545002 - DNA, 231 bp, Homo sapiens
aacgaggaggagacagagaacctgaggcaacgtgagatcgccgccgccatgcagcagatgctgactgagagctgtaagagccggctcattcagatggcctatgagtctcagaggcagagcctggtccagcaggcctgttccagcatggctgaaatggaccagcggttccagcagattctgtcatggcagcagatggatcagagcaaagccatcagccacatccttcaggag

SEQ ID NO: 545003 - DNA, 166 bp, Homo sapiens
tcgacagcactggagcaggtacttcgcaaaagctgatcaaatagtggctgggcgcagtggctgacacccataatcccggcactttgggaggctgaggtgagcggatcacctgaggtcaggagttcaagatcagcttggccaacatggtgaaacatggtctctacta

SEQ ID NO: 545004 - DNA, 158 bp, Homo sapiens
tttgccagagagagacagactccagacagcaatgtcagagggctcggcctgtcattgcctcccagagagaactagactaggaaatagaaaggcagtggcaagccactagagggttctctacgactacccattgcttaatacctcactcttatccctaa

SEQ ID NO: 545005 - DNA, 331 bp, Homo sapiens
ccgcgaccatggcagtgaccacggagctcttacagatggacctgtacgcgctgttatgcattgaggagaaagcagaggacaaagaggtaaagaaggcgtataggcacaaaggcctcttctggcacaccagacatccagataattccaaagcagctgaactcttccaccaactttctcaaggcttggaagtgctgaccgaagctgcaaccagggctggatatgacaaggtcaggaaagccaagaagcaagcagccgagaggacccagcttgatgagcaggagagatgaggaggaagaggagagcccgagcaccaggacacttgagcgagagg

SEQ ID NO: 545006 - DNA, 111 bp, Homo sapiens
ttaaccacaaccttcttgccaagcacatcacgtaccacatcaccgtctcgccaaccacatcaccgtcttgccaaccacatcaccccacatcaccgtcaaccacatcaccgg

SEQ ID NO: 545007 - DNA, 174 bp, Homo sapiens
gagcccctatgtacgtcatgggtgtgaaccatgagaagtatgacgacagactcaagatcaatcagcaaatgcctcctgcaccaccaactgcttagcacccctggaacaaggtcatccatgacaactttggtatcgtggaaggactcatgaccacccgaacaccctcctctttcg

SEQ ID NO: 545008 - DNA, 112 bp, Homo sapiens
  misc_feature (70)..(71): n is a, c, g, or t
agaagagcggggcaaaagaagaaaaaaaaccgcgagggaaatgtgttaacaaagcccacgggcaaaaatnnaaaagggagcctttgaaaaaaaaaagaaaacccccccccgg

SEQ ID NO: 545009 - DNA, 898 bp, Homo sapiens
gtcttagttgaccataggaacatcacgaaatcatgaactactttggtaatgaagagtgtgactgccacttcctcgatgaagggttctaactgccaaggacattctgggaccaagaagagttagatgaacgttatcttctgtctgtatgataaggatgccttctatgtggcagacctgggagacattctaaagaaacatctgagagtggttgagaagctctccctcgtgtcacccccttttatgcagtcgaatgtgaatgatagcaaagccatcgtgaagacccttgctgctaccggtgacaggcatttgactgttgactagcaaggactgaaatacatgtccggtagcacgaagtctgggaggtgcctccacgagaggacttcatctatgcaaatccttgtaaacaagtatctcaaattaagtatgctgcctcagataagttggacgtccagatgatgacttttgatacgttcaagttgagttgatggaagagtgggcgagactgcaatccgcaatgagcaaagtgggcgttgcggatgcctactgatgatccctgaagcgagctctgtcgtctcagatgtgaagattcggtcgccacgctcagaacatgcaggctccttttggaacgggcgatcagagctaaatatcgatgttgtaggtgtcagcttccatgtaggaagcggtgtaccgatcctgagaccttcgtgcaggcgatctctgatgcccgcgtgtgttttgaccatggggggcttgaagtagggtttcagcatgtaatctgttgatattggcggtggcttcctggatctgaggatgtgaaaacttaaatttgaagagatcaccgggggtaatccacccagcgtggacaattacttccggtcagaatcttggatgagaatca

SEQ ID NO: 545010 - DNA, 100 bp, Homo sapiens
agaggaccttctctaattatcagtgaaatcgaaaaggaaaaagaaaaggaagcatgacaatagtagaatctcacttcagcatttgtataattttttataa

SEQ ID NO: 545011 - DNA, 121 bp, Homo sapiens
aacttttatacagctctgcatgaaatattatgctgccgagatagaaagattagaaagtaaagaaacacagtgaacaaatgctttttcataagatgtatttcaagattattacatactttta

SEQ ID NO: 545012 - DNA, 620 bp, Homo sapiens
agcggattgttccgggagccgtcaccacagttaggtccctcggctcagttcggcccagcccctctcagtcctccccaactcccctacaatccgcacacgcggactcatgagacgctggctcccggacggtcgagcgagcatgcagttgcaggactatcactcgtccaccccctcgccatgcccaatgtgaaagacctgtgactcgggtactccatcgtggttctcagttcactcgagactagtccagcgccacaggtccgacagcgcccgcggttcaaagtaaccgaagttcagtagagggagagtcgccgaggagcgaggacggaatgagagaaggacggagcgaaccgagggatgacctgaagggacggcaattgagccgtggcatgagcagagtcgtgggaaaaagctgcttcgggacagagcgtcacgcgccagctggaccgggacctgtcccgcgcgtgcccccagatgatcccagagccgatcaccaatggcccgagctcaggtcggcggccctacatgacatgagatactggtcgagtcaacatgctactttcagattaccgccgtgttgaccccccgtgtggtagccacatgaactgggccgaggcatccaa

SEQ ID NO: 545013 - DNA, 1212 bp, Homo sapiens
  misc_feature (208)..(208): n is a, c, g, or t
  misc_feature (446)..(446): n is a, c, g, or t
  misc_feature (487)..(487): n is a, c, g, or t
tgctgctgtaacccgagttcgcgagccggagcctacagtcggggaatgggtgtgccgtggactggtcctgtgatgcctggcacgtgtcctgtgtggcgttcccacgtgatacctggcgtgcagtagagtcgattcctggggccccactcagtgctgagttgactgtactaccgttgcttgttcgtaggtcctcctggaccatctcatngactctagtagtgcataggaacttgtcgaggatgccgggtctaaagccccttcgaacgggcctgcacgggagatcgccatctcgttcacttctgggtttcatatcgtggtaccttcattatcacgtgtcatacctttccatggctccatggcgagtctgtacttggcttcagtggcctcccatactcatctatagaactactagctaggcgattcactacttccctggaaaggtcaanattggcctattccgtctatagtcttgtggcgcttgccttcntatcaggtcctcgtttggggcctaagtggcctcgctccccttgctggacttggcctgggtcgcaatgacacttcttgtgtcgctactttctaccgctgtacttactcactatgtctgcttaaccaaattctctcaagactactttgtgctagctaagtggggcgagcacttggtgggctgtccacggccctgttcttcttcgagcctgtcgaggcctggtatttccctgagcaccgtggaacggtcttgacgttccgctgctggagtggaatccccatgtaacctttgctcgaagcttggcttctggaaccctgtgcctgggtggtagtgggccgggtgtgtgtcaggctaaggcttgaaggcgcgccgtggaatggcgctgtgggccgtgtatcgccccttgttgggctgtgcatcccactcccgggtctgcacggggccttgtgcccttgaacttgggcggacgattaccgggcgtgccctcacaaggaccgggtggaggacatggagggaaccgcgggaaaccgagggtggtgtgggacccaaaaaacctatgaagaggagtcacaatagagatacctagagagctggttcaagagagcacacagatatacccaaacaaaacggtggtgctgagtacaacaaaaaccaagcgcgagaagagagattgtttacagacaagggcaaaagtataaacatacgcagagtggatcctacgatctctt

SEQ ID NO: 545014 - DNA, 322 bp, Homo sapiens
tgctcttgaggaaaaactacggtctgctatatctacatgttgaacaacagcattaaacatgccatgcgcggacgctcacgcatgtaatcccagcggtttgggaggcttaaagagagaggatcgctttagcccaggagttcgagaccagatagggagacccccatctctacaaaaaataaaaaaattagttgggcatggtggcaaacacctctggtcccagctacttgggaggctgagataggaggattgcttgagccagggagtttgaagttgcagtgagctgtgatcatgccattgcactccagcctggacaagagagtga

SEQ ID NO: 545015 - DNA, 1254 bp, Homo sapiens
  misc_feature (8)..(8): n is a, c, g, or t
agtttttngtgttacaccctagactacttacccttgtgctgtattatgttgaagcaagtccaagttataacatttcacttgtaaatatttcaatgtatttttaaaagaaaaaattttttgtcagtcacaataccatcatcacactctataaagtttttttttcatataattctataatatcaaatatgtagttagggttcaaatttccagttgtttcataaatatcataagtgtgtgtcttaatctgttttgtgttgctgtaaaggaatatctgaggctgggtaatttataaagaaaagacgtttatttggctcatgattcaggggctatacaagaagcaccgtgccagcatttgctaggcttctggtgagggcctctcacagcttctactcacagtggaaagtgatgaggaggtggtgtttgcagagatcacctggccagagaggaagctagagaacaagagtcaggctctttttaactaccagctctcctaggaactaacctagggagaactcattcactcttccctgccccagggaggacaggacattaatctattcatgaaggatccacacccatgacccaaacacctcccattaggtctcacctccaacgttagagatcagatttcagcttgaggcttggagggatcaaattcaaaccatagtagtatgtatgtgcttttaacagtttgttgaaccagggtccaaataaagtctatatgttatattatgttttgttaagtcttttaaaacctttatgtactccaacactcttttatccttgtgttttatttgttgaataagctgacagtttattctgtgaagtttcccccattctggagtttgccaattcttttcctgtggtatatagtttaacatgttattttctcttcatatcctgtaattgtgtagttaaatctagagatttcaacagatatttggtggggggatgtcaggaagagcaaggcgactttacgggtggtgatgtgttctagtatgatgtgtttcattatatttgattgtctctcttagcagcagttgtttgccaataccaattatttgctggtaataagattgtctcagaaataagctttttgttgacttgatcatctattcattttctacttccagggctaacaattccatttgagtaaattctacatcattttatggatgaaagaaagaagtgatgttaacatatgtatttgtgtgtgtgcgtgtgtatgtatacattatatcttttctaaattta

SEQ ID NO: 545016 - DNA, 185 bp, Homo sapiens
cacagaaatggctggaatagtgaggtcagatacgtgcttacatattttttgtcagagaacgattcttggtcacctttggcgctgtatgaacggtggtagtggcatggtatcggcagagctgcaacggtgtaatcaatagaagcttaaaaatgccaaagagtgtgttgataagtggggatctctaa

SEQ ID NO: 545017 - DNA, 143 bp, Homo sapiens
ggtatgtgtgtgtgtgtgtgtcctgggaaagcactcaatactctgatttggaagaggtgtgtgtgtgtgtgagtgtgtgtgtgtgtgtgtcctgggaaagcactcaatactctgatttggaagaggcgtggtgcggatggaag

SEQ ID NO: 545018 - DNA, 305 bp, Homo sapiens
  misc_feature (153)..(153): n is a, c, g, or t
gcatcagatgtctgagactgagacacaaagagtgaaatggtgttctgcttactgatgacttacttgtgaatcttctctggtcaaagctcccaactgagcacttgtgaccctgtccttgctgcagagaacacccctttgactgaattttccatnacctacccaaattctataaaactggcccacccctatcttcctttcgctgactctcttttttgggctcagctcgtctgcacccaggtgattaaaaagctttactgctcacacaaagcgcgtttggtggtcttttcacacggatgcacaaaccc

SEQ ID NO: 545019 - DNA, 844 bp, Homo sapiens
atggcacatgcagcgcgtgttggtctacacatgaagctacttcccctatcatagaagtagcttaatcacctttcatgatcacgccctcataatcattttccttatctgtttcctaggtcctgtagtgcccattttgtcctaactacatcaaggaacaataacttaactaatacataacaatctcaagacgcttctaggtgaagatagacaacctgtcttgtaatcgtgttccttgtccacggcctatcaatccatagtccatccatcgccctcccatccctacgcatccttttacataacagacgatggtctacgatccctcccttaccatcaaatcagatgggcagcaatggtactgaacctacgagtacaccgagctacggcggactaatcttcaactcctacatacttcccccattattcctagaaccaggcgacctggaatccttgacgttgacaatcgagtagtactcccgattgaagccccattcgtataataattacgtcacaagagtcttgcagtcatgagctgtccccacattaggttagaaacgagatgcaattcccggacgtctataccaataccagttttcacgctagacgaccgggtgtgtatactacggtcaatgctctgaaatctgttggtgcaaagcacagtttgatgccatcgtcctagaaatgagttccccttaaaatcttgaaaatagggccggatttaccctattaatacccttatcccttagaagcagagaagaagaggagataaaacaaagacagtgtggggcgccggccaaagagtttaacacacctgggggggggcccacagaaaaactggatactgcca

SEQ ID NO: 545020 - DNA, 272 bp, Homo sapiens
cccatgaggagctcctccgagctgacctctgtcgggacaagttctccaaatgtggcgtgatggccagcagcggcctgtgccaatccgtggcagcctcctgtgccaggagctgtggagctgctagggtgtgctggcatcctgagtcctggccctcttggatcttgggcctcgggcctgcctgacctggtcttttttcccatcccatgtcctttattctggaaaaggtaggtgacttcaggccttggggttcaggcttcgggtctctaggccct

SEQ ID NO: 545021 - DNA, 1805 bp, Homo sapiens
ggcaacttgccaacacaaccagcttgcaaggcacaacatgcaagcttcgctattttccatcagccagcatgcattccaccagccacagcagccatttcagtgggcaatccatgcgtgctgtttgccgtccctcagcacacacatgcacattctggcatgcacagcaccatgccatccagcacacacattgccacagggcagcattgcacacctcatctgcaacacgtgcttgttcatcgcgcacacacacctgccaccgcggcacgagcaccacacatctgtagcccacacaacacacgattttctccatgtcatttatgaggcacttgcagccaatgggtatatcaacacactcacaggcttggcagatagccaatgggtccactcactgatccgttggttggggccccacttgccacctaacacgccattggggacgttcttcttagcccaagcgccgatggcgtaggaccaatagggtatctacaccacgcaacacacaccattccacagcagcatcagcacgcaccactagtcaacatttacaaggtccacaacaggccgttccacacccgggctttctacgagcgtcccaaccgttgcggtagccacgcgattggcggcaggccacaaccttcaacaagggtggccccacaaggacaacatgccacgaacacaagacaagacggtccagtaggcggcaccactttccctagcactaccacccagttggaggacaccgccatcatgagccagccacatcgcagataaagatcaacatcccgcacaagaggacaccacacaaacgaccgacgccaaccgaccgggggggacaccagcatgttccagcccaccgttggcaaacacgaggccattcaacggaacaggatggcgaaacgctcatctaggcaacgagtacacacacaaccgggaacaccattgggcagacctacagatttaacagagtgccacaaacacgcaaaccgaaaccagtgggacgacattaccacaaacgggggtcaaccgcaacattatcaagttgggaatcacaacatacacacgagtgccgccccaatgagcacagatgaaacagcacctcctaacacacaacaggacgactcccacgcttcccgagaatctccccggaccacacaatcccaaagggagtgggcaactcagcaaacatcattacacaaaacagcacacgggggaatcttccgcgatcatacccatgtaggacaaaggtcaacatctacccatcatgccaacagacaggcgatggacaacagccgaacccggagtaaccggcaacaccattccattaggcccgaatggggccacaaaacacgcctatggcacacacgacagcaagcgcgacacgaagtgtgtgggtcaacacacagcggcgtgttcgcacacacccatgagggtggcccagtctacatcggatacgccctaacttacacccaccggcatcaatgtccaaacacgacgcggtgacgagtacacagacaccgcatggcggctctcggtgcggtcgtcgccacatgaagcaaccacccaccaaaggagacgacagaacattcaagtagcaacacaatgtccagacccatcgcacacaaggagcaactaaccactcatggtggacatcacccaggcatgggcgagcacacatgagccgagcgacaggccgcatgcacaaacgagacaaccaccccatagcactagagcaccaccggagagctacacaacaactagaccaactaacacaaagaaaacgaaccacacgggaagaggaacaacac

SEQ ID NO: 545022 - DNA, 445 bp, Homo sapiens
cctgtagtcccagctaattggaggactgaggtgggaggattgtgtgagcccaggagtttgaggctgcagtgagtcgtgtttgtccactgcactccagcctgggcgaccgagtgagaccctgtctcaaaaaagaaaaaagaaagaaatgaaagaagagggagtcctcctgtatgacacacagacgagaggtgaaagagggcacgagatcggttctcttttttgtttgttttttgagacagtttccctctgttacccaggctggaatgcagtggcgctatctcggctcactgcaacctccacctcccaggctcaagtgattctcatgccccagctgctcaagaggctgaggtaggaggatcacttgagcccaggaggttgaggctgcagtgagccgagatcatgccactttattctatcctgggcaacagagtgagactgtatctca

SEQ ID NO: 545023 - DNA, 721 bp, Homo sapiens
gcacaaactgtgctccatcatggtgaggcaggagcagaggccggagctgcccgtggaccctctggctgccgcaccttcggccatggctgccgcggccgccatggcatcactcccgctgtggagctcgtcagcactcttgtccgagtttgctctattccccaccaaggtcccctgcgtgaggagatgaaatccgccctgtcaatgtggatcggagtcgcatagcgctcatggtggttgaaccaagttccttcgaaaggtaggacgtgcggaaggcaccatgcgtgctggtatgctcgtccggcgcttcgctcctagacagcgcgaatgcgggagtgtagcgacgctgacaggcctcgctatcagatctcgctcgtctctgccccaccattcactggtggtcaggccccctgtggggctgctcccatgcagggagccaaatcttcctcctcgtcaccacgactcgctcaatttccacccgtacgatacatctatccaggggtgaccaatcgagggtgcccacgtggcgtaactgtacaatgcgcggggtacaccgcgagagactgtgaagtagcaaggggcggtacgcctgagtcctgcgaaccctgctttccctctgaccaaacaggtggccgggagaaagcgacttgggaacacgaggacgcttacggtcccctcaagaccatacgatacattttctgtgtgccacgtgcgtatgagaaag

SEQ ID NO: 545024 - DNA, 473 bp, Homo sapiens
  misc_feature (154)..(154): n is a, c, g, or t
  misc_feature (362)..(362): n is a, c, g, or t
  misc_feature (400)..(400): n is a, c, g, or t
  misc_feature (446)..(446): n is a, c, g, or t
tacagggcaggacgatattatcagatcagatcaggtgttatagtcacatgtgcgaattgcggtgtgattgcggtagagtgaaatatcaggctcgagctcaacatgcaggacaagtgaactaaatataaaatattaagattaacctcctctccgnctcctctattcctgtactctgcacttatattctcctcctcttctctcttctcattctctcctctcctccagatggtgatgtacatcggccagtgcctgaaggatgtgctgaagctagcacgccctctatcgcccccagtggtgaagctggagaagcgtgtggatgctgagtatggccttccctccacccacgtcatggccaccaccgncatcttcttcaccctactcctcagcgccccttccaggnttcacgtgagtgccatgcagcaccctgagcctcttgggtcccctgncatgcttctgcttctcagtcttggggg

SEQ ID NO: 545025 - DNA, 300 bp, Homo sapiens
cccccttcccccattggcgggtgggggtgttcggggggggggttttattacccaggcttttttttttaacccgcaggtgggccggggaccccccccccccttttttttccccccttgggggccccggggccctttcccccccccggctttttccttggccccggggggggttcccctttttccccgggggccccttttgccccttgggcctttttgggggccctttttaaccagttttttccccaaacccggggggggcccggccgggatttcccgggttttttttccccccccgtccca

SEQ ID NO: 545026 - DNA, 388 bp, Homo sapiens
gtatgagtttaaacccaccttattccatcattagataattccagttaaattacccatttagacaaagcacaggtgacagaaaccgaaattcggtgtaacagacacagcattgtaagggaaagacgaaaaaccacaattaagtacaacacagtaaggatcaattttcacattcctcgtacaacgaaccaatcagaaacaatcccgtaaggagagttaaagtcaagatttttgaaattagatgagtcattcaagaatagtcaaaagagtatatttgctcacgcagtcagcgggaagacccacaggcagaggtgataaattcattgagttcggcgacagtcggccgcttaagacagaactccagcctaatccccccgtttatagtttctcc

SEQ ID NO: 545027 - DNA, 516 bp, Homo sapiens
  misc_feature (6)..(6): n is a, c, g, or t
tccgantgtgcttcaccatcattttggtgcctttcttactacttatccaggtttctgaagtattaaacgagcacgttaagattctaaagctctattgtccacatacatgcaggttaccatccccttgtaaaaatcgagtttgttaatcacactagttacatttcaagtgctcagtagtgatcactgtaataagttgtactgggcaatgctgctctaaagggtagctgtggtattatgagtgtttcaatactgataagtaacatcgggtttgacccttgaacattgactgcttgtggggattgtattggctttttatgcctcattgtattacttgagttaccttgaaaggctggaaacaggctttttgatgtaaacttatgaggatctttatgaggttaagataatcttgatttattctactttgagtatatgttttcgcattaaaaataaaaatatggtcaggcacagtggctcacgcctgtaatcccagaaatttgggaggccaaggcgggcgga

SEQ ID NO: 545028 - DNA, 404 bp, Homo sapiens
  misc_feature (19)..(19): n is a, c, g, or t
ccccccccccccccttccncaacttaaatattgtattcggataaccccagacccccaaaagagtttgggggtgcgctttatccccttcccccataaaagtttaaaaatccctaaggcagtgtcggagggtttggctttctccccctagctctacagctatgcatgagagtatgatgatatccagaacgtggctgagtgattgctctatccccttacagcatgagagtatgatgatacctacgacaccttctgagtgtttgcctcactaccccttagatcctcagttacagcatgagagtatgataatccctagacacctcgtgagtgtgttcgctctctccccttccaccatcagcgtatgatgatctcaaggaagtatggatgaataaattaataatataatg

SEQ ID NO: 545029 - DNA, 104 bp, Homo sapiens
aagagggaggtgtcgttagtcatctccacagacaatattccaggaccattaagtttttagaagaaataaagtgtgacccaacaatattatatacagccaagata

SEQ ID NO: 545030 - DNA, 382 bp, Homo sapiens
ctattgtctagctaagggctttcggtccccccgtaaataagatcaaatgctcttaaatgttcctgttcccctcctaatgtaaaaactggatttttctgtcctttagccccctgctgcttctgtctgttttaaagctggccttaagatcatgagccctttttctccagtaggacaggctttgaaaaccacttctattaagttattgatgccatttgatattttttcataatctatatttaacccaaattccccccttgcctcctcttttttaaattcatctcccttaaaacttcccctaagctacccgattgcttttgccccccttggccctcctgtgggtttgtttgtttaatttcctttccccataaacttctgggtagta

SEQ ID NO: 545031 - DNA, 990 bp, Homo sapiens
  misc_feature (628)..(628): n is a, c, g, or t
cttactagaaacgattcgtcatgcacggcctgtcaccgagcgagttgaatgaaaatgagcaatagatgttacatcctgaaattctggtcctaacccaatagaaatctctgacatgaactgaaataacatctgaaaattctctgggcagcaacatatgaatactcacgtagaagagcatgtacctgatgtgtgcctgactgtgatctgtacgctcgagtgagatcccacgtcatagcgcggtttctagttaggccctgactctgcatattggactgttcatctactcatgtaacgtgtgactgactggaaaatgcttggagactaagcgtgacgtggcatgcttgttgcataatgtggaagagctatcatctgattccgaaacaaatgagacttgacttgttgctcaatctaatcttcgattggaaaactgctacaagtttaatggcagagcctgatctcctctggcggtggacaaagtcgtaccgggaaaggagaacacggcgctgcacttgttagaatacaggtaagtttgtggactcatgttgtcaggaccgcaggacaactcagtgtgaaacatcgtcctgtaatctttcactcagaaatctatgccttaattcgttaacggacncctttactacgcgtgctaatgaatacttcctgctcggttgtaactccctcagtgtttcggaagcattaagacttacgggttttatcggagaccctttacaatgccgtcagcattgggcattccgcgcaagttgttcacacagaaggcgtcactttcagatggctgtgcccatgggcgagcgatagtggcatctggttggctctgggttggaaagctcaatactgggtaatgcggttatcggtcacgaggtaaagccaacgagaagcggacctcgcagtgacgcactcgtacatgccggttgaggtatccagcacactagtggctaacttgtaacagaaaaaccctgcgtcttcacagtaagg

SEQ ID NO: 545032 - DNA, 110 bp, Homo sapiens
ccgaaagaaatttttaacactgtaaatcatgcaaatacgatcaacactatttcagagtacctcaatcatctaacagatgccagtcttcaaagagatataacattagaaat

SEQ ID NO: 545033 - DNA, 224 bp, Homo sapiens
  misc_feature (165)..(165): n is a, c, g, or t
  misc_feature (202)..(202): n is a, c, g, or t
  misc_feature (214)..(214): n is a, c, g, or t
aattaccctgctaagtcagtttagctggcaggaatccccggtccgccatatacttgatcagggtcctcatcccccaccatcccgcagctgatgtcagataaccttggcctgtgctcagcgagaatctcgttaggtcagtttagccagaatcctcccttacccttnatgttccctcatagtcatttcctatctgctaaccccnatcctcctcctngagtgtaatt

SEQ ID NO: 545034 - DNA, 1569 bp, Homo sapiens
  misc_feature (229)..(229): n is a, c, g, or t
tcacgctgagagcagcagcctctactgtactggctgagacgctgggtagccctgctcggtgccacacctgtggacagcaccatagtacacggtaggctaagatggctgaaaaacacggagctgctcgtgtgccgagtcactgctcgtgctctgcgaggaaccaaaccagcgtgtaggctgagattgaggctgcgcttcggaacgcgtatcgaaggactcgaatagtcanagtccttgtgcctatggatgcccccaaagagtccgccatgactgacagacatcgtatccgatgctacaataggcttggccagaaggatggtaggtaagtgcgtatccacaagctggccacctgggcattgaatgcatcggaggggaccaaaggcaccatgtatgtgcacacgaaaagctcatgggatcctagcttgacgggtggtctgagtaggcacaactttgatgtaccacgcaacgcagagggaattgcggtagaaagatttcgtggaagccaacggagggtttgctcataagcttctgctcacagatagattttttctcccaagaacacccaccttcggagtagtcggacatacgaactggacctcccatggtccatcggaagtcccgtactccgtagatatagcctacacgaccacgccctcgttgagttgtatccattcgcaatttaaaagggtcgcgaccgcaatctgggttaggatctcacttaacaaaccttttcttttgcaaccgaaccttttctttgggaacccttcttggaccgacgggcgctaatccaggtgccagagtaattgcccagcgaaattgcttcttcctggatcgcaaaaggaagaccgcggtacgcgaggcacgccgccagggtgggcacaagccgagaattcctcattgaatacgggcacattggaccggccccgcgtttgttgggttgggggatccagaggcgccgggaaaggccattaaacgcaaggggagggagcaagtgtccgacacttaacaggtgacaaccccacaaggtactctttcatcgagcaaagggggacgcgaaaaagggaatgcgttgcgcccccgttacattcacgaaacgtggcggactgtaaaaatctgtctggcacaagttgcttgcctcagaaggctcaccaataaggacccattcacagacacttctgacggttggtgagaggctagagttcttcccataggaacatttacttaagcgtatagtgggttggctctcggagagcgatatggacaggaagtttacccaacgccacaggtgggggcgggaaccattataaaaacaaagcagtttgcccgaaggggccacataccacgtagcacacaacggcttgaaccgagacaggtgccacaatataacgacaactgtgccccagtgcaacaatatcaccaaggagagcgttccacaaatgacattaaatgcgatattagttggcaccacaacattccaccaaagaaccgccaaagtacaatatccaaagacaagttattgggtgacaaaaccaaaggtgtgtgaagtaggccaccggacacataactacc

SEQ ID NO: 545035 - DNA, 192 bp, Homo sapiens
ctgtacagttgcgtaaacaaaagctttacacattgctgcagtgtacaggacgagtgaatgacgcgggccactgacgcgggtgcactcctctttcggcccggtgtcgagttgccgtcgtggcccacttttcaccggtcggtcggcttgtaacctgtcctggctgggaggaatgccgcaactggtacggcgggc

SEQ ID NO: 545036 - DNA, 418 bp, Homo sapiens
  misc_feature (32)..(32): n is a, c, g, or t
  misc_feature (47)..(47): n is a, c, g, or t
  misc_feature (56)..(56): n is a, c, g, or t
  misc_feature (303)..(303): n is a, c, g, or t
  misc_feature (363)..(363): n is a, c, g, or t
  misc_feature (406)..(406): n is a, c, g, or t
ggccatggaagatgaaagaacgcgagcgccancggccgtgctcgtcncgagcggantccgctgcgattctcacgccggacgacgactgcaacagtcccccgctttcggatacgtacttcaactggtaatccgcactgtacgcatgcaggcgattcgcagggttgaaggcctcgccaagacgcgcggcctggggctaaacgaaaaccccgtactcaaatagataacgacccaccgctgatctgcttgcatttcactgggccaagcccccgatttgtttcgattttttttaataccgttcggaantgttcaggcttatattttggttttgaatggcgtggcgacagggacgggttattcccgaantattgaaggcgacggcatctttaggccgaacgggttaggcgcnttttgggaacgg

SEQ ID NO: 545037 - DNA, 446 bp, Homo sapiens
aggcacgctatcactgctgctgtgagaagtgctaccaggatggaccatgttggattgggagtagggatacatagatcattgcttgaacgagattttaccagtgcattctctcgctacaagtacagagtttctttcacctaacttcttttatttgttcctttaaaacttccacttcttctcttactgcatacatcaaatggctttcaccagatccattgcttgtactatttagttgtccctggctacaacacctcccccagatgcactgtcttcatcaccatcaacaggaatagctatgctgaatacagccgtggccagactgtacataggatgttcactgaagggggtttgccagggcatctgcaacaggcgactacacaacaggctcatttacaccactgagagaaagtggtggttgcgcgtacgagtcctgctccacttctact

SEQ ID NO: 545038 - DNA, 431 bp, Homo sapiens
  misc_feature (40)..(40): n is a, c, g, or t
taggaaattccatctgtgtgcccataaaaattaagtgatnctaagggaaagtaatagcttttaatattccttcagtaggtcctttgtgaccagtttctgagtttggctaaaaagaagcaacacggctctgattttctttccagaagatgatgattttggaatgggagcattaatttcccttttgaattgtgtacacagctactttcccaaaaatactgaaactgaacatatcttgtccctgttttccttctgatttcaggacatataatgatttgccttccgtaactgcagatgggtgggggccctcccctttcccttagcacccttcttaaattctttgctgggattaacattaagcctaatttgaataggaattcactctcctgtgtcgggtggccagcaaaaccgcaggttctgctgcttttcacatt

SEQ ID NO: 545039 - DNA, 998 bp, Homo sapiens
gaccgtggacgattctctacgaaccacaaagacatggaacactatacctattatgcggcgcatgaggctggagtcctaggctacagctctaagcctccttattcgaagccgagctgggccagccaggcaaccttcgtaggtaacgacacactatcatacgacactgtgattcgtcaacacgccctatcgcattagtaagtaatacttcttccatagataactaccacatctatcatagtacggaggccttttgtgccaacgttggacatgaagtgttccccataagtagagtcaggtgcctcccggatgatggcggtttgcccggcagtaagacaaacaataaagcttcggactctatactctccactcgtcttccttactccctgctcggcatctgcgtatagtggaggccggacgcaggaacagggtgaacagtctacacctcccgttaggaggcaagtactcccaccgcgtggaagcctcggtagacctaagacatctgtactcctggtacagccgctagcaggtgtctcctctatctataggggcgcgaagggccgaagtttcatcacaacaattatcaatataaaaccccctgccataacccaataccaaagcgcccctcttcgtctgatccgtcctaatcacagcagtcctacttctcctatctctcccagtcctagctgctggcatcacgtatactactaacagaccgaagctcaacatcacttcgttcgacccgcggaggaggagaccccattctatatccaacacctattctgattttcgggtcccccttgaaagttaaatgcttatccttaccgggttcggaataatctcccaaatgtgagcttcctactcgaaaaaagaaccttggtacagggtgggggaggggaaaacaacaggggtcccaagggtattctggggcacccaatattgaggataaagaaccaagattttctccgcaatatggtcccggggatttagcccccaaaaaa

SEQ ID NO: 545040 - DNA, 258 bp, Homo sapiens
tttttttttttgctttttcccgggccccaaaaagggggggggttttttttttggggtgccccccaggaagcttttgggggggagggggggcccataattttttccccggggaaggaaaaggccccctttccaaacccggggggccattttggggaaacggccccccttgggttttagggtggtttttccccgggtttttggggcaatttttaaaagggggtttaggggggaaaaaaaagggggccccctttggtccca

SEQ ID NO: 545041 - DNA, 282 bp, Homo sapiens
  misc_feature (22)..(22): n is a, c, g, or t
  misc_feature (96)..(96): n is a, c, g, or t
  misc_feature (160)..(160): n is a, c, g, or t
  misc_feature (163)..(163): n is a, c, g, or t
  misc_feature (203)..(203): n is a, c, g, or t
  misc_feature (206)..(207): n is a, c, g, or t
  misc_feature (219)..(220): n is a, c, g, or t
  misc_feature (224)..(224): n is a, c, g, or t
  misc_feature (228)..(228): n is a, c, g, or t
  misc_feature (232)..(232): n is a, c, g, or t
  misc_feature (254)..(254): n is a, c, g, or t
  misc_feature (259)..(259): n is a, c, g, or t
gatcccccacagtgcctggggnttcaaaggactcgcattctgtttggagctgtcagcccagcacaggacgacatcttgttgatgcggatgacgtgnaaggggtggagccgcaccggatatggaagccatcttatgcacaactttttaccatgtacttatnggnacaaattcgggcagcctccagggcttcagaggacagctgntcnnattcatctgacnncatntggncaanaggcggaactcatccacttttnccttnttccggcccaggtcaaaaatggg

SEQ ID NO: 545042 - DNA, 1322 bp, Homo sapiens
  misc_feature (111)..(111): n is a, c, g, or t
  misc_feature (649)..(649): n is a, c, g, or t
  misc_feature (846)..(846): n is a, c, g, or t
  misc_feature (880)..(880): n is a, c, g, or t
tctaggcggacaaggggtgtatgggatggtatcaggacacactatggacgagaatggctgggactgagatatttcccttaaaatggctgggaaacaaaggtgatgaggaangatggatgcaggtgggtatgtagcctgggtcgaaatcggtccgctaacgatcttgaatcagatttcgagcaaggaagggattccgtcgttgccgagtggcacgatctctgcaggacgctggaaatgaccactggcggggactcattctgagagccagagctcttactgcgtctcgagaatccgagaaagcattgcgtcgcagaaactcgagtgcgaccgagtacggctgcaagggaagcatggtcacgcgaatagagttgtagacaggtgtccattcacatcgctggtcctggaggagatggcgaggcagggctacaggggggagctccgcgcacgtcaagtcagcgggccaagtgtgcgccgtggcgggctctactgccaacaaagaagagcaatgccaagcgtaatataagatccgcgggggactccgcctacgaacatactctggttctctgtttctacgcaaagtgtaatcgtcctttcaagagcagcgcagagcaccgcggtagcccatcgccaaggcggagatatgacagcntggagagagggaagcggcctaggccacgaccaagggggccggtgaccccgggcggccggggcgcacgggacacagggcaaaagagtctcaaattcctagagtgcggtgactaaatattttgcggtacggtgcgatgaccaacgaaagaataaggaaaggcaggtaggttgacattggttttcggaaataagactaanttcgtgcgttaaagtccctgcggagtcaattcgngtgctctcgatgttttgaacccggtggccgagctttcttgccagtgcggttatgcggaggtcttatagaacagcgatagggttacaagcggacaaaggttggtgagaaagttggtgacgtgtgtggacttcccaagctatatcctaaaattgggtagttggccacttttcgagttggccgacaccatggaagcatttcaatatcacattctgggcgctgggcagaactgggggaataacatttatcaacccacaccttggaacaaaggagcccatacatgaggagacagcagcagagaaagagcccccatatccatttgggggggtgttcccaccgcttcccacgtctgtgtggtataacacagggctggttttactcatcacaacccagggatcgagaaagaacaaggcaggggggacgaatacactcaccagcgcggggc

SEQ ID NO: 545043 - DNA, 192 bp, Homo sapiens
gacccgcttatgaggcactggtttgtacttacctcatggacaactgtgaatgatgtcactaagaaaatggctttatttaaccgagtttgccagagacctgaaatgtcccccaaactaaattagtggcccaccaggagcagaaatcggggacttcatggcaggtttttttggctgctaatcctcgttaagctt

SEQ ID NO: 545044 - DNA, 862 bp, Homo sapiens
tggaaacggagtcttgctctgtcaccaggttggagtgcagtgagctgaaatcgcgtaccacactccagcctgggtgacagagcgagactgtgttctcaaagaaaaaaaaaaacaagcagcctttggcttggtgggaatctgatttctctgtttgcgtgtcccttgtagccatagatgtgattatgtccacaccgggctgccttaatctgtcctgctgtggagagtgacttgtaagatgctgaattattcatgataatacagtgaatgtcctgggtccatgtcctcagataaacttgagaaaataggcaagaaaattggagacgggcgaaagcaaagctgtttctcatcctataattgacagttcgtgtggacgccttaacttggtggatgactccagagttcaacacgataaaaagacgccagagttctcgctgaacgaatgtgagaattcctgtgcatggttttctgatgactatctacacttggtgccctgatgtaggttgggggaacatttttaaaaccagggtgctagtgtgcctgtaatccagcacttgtgcaagctgagtggaagatcacctgtaagttcggagtttcaaaaccaggtccggccattcacggaaacctcgttttcccaaatttcaaatttgccgggttgtgacaaccctgtatttagcggtatcccggagctgagttaagtcgtgaatcggcaggagatgcattcgctgaatcgccggcttcctagtgccctcatgttccaacaaaaaaggcgcgcttatatccaggcaatcggccccttgtaagccatggaataaccggtaaaggaacttggcatatgttaccatacgtattgtttctcatcatg

SEQ ID NO: 545045 - DNA, 793 bp, Homo sapiens
ccctcgtgactcgtgttgctccttgcgccgcgatggtgggcctcactgtccgcagtcccgacgaaccccttccggttgtgcgcatccagtggctctacatgctggcagttgtgaacatgctggctgagcatgctgtgctgtgaacctccctgatgtgcctggtgctggttctgaccctgtgacctgctgcttggtttctgtgctgctgtgctggcctggatgttgaacccatgcctgtgctgctgcctctacacttgtggcctgttgtgtgagctgctgctgcctgctaagcctactcaagtgcttgtgaatgatgtctgacagctgcgccgtctgtgtgaccactatactatccatctgatgctgctgctgcaacatgtgaagtgcttgcccatagctgtgtgctgaagagctactcgtctaatgtggcatgctttgcctgagcctgtggccttggagcccctgtgttgcttgcgacttgcactacaagtgaagtggcttagcttgcccttgaatgttctgttccagcccacaagacctgttgcgaggtcttatagcacccatcactcctcatctactttcttgcttggtctgcgccatagtaccggtttttgctgcacgcatgagaacctggggcatgtttgtgcaatgagcattccttcaggtgtaccatcccttggctgatttgatttcaagctgggcgtctttgttggccaggccaaaatgcctttggaactcccctttccttaatcccctggtgccccggagtgccttgggtccttgtttccttccc

SEQ ID NO: 545046 - DNA, 124 bp, Homo sapiens
agggggtagagggggtgctatagggtaaatactggccctatttcaaagatttttcacgggaattaattctaggacgatgggcatgaaactgtgcgtttgctccaaagatattcagagacattga

SEQ ID NO: 545047 - DNA, 952 bp, Homo sapiens
  misc_feature (695)..(695): n is a, c, g, or t
aaaagtgagctgtgctgtggctcccgcggctgactggctgagtgactggctgagtatagacaactgtcatcatgccccactcatacccagctctttctgctgagcagaagaaggagttgtcggatatgctctacggatcgtgacccccggcaagggcattctggctgcagatgagtccgtaggcagcatggccaaaaggctgagccaaatggggtggagaacactgaggagaatcgccggctgtaccgccaggtcctattcagtgctgatgaccgtgtgaaaaagtgcattgggggggtcatcttcttccatgagacactctaccagaaagatgacaatggtgtccccttcgtccgcaccatccaggataagggcattctcgtaggcatcaaggttgacaagggtgtagtgcctctagctgggaccgacggggaaaccaccactcaagggctggatgggctcttggaacgctgtgctcagtataagaaggacggtgctgatttgccaaatggcgctgtgtactaaaaatcagtgatcgcacgccgtcggcactggccatattggagaatgccaacgtgctggcccgctatgccagcatctgccagcagaatgggatcgtgcctattgtggagcctgagattctgcctgaggggaccatgaactcaacgttgccagtatgtacagagaaggctggntgtggctacagggcctgagtgacatcatggtactcgaagggacctgggcagccaatggtgagcccggcagcggcctcagttagccaaaaatgcagggcacggagccgcggacatggcccacgccgggtcctcgcggggagaggaagagggccaccagggacagggacgcggggacacctggggcgggcacccgacggaaaggggggaaaagcggccaagggggcccacgcagcaggcgacacaagcggggcgtggcg

SEQ ID NO: 545048 - DNA, 830 bp, Homo sapiens
gaggcattgaggcagcacagcgcatgggcttctgttgatgtgggcaggcggagcttgagtgaaagccgcagataagtttttttctctttgaaacgcatagagaatgaatacgaacatacttatggaaagatatagatgcaataggattactaagtatattgcgttagcgttgaaaggtttgggaaacgttaatgtttaagtaggcttaggatgtttacacgatgaaaatatgattagtacttagtaagagctagacaatgaggaaggaaagagatatagagaggatttcgtaaaagcatgagcggaggttgagcatgaagcttcgtttcactggagttaagacaacactgtatttccacagaaacaatctgacgagcaaacggacttacagaatgccccgcaattatagtaccgaattagcaagggcgacatgctgtttcagaacttacaaatcgccaggctgcactgtttaacaccagcttgtcaaagcttcagttttctaaacagttgcagcgtgactaccctaattctgaaggcgactcttttagcacaccgagcattaaactcgcacaggtgattatagcatgacctttgagaatccattgaccgcatgggcagaattggcgtcgatttgagaagcccgtagttaaacggcatttactaagacgcagacgcacacactggaacagactcccgtggggagctggggagcgaatggcacaccaatctgccgtaaagattgaaaggttgcggtggtaaaatactggcaagagaggacgttcgggaagccggacaaaccggaatccacaacgctgcgagcgtacacgcta

SEQ ID NO: 545049 - DNA, 690 bp, Homo sapiens
  misc_feature (6)..(6): n is a, c, g, or t
  misc_feature (11)..(11): n is a, c, g, or t
  misc_feature (21)..(21): n is a, c, g, or t
  misc_feature (67)..(67): n is a, c, g, or t
  misc_feature (73)..(73): n is a, c, g, or t
  misc_feature (81)..(82): n is a, c, g, or t
  misc_feature (92)..(92): n is a, c, g, or t
  misc_feature (95)..(95): n is a, c, g, or t
  misc_feature (100)..(100): n is a, c, g, or t
  misc_feature (110)..(110): n is a, c, g, or t
  misc_feature (129)..(129): n is a, c, g, or t
  misc_feature (143)..(143): n is a, c, g, or t
  misc_feature (151)..(152): n is a, c, g, or t
  misc_feature (157)..(157): n is a, c, g, or t
  misc_feature (163)..(163): n is a, c, g, or t
  misc_feature (166)..(166): n is a, c, g, or t
  misc_feature (202)..(202): n is a, c, g, or t
  misc_feature (206)..(206): n is a, c, g, or t
  misc_feature (211)..(211): n is a, c, g, or t
  misc_feature (214)..(214): n is a, c, g, or t
  misc_feature (230)..(230): n is a, c, g, or t
  misc_feature (236)..(236): n is a, c, g, or t
  misc_feature (243)..(243): n is a, c, g, or t
  misc_feature (253)..(253): n is a, c, g, or t
  misc_feature (256)..(256): n is a, c, g, or t
  misc_feature (275)..(275): n is a, c, g, or t
  misc_feature (284)..(284): n is a, c, g, or t
  misc_feature (289)..(289): n is a, c, g, or t
  misc_feature (291)..(291): n is a, c, g, or t
  misc_feature (294)..(294): n is a, c, g, or t
  misc_feature (296)..(296): n is a, c, g, or t
  misc_feature (309)..(309): n is a, c, g, or t
  misc_feature (318)..(319): n is a, c, g, or t
  misc_feature (321)..(321): n is a, c, g, or t
  misc_feature (330)..(330): n is a, c, g, or t
  misc_feature (337)..(337): n is a, c, g, or t
  misc_feature (393)..(393): n is a, c, g, or t
  misc_feature (409)..(409): n is a, c, g, or t
  misc_feature (437)..(437): n is a, c, g, or t
  misc_feature (446)..(446): n is a, c, g, or t
  misc_feature (449)..(449): n is a, c, g, or t
  misc_feature (463)..(463): n is a, c, g, or t
  misc_feature (497)..(497): n is a, c, g, or t
  misc_feature (500)..(500): n is a, c, g, or t
  misc_feature (505)..(505): n is a, c, g, or t
  misc_feature (609)..(609): n is a, c, g, or t
  misc_feature (624)..(624): n is a, c, g, or t
  misc_feature (686)..(686): n is a, c, g, or t
taaaantccanctttttttantttttccccttttaaaaaaaaaaaaaaaaaaaaaaaaaaaaaggantaaaantgcaaaannagttaaacantanaaaangtatgcacanaaaaaaaccaaaaaggaanaaaggcttatttanaaagaaannaaggnaaaaanaangtagttttcttaagaaaaaaaaaaaaaaaaacaaanaaangctanaangggcaccactgttcanagcaanattaaanaggagaaaanaanacttatttaaaagggacanaaaaaccanaaggnanaanancagtgcaaaaaantcacaaaannanattacagcnagttaancagtttaagaattgttcccgtcagtcacattttttggcccccagaagttcattccnaaagatttcaactacnctaaatttctagctaccaagaagttaanaatgattanaanaagctttccaaggngttatgaaatctttgtagaccagaggccaactancancaccncaagtctgccctcaccaacagcccttgtatttttcagggggaaatctctaggaaaaaagtcagacaccagtgtagtcactatctcccatgtcaaacctaggggnctaaaatggtcagtnttaccataaaatgataattttgaggtttaccttaaaaggcttattctggtctcaaaaattanataa

SEQ ID NO: 545050 - DNA, 758 bp, Homo sapiens
tattgtccattttactctcaaatttggccaacagggaaaatataatcctataaaaaaaggtgcataataaatctatataaatatcatataatccggtatatataaaaataaatgtatcccataatagaataatcaccccatgagggggggaaaaagaaatacgagggtactaaaggtacccgagggcagtatcaaaaacagcccacggcggaaactataaaaatactaccaccagaaatcaccacaaaaagccagaaatctaaaagaaatgcgggaatataaaagaggggaggcggtggctcctgtggcaggggcccctgggcacggacaggagaatatcacaggtcaacactccatggcaggggagcagcgggtggcccccatatgccacgcctggcccactccccgtgaaaagacagcaggggacagagaagattcgcacgcatggtggcccaggggggcaggtgggcacatgaggcgtgcaaacacccgtgaggagccaggggccccagaagggggagaggcctcaatcgagaacccttattcccagccagccatccatgggcacggggcagtgggcccaacattacagggccatcgagaaacgtggaaccagggccgtgagagacgaagtacagccgtggacacactcggggccaggtgccacccccgtggatgtccatcacagggcagaagaaacaacatacccgggataaaaaaacagaatggcaaacccaagcaggagaaactccccgaaa

SEQ ID NO: 545051 - DNA, 359 bp, Homo sapiens
gatgtatctttcatggttatcagttcttaatattcagtttgagttccaccatcttttaaaacagtgcgttcccaaagtattggtccacagactcctggagcatccctaggacccttatattcgaggggttcacaagtatcaaaattattttcataattgcacttatacgttatttgccctttcactgtgaggacatttgtatgggtggtgaaagagcagtgatgtcgtaactgctggcactttaaaatgactctaggctgttttaccaaacatatgagtcctcattgtgttctttatagtctaacatcacattagcatttataaaaaatgccggttatcacttaataatccccggtcta

SEQ ID NO: 545052 - DNA, 660 bp, Homo sapiens
cgcaggcgcgtaggcagccatggcgcccagccggaatggcatggtcttgaagccccacttccacaatggactggcagcggcgcgtggccacgtggttcaaccagccggcccggaagatccgcagacgtaaggcccggcaagccaaggcgcgccgcatcgcttccgcgccccgcgtcgggtcccatccggcccatcgtgcgctgcccccacggttcgggtaccacacgaaggttgcgcgcccggcccgcgggtttcagccttggagggagctcagggtggccggcatttcacaagaaaggtggcccgggacccatcggcatttctgtggactccgaggaggcggaccaatgtccacggagtccccttgcaggccaacgtgccaagcggccttgaaggagttaccgctccaaactcatccttctttccccaggaaagccccttcggccccccaagaggcggagaacagtttctgcttgaagaactgaaactgggccacccaagtttgaccgggaccggttcatgcccgtccgggaacggtctattaagcagggagaaagctcggagtcatcacttgagggaagagaaaaattttcaaagccttcgctaggtctcccgtatggcccgtgccaacggccgggctcttcggcattcggggcaaag

SEQ ID NO: 545053 - DNA, 185 bp, Homo sapiens
ctttgttgaggcatacagaaaatttatttgggcatgccactaagtgatactgagggtcatgggtgtaggggatgattatgttgagctagtgatggcttgatgttgtgtgaccatcccatcttgtgagatgaatagttagagttgcagctgctgcttcatgtgaatggatagtctctgtggatgta

SEQ ID NO: 545054 - DNA, 352 bp, Homo sapiens
  misc_feature (291)..(291): n is a, c, g, or t
gccagccttcgttcttcgtcgatgcctgactcaggtaggggagctttccgcgtggtggacaccgagttctaatcctaggcagatccgaggaccccagcagcgcaggcggtggagaggtgatgccacacccctcacagggcgagcccctcaagtacatcttccctgcgttacgtctctgccatacctgcctgagccatgttcacctgcccacgttgtcccctgctgcctgcccagacaccccaccagttgtgcctgtcaagaccagccatttggtcctggtctgcatggtgntgcgtaaacaacagcatctcagtcagcgtctcttcaacacatagacaaagaaagaaggggg

SEQ ID NO: 545055 - DNA, 304 bp, Homo sapiens
cattaggaagggttgtttacgaccgtggccttgagtgtgaaggcctcacacggagaccgtacgaaagtccttccctgagacatggatctgggatttggtggaggtaaactcatcaggtgtggctgaggtaggagtaacattccctgacaccataaccgaagggaaggcaggggccttttgcctgtctgaagatgctggacttggtttctattgcactgcctctatcctagccttccagcccttttttgtggaccttacattgccttactatttgattgagcgtatccagtagattccaccggat

SEQ ID NO: 545056 - DNA, 172 bp, Homo sapiens
agccagacatctgggttaggcgtgaggcaggcagagtagcctgagcccaggatgttcgagagcaccctgggtcaacatgatgaaaccccgtctctaccaaaaatacaaaaaaattagctgggcatggtggcatatgcctgtagtcctggctgttcgaaaacctgaagtggga

SEQ ID NO: 545057 - DNA, 203 bp, Homo sapiens
  misc_feature (34)..(34): n is a, c, g, or t
  misc_feature (73)..(73): n is a, c, g, or t
  misc_feature (85)..(85): n is a, c, g, or t
  misc_feature (114)..(115): n is a, c, g, or t
  misc_feature (125)..(125): n is a, c, g, or t
  misc_feature (151)..(151): n is a, c, g, or t
  misc_feature (157)..(160): n is a, c, g, or t
  misc_feature (162)..(162): n is a, c, g, or t
tgacatccaaaatcttgatcagttaagaaatttnacatagcccacttacatttacaaactgaagagtaatcantctactcaaagnatgggattattagaatcaaacattttgannagtctctccnagaaggcctaatagaaaagtatgttntaaccnnnnanatgaggactctattctttaactcccattaccatgtaatgca

SEQ ID NO: 545058 - DNA, 153 bp, Homo sapiens
acagtaaaaagagtgaagtcgcccatttctgctcaggatctagctcatgtggtccttctggcttcaaaattcttgctataataactggttttcctccttatgatcttccttttgtccccagtgccagaattccagagcctactcgctcagatg

SEQ ID NO: 545059 - DNA, 330 bp, Homo sapiens
acgatatacgatcatagatcagggaggcattgttcttgatcagcttgccggtccttgataaggtagccctggccaatcttataaatcttcttgtaagatctcagtgcggtgatggtagcctttcatgcccagtgcgtgccacacgagaaggctacacgagacaggatgccatgccccaatacatggccaccttgcgcaggcctcggtgggtcttgctggggcagctacttggtgtgccaaagacctggtgaccccatttgtagccttttgcccttggtcaccccgattgacgtcgatcatctcatcctgcccaaaacacttggttgaccg

SEQ ID NO: 545060 - DNA, 190 bp, Homo sapiens
gggtggagggaatagggaagtgttccttttacacgaatatgttgcataagtgtcccttgtaggggttggatgatgtgctaaggtggtttagagccccaggttataccgtgccccttacagttaacataaaaaccacaattatgccaatgtcacttgggacttcagaagaattatggggtgtgaaagccca

SEQ ID NO: 545061 - DNA, 113 bp, Homo sapiens
tgccatgatacaatcgagctcggtacgaaatccggaggcacaacaattagaaatgacgcaatgatccaggtgagatatgatggtaacttggaccagagaggcaggaagagggg

SEQ ID NO: 545062 - DNA, 220 bp, Homo sapiens
gctgcggcgcagtcttgcagcatggcgtaccccgggcatcctggcgccggcggggggtactaccaggcgggtattgaggggctcccgaggccttccgtttcccgacaaacttaggattccctgtattggtactttgctgctgtagcttgacaagttggcagatatatgctcatgtatttcagagatgtctgtcacagactctgattctctaggtacaaac

SEQ ID NO: 545063 - DNA, 112 bp, Homo sapiens
aagatcaacatataggcctaggcgacggagaagtgtaccacctcctgagctgattgggcctatgctggagcccggtgatgaggagcctcagcaagaggaaccaccaactgaa

SEQ ID NO: 545064 - DNA, 226 bp, Homo sapiens
gtaggatcccactattggatcattgagtatagtagttcgctttgtctggtgaagtcttagcatgtactgctcggagtgttgggttctgcatccgaggtcgccccaaccgaaatttttaatgctaggtttaggtagtttatcgacctgttgggtttgtataagtactagtttgcattcaatacattaaatgctccataagtgtcgtctcacgggggataccgacgcg

SEQ ID NO: 545065 - DNA, 318 bp, Homo sapiens
gcagtataggggcggtgtgaattaactacgacacatatgcatgcatagctgtgaattctgcacgactttttttttcttcttggccccccaagaatatctctggggaaatgttggtcgtacgttacttaactttatttggctgctaattggcgcattagccggtaactggcaagtctggagaccacttacggttgagggtagctggaattttagaccctgggcagtatttaagatttagacagtttagccttgtgaaagttaccacagtgctccatgtgattcattgactgtgagcctgtcgtccatcgcacttagacg

SEQ ID NO: 545066 - DNA, 272 bp, Homo sapiens
atgcactcacatgcacacactcgcacacacacacatacctgctcgcccatcgctcttcccttgagagacaaaaggactgtatagacccagattccgattccaccccagctataggggcagtggcctaaggtgctatttgggcaaggtccagtgaaaatcctgaaggggctgtctcgtgaggtgagggtagatagggagctccttagcctgaaagggtggatcgtgacgggggcttcttgagagtggcccttgagaatgtcagtgcgtattga

SEQ ID NO: 545067 - DNA, 1094 bp, Homo sapiens
  misc_feature (177)..(177): n is a, c, g, or t
  misc_feature (282)..(282): n is a, c, g, or t
  misc_feature (1081)..(1081): n is a, c, g, or t
ttttattcacttcctttactttaaattttcatctctttcaggcgattcttaccttattgcgaaattgacaaattatgctggaaaagttactgaggacacaaagcagccgatctgcttctcctccgatcgccctggagttggtcggtcggctcacgactcatgtccaatgctcttgcnagcactgccggtcatgctagcaagcgctcattgtaatatcttagttgtcgcactcgacatgccatcgtaaaattgcaataatatcagttatgcacatgacttggngaaaaacctcggatatctgttgaaaactctcgtcgcactcgatcaatgcatggatcacacaagttaggaagaaaggtggatcctgattctatggatgctgtgaatgacaggattgcataactcttatcagtacatcacaccaattataatctactccattatgtccttgatagcctgttctacaacacataatatgtatttcatatgccattctatcacacgttacactacacctcttgttagcctattctattcttaattaacagtcacgcctcaatcataactccctaacaaacagatcgaaacgcatccatcattattactaggccaaacataattcaacttaatttgtgtaacttttctcatttttcattttacactcgctttcgttttcgtactgaactattgttactctcatgtctagtcatccatcctcccatagtctatcgcatcattcaataaacataattatcaactcgatgtcatcttggtcatctcacatatcttctacaacatcacctttcgtcgcctcactcttgaaccattcacagcgatggaacctacttgctttgacacatttactcttttattgcctgctctatatccaattactctcttctgtttacattatcattatatcgaactttagttactatacgatattacttatttaaatgagaatacaatacacattataaatcaccagataaattaagaaattccagcaccatacaggaagaaatattcactactctactcactcttcatctacacatccatatattaatctgcaaattanatcttttagactg

SEQ ID NO: 545068 - DNA, 545 bp, Homo sapiens
agcggagaggctgggcggggtgggaatggggcgcccgaggccggcctggggcgcacgcagacgcggctccggtagctgcggcggaccgtacagagaaacagaggcaagtcaagacaagtgctcgacagtaacaaagacacgcaactatacaagtacatatcagcgatcactttgtacgtaggatcgcatatccacatgaagtccagcacaatgatcaacgactgccagagctgactaaggtccctacggtcacgctactatgcaccgtgcccggtctcacgtcgtacggcgacaacaatatagcactcaaacggcactgcacaacaacaagtgcaataccggcacaaaacacaaggtccacggcaactaccatagtcagacagcacaaaagctccaagcacagcaagacagcactattctgtgaatgacgctgcaacaccagcaggcgacccaggctgaaccaacactagtccatctaggatgaaaaaagataccaatacaagccagaatccgagcacaagacaaacaagaaacgtgtacaccaa

SEQ ID NO: 545069 - DNA, 815 bp, Homo sapiens
  misc_feature (382)..(382): n is a, c, g, or t
  misc_feature (390)..(390): n is a, c, g, or t
  misc_feature (476)..(476): n is a, c, g, or t
gccggggattggattggagccaggacctcacttcctcctactgcccctgacccctgtccccatcccagcacctaggcgctcatacctcgtggcagacaccggcccatggatcatggttcctggcgtggctgatagagcatcactacgtgcgtggtcccctacatatggcctaggggtaccgctgactgcactgcgtgagcctcactgttggggccagtaccttgctccattggactggcgtacttggctactgcacttgcgcaagcgcaccgtctgtctcatctcggagatgagagatacgaccgaatcaggaggatcggaagaaatggacgattcctgtgcctccccagagagcagacttgtacatcggggtagaatgctngcgagatnagcgaccgcggctacctgcaatacggcgggatatccgacacattggtacgtgtgctatcccttagtgccccggtagctatggagtnggccttgttcgcatagatgcgacgtgcgagcgattgccgtgcgcgatgtgaggcgcctgagatggcacaggcgtcgacttgggatcgatcctgattacgcagaggcgttgcgaatacgtgggagcctcaccattggagtccagcggccaaaggattctaagtccggcgaaaggcgaaagagtaagcgcaagcggcctccgaggaatccgattgcgtaggaagaggcactcgggcccagtacggcgagccttagcctacccgccgagccacaatggagacgttgaagcaagtcaaatggacacctacattttcccgccagacccggtggaaaacccccag

SEQ ID NO: 545070 - DNA, 285 bp, Homo sapiens
  misc_feature (33)..(33): n is a, c, g, or t
  misc_feature (59)..(59): n is a, c, g, or t
  misc_feature (69)..(69): n is a, c, g, or t
  misc_feature (125)..(125): n is a, c, g, or t
  misc_feature (139)..(139): n is a, c, g, or t
  misc_feature (255)..(255): n is a, c, g, or t
  misc_feature (264)..(264): n is a, c, g, or t
atcttatcttcctaaatgactaatgaggtaagncgggtgttctttttctgacactttgnattcgccatnctgggttctgttagggttctctgaaggtgtgattctgaccttctggctgatgtggnagggaagagcaagncgccttcccagggccacagctgctcacctctcgggcagatattttagggcaagcatccgtgtgtcttcccatcttcaggagaaaggtaaatgcaccctaagtgttcacttctgganccttttttnaagttcacttgggactttttt

SEQ ID NO: 545071 - DNA, 166 bp, Homo sapiens
ggcccttgggggcccccttggcaattgccaaaaattttttccccgggggggggcccctccgggcccctttttttcccctcaaaagggggccccccggggggggggggcctttttggtggtttgggtgggggtttttgaaaaattttaaattttttttttcccccca

SEQ ID NO: 545072 - DNA, 343 bp, Homo sapiens
ctcagcattaccatgcagcgatgctatcgaggagtatcctgactcgcatggtggtcatgggttgaggtcatggtgagtgtatccgctgagattcgcgctggaggtaggatatgcgtgctgtgggtcaaacgaatatagatagggctctgtgattgagacaccccttgagcgagtgtaggaagctgaataatttatgaaggagaggggtcagggttgattcgggaggatcctattggtgcgggggctttgtatgattatgggcgttgattagtagtagttactggttgaacattgttagtaggtgtatatattgtaattgagattgctcgggggaataggttaa

SEQ ID NO: 545073 - DNA, 608 bp, Homo sapiens
  misc_feature (6)..(6): n is a, c, g, or t
  misc_feature (181)..(181): n is a, c, g, or t
cttttnccctcagttaagtcgggggcataccctctcccatcaccctttatgctcccattgcacactcaaccttttgtctctaaaactgcaaggtgcgaacaaaactctcatactagaacgcacaacagcttttatcagaacccccatcagcgtctactctttttttggggcgtggggcaantaaagtgcccccctctgaaaaaaatcacgccaaactctcccctgagagcggttatctacctttcctcacattcactaaataaaccccctctccccacgtcctttttcctcctttttaggggctcctccccccttcttttccccttttctcgctcttcctctccttctacttctctacgcccccccccccacaatattacttttctcccctcctcttttcttttccctcttttcgcccccttcttcttctctctacctcctcttccgttcctccctctcttttttttttctttctcccccccctcccccccctcctcctcttttcctcttctttttcctcctccttcttcccctctctccctctcccctccttctctcttcccccctctttctcttcctcttctctctatatttagaaaaaaaaaata

SEQ ID NO: 545074 - DNA, 277 bp, Homo sapiens
ggtggtacttgccagtgctcgtcgcctggactgtgtgctcgatgagtgtggaagcgacgcttcaccattgatgctcgcgcgactggagtggcgggccacgcatccgcagaactgcttgcatccgggacttcgcagcgagacacgtgctttgctgactggcagagaaccaagacatgttggcctaatccacgcgcgggccagtgcgtgggggtcgaactacctgctgtgcttctcttctccggcctgaatatcgccaccatgacgcccgcgacggtca

SEQ ID NO: 545075 - DNA, 246 bp, Homo sapiens
ggcggaccttccacagcaagactcatctctacaaaaagaaaacactagcccgggcgtggtggctcagctttcttaatgagccgtgaaaaatcaatgattctaagaataagaccaggatatattatttatgtaaatagggatttatgattttcctgtttattaaaactttttttcaaaggcatgtttctacttaaaagaaggcctgagaaagacttacacaggtcaagggtctttgctggtgggaag

SEQ ID NO: 545076 - DNA, 1282 bp, Homo sapiens
tacctcgcctgctgtagcctctggggcgcattccaaccttccagccatgcgaccatgcggcagcaacaacacaaattacttattttcttgccccatacataccttgaggcgagcaaaaaaattaaattttaaccatgacgggaaactcgtgcacactccaggctggctcagtgctggcacaccacgcatcgagtgaccaagcttcatggcgacggctgatcagctgactgaacatggcatcgaacccaccggcacctaccacggggacagcgaccctgcacgctggcaccgccatctctgctgctactacaactgaacgccaccagcgtggcaaaatatgcttccctcgtgccatccctggctgcgatctcaaaacctgcagcacccactggacctctgctccagctcaggctccatctttgcgccacgactcctcttagcaccacgacacactcttgctactcttgcgtcagtcatgcgcgagcacggctaacaacctgcggcccaaacggcacactacaccatgatgggtcgccgaagcctggcttgacttactgtaccctggaactgtgcgcatacggcaacggacgcgcagcagctagcctcgtgaactgtccatgcaagggacatatccagcatgcaccacacatccactgtgtgccggtggcgcaacagcgcatctgcgcaactgcggcacctctcgctctatcacgcaacgactccgacgcaaggaattaccctgcattctgcatcactgcaataccattcaggtgctggtcgccattcacaccaacaagtgctctgaacaaccgacagagcatcagacacccccataccaaatgccgcaaacactcatcccgtcccaatcaagaaaggctagaagaaacatacctgaactgcagcaccctactcagcacttgcaccagcggaaagccacccccacactgacacactcctagcctacagcaaacatctgacacagcactgccccaacaccgaaagcctacccacgccgacactccgtgacacccacaacccctgtgactcataccgacccacacacagcacagttgcactggactaaccaaaacctcgaaccatcagaactcacccacgtgcccccacccctcaaatgcctcgcaccacacggaaccgaagagaacagcctcaacaacatgatccacccataacaccacgcacctcacatctctaaacgtcccggtctcgagcacccccatatcacagaaccacgactgaccacaccaccatctcaagcatacta

SEQ ID NO: 545077 - DNA, 287 bp, Homo sapiens
ctcatgcctgtaatcccagcacttgggttttgaggccaaggtgggcagatcacttgatgtggggagtttgagaccagcctggccaacatagtgaaaccctgtctctagttaaaatacaaaaattaggccgggcatggtggctcatgcctgtaatcccagcactttgggaggccgaggcgtgtgggtcacgaggtcaggagatcgagaccatcctggctaacacgatgtagagacagggttactactacacttctctgtcccctgcactttgcaacaagtagaaaccc

SEQ ID NO: 545078 - DNA, 641 bp, Homo sapiens
ttgtgtggtaacctgccaccgagtttgatccgctcttcacccctcgggggggcgtttgtctccttccctcagcttttcttgttgcgccgtcaggtgcaggatcccggctcccccccgcgcccgaggtttctgcatgcaggttctcatccccacctccctctcgttcgcttgccgccccgtttgcgcctctgcgcgcccccgttttgttcggccccacgcccggggcctcgttgtactttcgcagctctcgtggttccttctccacgctctgtggattctccctggaccgcctccgctcgtgggtccttgtgttcttcgtcacctcggcccccgagctgctcagtgcgctcctcgtctcctcacccttgcaagtatgagggctcatgttgtcttcgtcctcgctccccccccgccccgccgcttgttttcttgttttgcctgcgtccggcagcagcgacggaggcgtccgtcccctcttttttttttcccggacgcgtgctccccctatagccagaaataacaaaacaaattaaacaaaaatacataaataaaacaaacaaaatatataaattacaaaataaaaaaacataataaaaataaataaataaactataacaaaataaaaataaaacaaaaaaata

SEQ ID NO: 545079 - DNA, 2103 bp, Homo sapiens
  misc_feature (509)..(509): n is a, c, g, or t
  misc_feature (994)..(994): n is a, c, g, or t
  misc_feature (1961)..(1961): n is a, c, g, or t
aagagtgatggaggtggtggatttggggtttggggtgtgatggtatgtgaggagcatagggtgggttggtttgaggggttgtgagtgatgggcaggagtgttgtgtttgtgctgtgtggtttggtgaggggtgtgtttggatgtgatgtatgggagggggagtggggtggagatggtattgaggtgggaactagtgatggtggggttagtgatgattgtataattgtttgtgtttgaggtggattgagggagtggtggggaggatagagtgatgggggtggggtggtggtgggggggcttgtctggtggtttcgtgttgttttttgtgcggggtggtttgtcttcgttgtcttgtgcgtcggggtgagtggtgtttgtgttaggttttgtttgttgtgtctcgtcgttctggtttgtgtgtgatgtgttggtgtgtgctggggtggggggtggggttgtgtggtggttggtgggtgtgattggtccgccgcgcctgggatgtgagtgtnttttggtgagtggggggctgggctccgactcatgtgtggtgatggttgcattatggtgcgcgctttggctgttgtgttgggtggtgggtgtttggttatggcgtccgatcggctgcctgccgtggtgtttggttgtgtgtgtgtggcgtgcgaccagcctttgagtgttggttgggtgtgtggctggctggaggggaggtggtttgctctcctcaccaggtgtgggttggtgtgcgcccgcgcattgaggtttagctcgagcggcgcgctctgtggttgttgttgtgttttagtatcgtctgcggcgctgcgcgctcgtgctcgtgtgtgttgtgtagtgtgtgtgttttagatcggcgggggcgtggtctggatgcggtgtgggttgtgttgttgggggaggagagcggcgcaacagtctagcgtttggggggtgtggggtgtgagttagtagttgtgttggtgtggctgcttgctactagcangcagtaggttgggtgggtgtgtccctccatctagtctggttgatgggtggatgttggtgtgctgcttcgcccgctgcgcctcggtcgtgggtggggtgggcttctacggcccgcttcggctgtgtgctggttttttcgtgtctcgcgtcggcgggtgggtgttgtgtgtgcttcacggcgccgtcgcgtctcgcgcgtcgccccttcgtcgtggtgttggggggtggtgctcgaccagagcaggttgtaggtgcggctgcgctcggccggggcgtgggggtgtgggggtgtggttgggaccgcccgctcctcgctgcgcgtggtgtgtctgcgctgctcgtcgcgtcgcgcgcggttggggtgggttggtgtttgttgttgtcgcgcggtcgcgctcgtggtgtggtgtttggagatgagagggggggggccgctctcgctgttcgcgcgcgtctggtctctctacagggggaggagtgagctgcgactctagctcgttgtggcggggctgctgttggtgtgttccgccccggcgtgtgagatatcggcgcgccggctcccgtcttgtctggtgcgcgctgcgctcgctcactcgcgcggcgtgtgtgttctcgctgcggtgctgtgttcgaccctatgagatgatcggctgctggtggtgtgggtggggggagatcgcgcgtggtggtgtagttgtctgctgttgctcgtcgagagctgccacgctgcgttcgctgctcttggcggcgctactagtctctctctgtgtgatagatgctccgcctctcgagctcgcggggtgcgcgcgcgacagtgtgtctgctctcgggagtgtgtcgttgatgtgtctgtggtgtgtgtgtgtgtgtgtgtccgccacagcggtgcgtgtgagataaagtcctacacagcgagcgaagaatagagagatgtccgcccatcagcatagcaggggggtggtgaaganggagcccagccctggtgtgtggtttgtggtgtcgtcacaataaaagaaaagacgtgagtaataaagacacgcaaggggtgctctctctcctcacaataaataatataatatatgataatagaataaaataaaagaagaaaaa

SEQ ID NO: 545080 - DNA, 650 bp, Homo sapiens
ggaaaaaatactgctggacgcacagcatgagtctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaactaacacgaataagacacgcaaaaaaaaaaaacaccaacccaacacaca

SEQ ID NO: 545081 - DNA, 870 bp, Homo sapiens
actccgggatgttcgtgcgccgccctgggtgccaccagtgcccccccgtgggccccggctgcccctccctccgtgttttctcctggtcccccgcggtctagtgtgcccccggggttgccgcgtctgtgtgtggttccccaccgggcacacaaggccgaagtccgaggctgccttgggttgggacgaaacaaggttcgttcccgccttcctgtggtacaaattcctggttgaggtcggccgcccactttgtttaaaccctctgctggggcaccgccccgggttataccagggctcctttggcggacacccacctttcgggtgggggacgctttctcccggagcagcccacccattcggggaccccttcacgtcctgtcctggatatgtccgcccgaccactccactccgcgtgggggttctcattcctcaccctcggtgccgcgcaatcctcttggcttgcggtcacggtcacacagcgttccccggttctcctcccctggcacagctttgtgaagaggtgctatcgatatattttctaccccttcatcagctcggccccccccctcttatcacacgagcggtgggcatgaccccgctttgtagccctttttcatctcagcggcccccttatcttacattttcaaagaaatcggtttatccgaaaccaacacggcatcttatagactcctcctcaacacaataagtgaaatatcttgctgggcaccctacgtgttctattttgtatcgatggtccacatgattacctttatcctctgttcctcataaaaccccaactatttttagtggacacgacatccccccatatgttcgcccaaaactttgggacccccctccaaccacaacattaac

SEQ ID NO: 545082 - DNA, 450 bp, Homo sapiens
  misc_feature (43)..(43): n is a, c, g, or t
aagaaggcaagaactagtcttctagagcagggatcccatcccncaggtcatggactggtactggtccatggcctgttagaaaccaggccacacagcaggagatgagtggaaagcaagtgaaacttcatgggtatttacagcaattccccgtcgctcgcattaccacctgagctgtgtctcctgtgagatcagcagcagcattagattctcaaggagcacaaacccttttggaactgtgtgtgagggatctaagttgcgcatttcttatgagaatctaatacctgatgatctgttgttgtctcccaccacccccagatgggaccatctagttgcaggaaaacaagctcaggctcccactgattctacattatagtgagttgtgtaattatttcattatatataacaatgtaataataatagaaataaagtacataataaatgtaaaaaaaa

SEQ ID NO: 545083 - DNA, 280 bp, Homo sapiens
ggagtcaggtggggacttggagaacttttatgtctagccagagaattggatatggaccaatcagcactctggggtctaactccggggttcgggatggaccaattagcactcggtatctagctatctgggtggggactggggaacctttatttctagctaaagatggttaatacaccaatcagcactcggggtctagctcaggttggtaacacaccagtcagcaaccggggtctaactcaagggttggcgcaccaatcagtggtctctgtcttctatctgc

SEQ ID NO: 545084 - DNA, 216 bp, Homo sapiens
tccatcttaggattggggccggttgtggtctgggctggcgctcaatgatcccggcgccttttatatcttcagaaacggtcagttgacgccgctgggccagcccaatccgcagatcaatcccgccacgatcggcaagactgaactcgtctactacaaggcgcgtgacggcctcgatattcccggcttcctcagcaaaccgcctgcagagatttatgg

SEQ ID NO: 545085 - DNA, 882 bp, Homo sapiens
cagcctggctgagctagaggtcccgcccagactgcagaccctccaggctggaggaccagcacgccctccttccctacctggaatggaagtcaaaagccaagctttcatccccaccctctgtgggccacacgtgcacttgcacccaccacacacacacacacacacacacacacacacagacacacagacacatacgcacacacgtgcacacacttacacacgagtatacacacacacacacacacacacacacactagtatatctgagcacgccccatcgcactgtatctcacctatgaaaccattacttccacgacttactatatgctgacagagactatatactactagtatcatcttttctcactctttctcactccacaaccacactcatactccctcacaaaaacacacactcacaacacaaacaagaggacggcagatacccgcctcacaccaactcctcccacatcaagaggagcgccccccagcatcactcgccgcccgcagtacccacagagagccataagagaagaaaaaacagaggcggcaggccactcacatacagcagagagaggagacgtgagcaaccataaacacaacaaacgagagaacgacaaaggcacacgcgcgcataacacacacggcagcgagccaccgcgcaacacacaaccagaggcaatcactaagagcagtcgcgcctctcgtcgtatggatgcaaggtgcatcacaagttacacaaaagcatgcgagaagcggcgcacgcactcatagtgggcacaaaataaagtaaccaccgcaccagaccgcatctcaccgacctcctcaccggggcacgacatatcaagccgctctaacaagtccggctaaccacggggcgat

SEQ ID NO: 545086 - DNA, 183 bp, Homo sapiens
gtagaagagaagaagaaggaggttcctgctgtgccagaaacccttaagaaaagcgaggaatttcgcagagctgaagatcaagcgcctaagaaagaggtttgcccaaaagatgcttcgaaaggcaaggaaggaagcttatcttatgaaaagcaaagcacttattcacaaggattttggccagat

SEQ ID NO: 545087 - DNA, 253 bp, Homo sapiens
ctttctgggtacgccatgcaccagcgtgaaaagaagcgagccggaactagctaaagatgtgatagaactgtggatctgcatgtgcatcacccttccttgttataagacaccaactgcttgaagacataaggatgtatcagttcccccatttgacagatatgaagagcattttaagaggtgcagcctctggaagtggatcaaactagaactcatatgccatactagatatgagtgttatgatacttatgacgtg

SEQ ID NO: 545088 - DNA, 171 bp, Homo sapiens
ctccacccgacggggcgggggcatgatcagaatttgcgcaggatgctgttttgatccaggtgaagctgcagcagaatgtgacgggggaggtaaagcctgtgacttcagtgcccctgtcctgcatgttttttgactgcatctacacacgagatgaaatagactgggggaggc

SEQ ID NO: 545089 - DNA, 195 bp, Homo sapiens
atatccaaaacaaacaaacaaaaaaaacccaacaacaacccataacaaagcaaaacccatcagactgcacttagcattgtctaaattccattctcaaattccaaatatcacagacacccttcacacatggatttataaaaactaccaccctccagcttgtgcaacgttgtaaaaccttatctatacaagaaaacc

SEQ ID NO: 545090 - DNA, 318 bp, Homo sapiens
  misc_feature (14)..(14): n is a, c, g, or t
  misc_feature (35)..(35): n is a, c, g, or t
  misc_feature (41)..(41): n is a, c, g, or t
  misc_feature (59)..(59): n is a, c, g, or t
atccgtgagactgngaaaagatgagcaatgccacnaatacnactccctcacgctttcantcccgtgactaattctgcttgtgtttgaaagaaaggtattcgctttcatcagggcttgggttaaaatgtgtcagtttgcagatcctgaacttgtttgaatttcgcaagccgtggatgtcaggatgagtttttccaggaagcaacagtcagctttgggcttagggttgtaaatagaagctcggcccattcctgtctacctgactccacctactgaggacagcatcatggcacgccttggccttgggctgcagcctaaggg

SEQ ID NO: 545091 - DNA, 599 bp, Homo sapiens
  misc_feature (43)..(43): n is a, c, g, or t
  misc_feature (71)..(71): n is a, c, g, or t
  misc_feature (94)..(94): n is a, c, g, or t
  misc_feature (98)..(98): n is a, c, g, or t
  misc_feature (106)..(106): n is a, c, g, or t
  misc_feature (111)..(111): n is a, c, g, or t
  misc_feature (116)..(116): n is a, c, g, or t
  misc_feature (147)..(147): n is a, c, g, or t
  misc_feature (152)..(152): n is a, c, g, or t
  misc_feature (190)..(190): n is a, c, g, or t
  misc_feature (201)..(202): n is a, c, g, or t
  misc_feature (215)..(215): n is a, c, g, or t
  misc_feature (258)..(260): n is a, c, g, or t
  misc_feature (268)..(268): n is a, c, g, or t
  misc_feature (272)..(272): n is a, c, g, or t
  misc_feature (312)..(312): n is a, c, g, or t
  misc_feature (358)..(358): n is a, c, g, or t
  misc_feature (364)..(365): n is a, c, g, or t
  misc_feature (369)..(369): n is a, c, g, or t
  misc_feature (372)..(373): n is a, c, g, or t
  misc_feature (380)..(380): n is a, c, g, or t
  misc_feature (396)..(396): n is a, c, g, or t
  misc_feature (437)..(437): n is a, c, g, or t
  misc_feature (464)..(464): n is a, c, g, or t
  misc_feature (473)..(473): n is a, c, g, or t
  misc_feature (476)..(476): n is a, c, g, or t
  misc_feature (554)..(554): n is a, c, g, or t
acgtttttatttccttcttgatgtactgcataatagtttaganattacttcattggccttaactccagtanttttctgttaatgcgtggggaanagcntcaaatgnctcancaaanttcttaatagcatacttttcaagtccatganatgtntctccatatgatgtgatctgtttggctaattcaatttntgttgctccanntccgggtacaagntgtttattccttgtaagaattttgtaaagtattaacaatatcnnntactgttntttntatatatatacatcagattgtctgtagagcctcgaagtantatggtagaaatggcgccatcttccttttcatgcttaaaaaccacnacctgnntatntcnnacttctnagaggtaaacactgtnacagtgtcccatttcttcaaggacaggaggtgtcaatctangaagagctgtagcaccaacagttttanaaagtcttnggngatcccattttgagtttagcctcactaacatgatattatatttatttgcataatgaagagccatgtctgccactttgncacctggtactacgacatttggcaccagtatcagcaatagctttg

SEQ ID NO: 545092 - DNA, 189 bp, Homo sapiens
gaaaaggaaaaagacacagagacacagtatagagaaagaaatgaggggacccaggaaccagcgttcagcactactggaaggatcccgccagcctcagagttcccttaggtatttgttgatcatttttgggtgtttctcagacgagtggggactgtggcagggctcatacggactaatacgtggcagacg

SEQ ID NO: 545093 - DNA, 170 bp, Homo sapiens
ggtcgtctagaggtccccagctgaggcaggagaatcgtgaacccaggaggcggaggttgcagtgagtagatatcgtgccgttgcactccagccggggcaacaagagtgaagctctgtctcaaaaaaataaaataaaaaataaataaaaatcagttaagatgctatggaaa

SEQ ID NO: 545094 - DNA, 255 bp, Homo sapiens
  misc_feature (23)..(23): n is a, c, g, or t
tgaaagggctgaggagctcatgngagcctgagttgtcctactctggagcacggtgtcttccttgtaaactgagtgactgtagtactatctgtgcctctgatggtaataaaactgacaagatgtctaatttttttttaagtaggaccaaaggaaaacaagatttagatagtctgactttgcttttgaacaacagacattgcaagtcaaaattgttgtcaaaagcaaagtcagactatctaaatcttgttttccttt

SEQ ID NO: 545095 - DNA, 134 bp, Homo sapiens
taaagcactggactcacctatcaattgctagattgtttagagaaactttaagtgatgataaatctgaatatacttcggctaagtacattataaaattctgtaattactggtccaggatgtggatggttcacgtc

SEQ ID NO: 545096 - DNA, 278 bp, Homo sapiens
  misc_feature (18)..(18): n is a, c, g, or t
  misc_feature (196)..(196): n is a, c, g, or t
  misc_feature (211)..(211): n is a, c, g, or t
aagccactgcgtgcaagntcttcatcctgggtgtatttacaaacggactgaatgtgagtggttaagaagtgaggagctgggtgacaggtgcctgcgaccccggccaagcactgcctcctgcgatcgaaggggcagggggagacagaaagccctcaagggggtgtggagatggagaagccagacccaggtggggggngcatagagctggggntcagggccacggaccccacctggcagtgccctgccttgcccacccacactgtgtcacccccagttgt

SEQ ID NO: 545097 - DNA, 186 bp, Homo sapiens
ataccaaaagttctggctgccaatggccacaactcagactgtgcaagttctccagtagctcatgaagacgtggagatgcgagcagccctgcagttcttgatgcaacacatggtgaagcgaccagtcatgcggtcacccataaacacaacatagggattagctgatctggaacgagcgcaaaccatg

SEQ ID NO: 545098 - DNA, 373 bp, Homo sapiens
gagttggcatagtatttgtaaaaaaaagattaaaaaatatcaggattgtggaaacactagatctgtgtatctctgttttggcatgcttttaatcagtatcttctagcaatggtttttctctgttgatcgaccgtactatcctatctttacgttaactcgatttcttaaggagtatcgtcatcacttctcaaggtgtcttgacttctacacaaagtatatatattcaggactttacaaaatagcagtacacatttaacactagcgaattacaccaaaatgctttactttgagatttgactaatttgcatagcagtacaatgtgtcccgcctaacatacaaatacaccaatgacccagtatcttaattgctactt

SEQ ID NO: 545099 - DNA, 654 bp, Homo sapiens
accgtcctaaggcccaaaatggaacgaagcaaagtgaagaaatgcgatcgaacccccccccaacccatcagcccccaatgtgtgagcgggacgaccgcgcacaaagcggcgcggggtcgcggacgatcttccgtgtgccccgcggcgcggattggacggcaagtgaaaagggggaaggaaaattgattgggaatgcggggcttcgggggaaagatctcggagccgatctccctcccccccaccaccgcgcaacgcgcatcggatgaatgggacttgcttccctcccggcgcggcggccgatgcggtatattagcgcgccactgccggcgccgttgtcccctggtgtgcggcatgatacccggggttttcctgggccggtgtttcctattgttccccccattcctcactgcgttcccctatccctctctctcctttggcattttctcctgtatccgtccccgggctccggtgcccccgcctccggatcctatcgagccttcggtacgtccctcctaccctgccgggtgcccacagcagcagagcaaggagagaaagggggcgccacgcctctggaaagaggcagggggggaaagagtctctctctctgtctgtcagagagagagagctgtccacaacaaagaacgcagaaaacat

SEQ ID NO: 545100 - DNA, 410 bp, Homo sapiens
  misc_feature (348)..(348): n is a, c, g, or t
gggcgatggcggtgacttacgaatggaaccataatgtccacatttcccgaagtgtatttcgggagcctcttctgtccccttctttctaggaccccgagttaaaagaaagaaaaaagaaagactagccaaaggtcggtggatgcccattaatcactaacacagggtcggacccctcaattaaatttgggatgggtatctctggggctccccaattggtcccggtataacccaaatggtctggctggattcccaatttcccacatggcttcaggcggttccttagtcaccctgggctacggtacttcccccaagatggcatctccaggttggcagggtcatgatcccggnaagagggtgatgaggatgaggtcccagcctcatagaccttttcctctgagttccccccacgg

SEQ ID NO: 545101 - DNA, 838 bp, Homo sapiens
tacgggatcccttcacgtactcggacgctcggatccagtgtggacctggactcgaatcctgttgccagctcgcgctctcggcttctgctccggggcttcttccctgcccgcccggggccctgaccgtggcttcttccccggcctgatctgcgcagcccggctgggcgcccagaaggagcatggctggctgctgtgggtgctgcagctgagggcaggggtgacggctgtggctctgtgatgctgctgagctggcaacgcgtggcttgggacttgctcgtgcctgcctccatgcaccggctgagcatgctcagaccattgtcgcctgaatgaatggacgtatctagtggttcttcttatctcacatccaccatcggacttcctctttaacgaaatgccaggtcctggagctgaaagagatagagggagcatgccagatgataggtgactggaggcatcaccacatgattacaccatggttggcccacacacaactattggcaatatacatcatggcgatccacacaaatacccatcggagagaacacatgtgagcacacatcaacttcaaagaggccaccagaacccaaagacattccaatgccccaaggcacacaatggactactagggcacatgggcacatataatcctcccctaagtacatccccatggtatcctttcccctggagggcaccgatcacagggaccttccctttggaagaccatagagacccagcattcacacagccaggccgccatatacacacccaagaattgcacacggatacaaaagcatatgcataggcctaggaaccgctctacagacacatcagagacgaa

SEQ ID NO: 545102 - DNA, 265 bp, Homo sapiens
tcagtcggtccactagtcacggttggtcactgcaactctgcctcctgggtcagcgattctcctgcctcagcttcctgagtaactgggattacaggcgtgtgccaccatgtccggctaatttttgtatttttagtagaggtggggtttcaccatgttggccaggctggtctggaactcctgacctcaaatgatccacccttctcagcatcccaaagtgttgagattacagatgtgagccactgtgtccagccaaccgtggactagt

SEQ ID NO: 545103 - DNA, 110 bp, Homo sapiens
ggaggtgtctgacctaaaatgtggtgacctggaggagagacgcttcaggaattgttactacacatatctgaaattctctggaggctgcatctgaaaggtattctgaaaag

SEQ ID NO: 545104 - DNA, 174 bp, Homo sapiens
cagcagtgagtggagctgctcagggtgccctctcctgcgaccagtctctgaatgttcaaagatgaggcctggcttccgtgctctggctttgtaacttatctggagggaaagcacaatgccttcacgggcagggtatgtccttttcttctcggggtgttgacttgcatcctgtgt

SEQ ID NO: 545105 - DNA, 1055 bp, Homo sapiens
agcgggcgatcgcttcctggctcctcgactcctccgctgtctccctggcacttcttgttcaaatcggccaggatgtctcattggtagaccccttgttcgttgagaccgagctatgtggggctgacacgtacatggctcctcaccgccatggctctgacaatcccggggcactggtggacagacgcgctgaaggtatagagaaacagtctgcacgaagtgacgttagtgcaccattgatgaccaagccatcgtgatgaggagatgctgttcatctatggccatcatataaaagcgaagacacacctgttggggcccgaaccactatatagtaactggtaaacgtggccctagctagttgttggcgcatcttacagcaggagccagatgggccagaggttggcggacttgtccctggcaaagtgcacgacttgcatagcgggtaacttcatgaggacccgaatgtcccatgtaagcgttgtacaatcaaccaaagtaagaagagagctacacacgagaagaactattcgcgggcactatagacgaggagctgggcatgttgggtatcacttgtggccgagtagtagttctagtcatgaaaacctgtcgagacagaatggccttagtttctttgttgtgcttaagttacccggtcgtgatattgtccgcgcgaacttccgtcgggacacaaattcaaacccccatgttagataaactcagaagctttactttccacacgggcttagttctagccatatgactgtgctcctagaaaccagatatttaacggggggctaaaccaccaggaatttatcttgaactttttccccttggaatgttaggttgtgtttgaatccctttgataaaggtcccagattttaaacacgatcgtttgtgactttgtttgttctcacctttttttataccatatcggattcgagcgataccatccccttaaatttacaacaccaacgccttatctaaaaatacttgaccaccttggtcccgcttattttgaagcccccacgttttcggttacaacaggttggcccttcggt

SEQ ID NO: 545106 - DNA, 225 bp, Homo sapiens
gaggattctgcagagatgcatacacacatgaccaattctatcatctgtaggctcattcatttctctaacagcaggtatattaataattttcatgatttgggaaggcttcggtttgaagcgaaaaggtctaatagtagaagaaaccttcataaaactggggggacttatattgattgccccccaacctaacaaaacatttcggagaaaccggtatgcatctcggga

SEQ ID NO: 545107 - DNA, 231 bp, Homo sapiens
  misc_feature (101)..(101): n is a, c, g, or t
ttccccccccccccccccgggtttaaaggggggtttgggtttagggccccccccaaaaccccctccttttgggggggggggggggggccgggggccccccncccccccttttttttggtttgccccccggagcccctttttttttttttttttggggggggcccgggaaattttttccccccttttttcccccccgaaataaaatttttttttcccctttccgggggggga

SEQ ID NO: 545108 - DNA, 480 bp, Homo sapiens
acgacctctagaggacccccccggtaactgtcatccgcacgctggcaaaactcagagagaatgtgttatagccactgaataccatcctggccacagctgatgagctgtacccgctcagtgtattcctgggatattgtcagtccagagagttgggtccaaactcttctttgacaagagagacaactctgactttgacctcctgacagtgagtgagactgccaatgagaccccctcaagatgaaggtaattcctatcaattcaccccgcaacctggccatggaaggcaacctacatcaaccacaactttctcccaacagtgcttgagaatggggaaggaaaagatacaatttccccaaatccaaagccgtatgtggaggccgccatggaataagaatgaaatcgcctctgttgcgtaccgttaccgcaggtggaagcttggagattatattgaccttattgtccgttgtgagcacgatgaca

SEQ ID NO: 545109 - DNA, 384 bp, Homo sapiens
tcccccccagaaatctgcatttactaaatttgtcttaagtccaattgtgtttaaaggtcatgctggtcgggtgtggtggctcacacctatagtcccagcactttgggaggccaaggtgggcagtcacctgaggtcaggagtttgagaccagcctgaccaacatggtgaaaccccatctctactaaaactacaaaaattagctgggcgtggcggcgcatgcctgtagtcccagctacctgggaggctggggcaggagaattgcttgaacccgggaggcggaggttgcagtgagcctcgtgccgaattcggcacgaggacgaaggtagccagacttccggttgtacatctgggcccttagtttttattctgtttattatatgtctc

SEQ ID NO: 545110 - DNA, 326 bp, Homo sapiens
gttgaaaagaaaaattccttactgtctctccttttcgaaccatttaatatgactgttgccaatggttgtatttagtaagatttgtagactctgttttcttttgacacagctgcaaggccaacagctgtgcaaagccacaagttatgctaagtcagcagttatgctatagattacatgacctgtgactgtatcattaactgcttttgttttgcttctgtaagtttgcctataaaaaccacactcagtctttgttcaatggtcagcttttcagatacaaatccactgagccggtgtacatctaaataaatcctcctgtttcccgtgtc

SEQ ID NO: 545111 - DNA, 1260 bp, Homo sapiens
tctcttgggggctttttttcccgggcaaaaaaacaacaccggggcacgggcccctctctggcctgaggacccgggacaacacccaacaccaaacacacacgggggagagtgggcggggggagaggcacgaggaacacagggtctccaagcacgagggtggtccacgtgggccaccgtgggtgggtcccggtggggggctctcagagggaaaagcgctctgtgcccggggggtggggtgcgcacacggaacacaccctgtgggggaacaagagcgccccagaggccagagagggccacgaggggacagggaccaggagaagagaggagagcaaataaacatacggaaaggcgcacgagagggggggacctcgcgagggtgtggccaccagtgggggggcggggggagggagagctgtgcacacaaaaagaagaggcgcctctggagggaggaggttagtggggcccatcgtgagagaaaacgtggccacgaaggagacacacaacaaccgagagagcaaaagagagccaggaacaaaaaaaaccacacaaacccaccgcgggagaggaagaaaaacggagagggacacactgagagacatcgagagagaaaacatgagggaaaattcaccacaagaggcccccccgcggaacaccaacattctccacaagactccgacgggcgacggcggcccacagcatttcccatatccgacacagggctcaacggggtacaagagaaaaacacctgaggcgcaaaccacaccgaagaaatggaggaggagagcaaacaacacataaacaccccacaagaagaaaacagggcacaggacaaaaaaccattcaacaaaaactgtataacagcaaaagcaaacaagaggacaaaccacaaaaaaacaacacaccaaaaccacacagaggagacaataggcaccacaggtaacacacatggggaccccagcaacaaagagacaaaggaacacaacgcgacccccccccacccaagagggccaacaaaagaacgaacccacaacacgaaccacccctactcaccccggaaagaaaacgacgcaagaaaacacgcacagaaaagcccaaaaaaaacaaaaaagggagaaaacgaagaacccaaaaaacacgagaaaaaaaaggagagaaaacaacacagagataacacccggaaagaaagataggcaaaacaggccaaaaaaaacgggaaaaagagaaaaacaagaaacaaaagcgacaagcaaaagaccccca

SEQ ID NO: 545112 - DNA, 171 bp, Homo sapiens
ggcaatgttccaacgcgtcctgcaacagttcgtcagcttgcaacagctgctcagcttgatcggcgagcaacatgaatacctgcaagccaacgcacccgtcgatgcgacggcggtacgctacgaagtgccgggcaaaggcttcttcggtgtgatcgccaacgagagcgtacc

SEQ ID NO: 545113 - DNA, 1211 bp, Homo sapiens
ggtcccgtgagctgcagagtgcccaggtggtcgcgctaaacactgtacctcgtgggaacaaaaccgtgaaggctaattatgtgacaatgtctggatgcagggaacgtgggactgccgtggacgtgggatgatgctgcgctcctgaagttgtgtgcatgaacctgtgaactgtgtcacatgtgaaaccctgggctgctggtgtgtagtctgtgtgcctgatgttgtgtgacctttgcccactggtccagagtgtgtcttggactctggcccacgcgtgagatggagctgcttggtgactgatcccacgtactgcttggtgactggttggaggtgtcccatgatgaagtgacctgttgcgttgcaaaaggctgaacctcggtgtgctggtgtgtccactgtgtgcaatgctggtggaggggaggggtgcgcagcaatgtgcgtgacaaatgacggactctgtcttgagtgttgcgcctcggctccggacccgctcccattcgaactgtgcccttgaaacgtgtgtctcactggtgacggggccatggactgaagggtgaccaaagtgcatagtgtgtcctcccacggagaacgcgccaaagggtagccccgggcgtgtcctgtacggcagcgctcctcgtggacagaacggcgggtgcgggggatgcggcaggggcatgcgaccactcaccaccaactatgcccccgggtgaatgtgccggaggccctagaacaaggtgaagtgcgccgtgcagtgtgcagcgggggcccggcatccagggggggcgctggcactgtccaactaggtaagaaacccagactgctgggtaggggcccagtaaaaattcccatttcttcccttcacccagtctcggtcatatggcttatgacgtatgggctttaacctgggagggtgaccccgaaaccagtagcctgtggccttggtacgtccagggattggcaccattgctatagaaaagcctttggttaactgtgtgccagagaagcttgccatgtcaatgccgtagtttcccgaggtgggcacttagccccattggcctatgagtccgaagccgagtatgacaagcgtaagaggtatataacacgcatgtagaatacaacccttatgtgcacgagtttttgagtaaagatgacatcatacaggaagcagagtaacgagggcggaattgcaaccaagtttggggtttagacag

SEQ ID NO: 545114 - DNA, 236 bp, Homo sapiens
caaagcagggggatcaattgaacccaggagtttgaatccagcctggcaacaaagcaagactcccatctgcacaaaataaaaaataaaaaattacgcaggcattgtggcacgtgcctccagtcccagctacatgggaggctgaggcagtagaactgcctgagccctggaggttaaggctactgcgagccgtgatcatgccactgccctccagtccggatgacagggatcctcatttc

SEQ ID NO: 545115 - DNA, 376 bp, Homo sapiens
ggaggccagtgtcagggtcggagtggcctggcttttagccctgaccgaccattgccatttttggcctcgctaggcccaggaaaggaaggaggccaaccagtcgggttttctggaacaatgggtgtgccagccctcagcatgactttgccaagcatccagacccccaatgcaggaatttggcttaggagcagctttaggtatggattgatgactaagtccagctacttcctgagcttttttcagatttcccaaagccaaagatgaattgtgctgcatcttgcccccatttttaggattttttttcctccgcccctgcagtgattgttaaaggtagttttttttaattaatatttaatccccgttccagcccttgtta

SEQ ID NO: 545116 - DNA, 156 bp, Homo sapiens
ccccgctcacaacatgccagcgtgcatagggactctggcctaaagggagtgtaacctgtgctcggcatgggcggattggttttaaaaaaaaccacgactggcttgtttcaaataccattctctatggtaaataaaattttttcttgggctctgggc

SEQ ID NO: 545117 - DNA, 234 bp, Homo sapiens
cccccgggggggaaaaaaaccccccccttaaaaataattttgggggccccccccccccgggccccttttctttgggggggtgtgggggcttcccccccccaaaggggggccccccctcccccccccttttttggggggggccccccccccccagggggggttttcccccccccccccccccccccccccccccggccccttttttttttaagttggggggggggggggttttta

SEQ ID NO: 545118 - DNA, 251 bp, Homo sapiens
caacactagcaacagcactctatgtacaagcacattgacgctcctgactatcctcaactaggggaccctattacttaccccctatgccttagcggacctctatactatacaaatactttacaggatactaggatactacctataggccagggaatccagccctactctattatagagcctacgtatctatcttatatccagctacttatgcactacacacagtcagagagcctacctggctaccggcccta

SEQ ID NO: 545119 - DNA, 195 bp, Homo sapiens
agcactgctcattatgtttgcagactctctgtgcgcacacggatgacccattcataagttggcattctttcagttggctgtatggaaggaggctccttattagaaacacagcacagagcccttacccggtggcccgtgtcccctacaaaagaaaaccctgagatggccgtctcataatagcaagtacctgtaccc

SEQ ID NO: 545120 - DNA, 1001 bp, Homo sapiens
gctccattatagcattgagggctacaatggccccgaggggtctttcacgtgggctcacgcactttgcgaattagctacacaatgtcggtgagggaaccggtcaccatttaaggatgctcaacagtcccactgtttgttcagtaggcgtggagatcacgcccaactttatagcgagggctcaaatcaagtgaccaatgtgtggtcgggctagacttcggcgtgtaatgtagccaaccggggtggcttgatgtgcgacgactggcttctagtctgggccccccgtggtggcttgtctggagggtcgtccctccgttccactgggatatcctcgtcgttgtgggtgcgtgcacgatttgtagtagaaccccctttccgtgtgatactcttcggggagtgcgtccggtactgattgatgttacttcgatattgccgtagagtgccctcgcccatgcgggcgtattgctaagcgtgtggtccgtgactactctcgcgccttattgttgggggcctctacatagggctccctcggcggattcatgtgctagcagagccatggggcgtctccacgtttggcttttggcgcgtgggcgtcccaagcgtccctttcagcacagcgaacgaggctctcatacaggggcccgtgtgtatgttgtaaaaaaaagactctgaggacaacgtgattgcggaagctttggtatcttgtagtcactcttagacgttgcgtgcccacaagttgtgacatgattttccggcagccccgtcgccatgccagtatccctcttttcatgtcgcttgctccccgaagctcctgtggaaaggaaggccccttattgcagggtagcaactgggacacggagacccacctgaggctcacccttgccctcagcccacctggggagtttaatacctggggaacccccttgcccaagcctccaggttccaaacaattcaattgctttttttttttggtccacaaattaaacctcagctagctctgccca

SEQ ID NO: 545121 - DNA, 1934 bp, Homo sapiens
  misc_feature (655)..(655): n is a, c, g, or t
  misc_feature (1176)..(1176): n is a, c, g, or t
  misc_feature (1186)..(1186): n is a, c, g, or t
  misc_feature (1412)..(1412): n is a, c, g, or t
  misc_feature (1523)..(1523): n is a, c, g, or t
ccttcctcttccgctgctttgtgctgtcgtgcgcttcctgccttgtttggcgcttctctctccgtcgtcctctgtctctgctgcgttctttgcgcgtatcccttcctgcctcctcctctcggcttccgtcgtctctcttcgctggcttcgtcgtgtctgtccgttgactcactggtgtgtcctgccgcgtgctctgttctcttgtctgcttctgaccgtctctcgctcttcctgggtgcgtcgcttggatcgcgctctggctcgctgtgctctcgcgcacgctgtgtagctgcattcgggttcatctctatctcgcgcgtagctgtctggccttctctgcggtatccgcatctgtgtcatctggctctcgctcgtctctctcgctatcctcttcccggcagccgctctggaatcagtgggtagctgtcgtggtcttctactgttgatctcgctggtgagcctgatcgcagttctgattgcatgattcatcggtcttgacctttgttcggtttctgtgatgtgtctcgtactctgtcgctgcgtcctgctggcattgtggttggtgggttctgcgctagtctgttgcagtggctgtgtgggtaccaccaacgtcgaagcagtgacgcagctgaacagaccttggtgacaaccaacncacgttggatgcaaccctcgtggagctcgccgaggagcccccacacgtgtgaccccaaaagcccacgctgtggtcgtaatcccccgccccctctgtctcttgtggccgggcccttaagggtttcaccgagccccttgggttggccctgaattctggctaccgagggccttggcccagccagaagttgtcttctgcggacacccccctggttccgaggccggtcctgggtgatgttctctgcttcccggggttcccagccgcctagccgccccctctagtgtcccgtggggaaccacggtgagaattttcctcagaatctgagccgttggaaggagacgttggtggtgcgcccccaggagagggatcccctgccccctttctttctgggggccaacccgcgttcagagccctgtttaaggttcgccccgtcccccccccccccgtttagagtgttcttcctgctgaggttgtttcgctggggggggaacacacacacgaccacactcggtgatcgcaggagncttatagggncccgcgtgggaggtatgtgcccccctacacactgggaaacacttcgcaggccgctcgtgtgatatgaatagcgtcgcaccccgaggaagtatataaaccgtgggtccaagaaagacgtggcccacagaacagagtagtgcagatgcacgtttgttgtggccacctctagaagagtctgtctttgggagtcctagaccagaagtgtctcgccagacagtctcccgcngccacccagagggtgtgtataaagtaaagaggcccagaggaaagagtgtctcccctgtgtcccctgcgtccaacacacaacaccagacagaaacacctgtgtggccaccanagagtgggagtgagaggtggataagtctccacccagtccaagagttctccgaagtgaagaatagaggtgtttatggtctggcgggtagacgtgtgttgggtcaccgtgaagaatgcaccagacggatggagacgtgtggtggtagtaaccaatgtctaccctggcgtggtccaacagttctgttgggtgctccattgtcctccagaaaaaacgtggccagaaatggtccgggccctgtatatagtccagcacaccccctgggccagacccccgccccctatattaaggcacacatttgtggaagtaaagttctgtagtatcccagggttgaaaaaaaaaataaagaaaacgtcgagcatcgtaaattcgggtcgagaagagtatatcaccgtcctgggtggtttggttgta

SEQ ID NO: 545122 - DNA, 309 bp, Homo sapiens
atggcgacatatcaactaaatgatttcataaacaccaaaaagtagttaaaacttttgtatacataaccaaaaaaaaaaaaaaagaaaacgggtcctttaacagtaattgggcggcggtccatcccccaaaaatacattaagggccttattggggttttaaaaaatttttataaatttaaataaaaaactttggctaataattgtgtgggatccccactttgggcattaaaattccaccttctcataaattcacaccattcaggacctctcattcctaaaattaaagttgacccacaaaattagagaggt

SEQ ID NO: 545123 - DNA, 1349 bp, Homo sapiens
  misc_feature (27)..(27): n is a, c, g, or t
  misc_feature (94)..(94): n is a, c, g, or t
  misc_feature (125)..(125): n is a, c, g, or t
  misc_feature (127)..(127): n is a, c, g, or t
  misc_feature (333)..(333): n is a, c, g, or t
  misc_feature (357)..(357): n is a, c, g, or t
  misc_feature (389)..(389): n is a, c, g, or t
  misc_feature (408)..(408): n is a, c, g, or t
  misc_feature (463)..(463): n is a, c, g, or t
  misc_feature (524)..(524): n is a, c, g, or t
  misc_feature (781)..(781): n is a, c, g, or t
tatatggccggcctcgtcattgttcgntccggaatcacgatatgagtgtctgcctttgccggccggatccgaaccccaaaatcgggctgtctcntttccgctctcggctgctggtgttgcccccncnctccctacgatcgctttgacctgaatggtggttcgtcccacggggccgtggtaccttagccgcgggttcgtctctgtccgcccgtctctttgttagcgctgcgtcgaccctgatctcgcgatggttggttattgtcgacatctccctaggcctcgaacggctcgtgtcttcaattgtggcgccctttgtcgccagcccacgactgnaccgacacgttgatacccttcatncattggagctgccgctgtgggttcaaccgagnacaactgttcgtctcaatncgctctagcgggtgcaccctctcactgaagccacactcccgtcgttttctcctanaagtggcgctctctcacatccgggggggtccttgtttctcccgctactggtgtagctctcngcgagaaacggtcgtggtttctcttcggcgcagaaggaagtgtcgtgtggcggccgcccgctttatactcaaacgtcgctgcggcgcctgttgctgcgctcatacctctcggccctacttttgtgtggtgtcggccttgcttggcgcccactaacatacgggtgtaatgtcggccctccagtacagttcttcctcctttgttatggtctccctcgcctctcctgtttgcaaccgcaccaactcgcctatttcaggcntggtcgcacttcaccaggaggtggttacgatacttcaacacctgcgacgtgcgtcacccacttcagtgtggtctttattataggactacccccgccgacgctcgcctcaattatagtgtcgtcaacgccgaccccgtgctatgttcgccacgttcttatcagcggtgcttggatggttgttaaccctcccgctcctaatggcctcgtacgtgcgtaacgtgccgtagtgtgttgcgccccatgaccgccatttgtcggacggcgcaattgttagggcggcacaccaatctgtgtgtagcgacgccgcagccgaggtcacccgggtagtactctccctacggcttgttgttgggcggtccgatacgtctccttcgctatagattgtgcttctctacttccgccgcagcataaattgttgctccacttagcaactccgccacagcgacgatcattgtaggtgttgagaatcgccgcgcgcgccgaatgcttacgcgcgctctatggagaatgggtgtttgcgtagtagtgattgaaatctccctttttttaaaaggcgtccctcataaca

SEQ ID NO: 545124 - DNA, 445 bp, Homo sapiens
ccgtctctactaaaaatacaaatagctgagcgtggtggcccatgcctgtaatcccagctacttgggatgctgaggcgggagaatagcttgaacccgggaggcagaggttgcagttaggcgagatagtgccattgcactccagcctgggcgacagagtgggactccgtctcaaaaaaaaaaaaaaaaggaacttttacctgatttttaaaaaaatcctaatacgggagtacggtccaaaaggggacatggtttagaatttaagaggggtagtaacagcctgatctggcctggtaagggatgggaggcggtggtcatgggagaagtccatgagattgtgactcggcacggtggcaacatctcgggactgaggggccaggtgacctgttacgcggaacaactcggagcgtgtcttccttctctcgtccaattttagcctcgggccagt

SEQ ID NO: 545125 - DNA, 434 bp, Homo sapiens
ctgttgccagggtgcagtgcaatggtgtgatcatagctcaccacagccttaaattcctgggctcaagtgatcctcctgcctcagcctcccaagtagccgggactacaccaccatgcccagctaatttttaaaaattttttagagatgggggtcttcctatgttgcccagtctggtctcaaactcccagcttcaagaaatcctccctgccgcagcctctgtagctgctgggatgagaggcatagcactgcacccagctatccctgccccctcctgccttttttttttatttttatttttttccagagatggggtttctctatgttgcccaggctggtctggaattcttaagctcaagcaatctgtgcccctcggcctcccaaagtgctgatcacgaggtcaggagattgagaccatcctggccaacaaggtgaaa

SEQ ID NO: 545126 - DNA, 172 bp, Homo sapiens
gcgaaaataataattcgcataagaatatatgataaacttcacatacttaccaacttatgccagatgtttaataaaaaggaaaattgaattaggctcctctagctgaaattccttttaattaattaattaattgagatggagtctcgttctgctgcccaggctggattgcagt

SEQ ID NO: 545127 - DNA, 281 bp, Homo sapiens
aaaagggttttaaaaaggttttgcccggtttttacccccctttgggggtaaaaaggggtttaaagggcaatttttttgggaattccccggtttttgggccaaaatttttcccaggtttggaggtaaggggaaaaaaagcccaaaaaaccccttggtttgtttgaccccccccgccccggtttgcccgggcaaggaaaagctgtttccggaaaaaaagaaggggaaaccccttttttgggaaaagtttttcccccaaaaaaaggaaagggggttttccccca

SEQ ID NO: 545128 - DNA, 616 bp, Homo sapiens
  misc_feature (127)..(127): n is a, c, g, or t
  misc_feature (463)..(463): n is a, c, g, or t
atgatcaggcagtttctgttctcagtgtgttagtgcctgagctgttctgtatgtagaaatcgttcccactctaagaactgtcggggctgtgagtcaaagcttcccagtggctctgctaagcccctcntgttaacatgtggtcactcctgactcactcctgcttcctttgctgtgtatgtttatggcctatgaggttgtatctgttacttctttctctattgtggttttaccagtgtccatgccaaatgttaactgccaagcttggagtgacctaaagcctttttcagagcatggctagatttaattgaggataaggtttctgcaaaccagaattgaaaagccacagtgtcggttgtcacaaaatgacatgctgccattcctggttgctgctcggatgcaatggaaactatgcttgattacatgtgaaaatcttaataaagtctgtgtctcagtagtataggtntcaatatttattaagaggacagtggtctggacaaaacttgttatattctaaaatcaactggtattctggaagcattttcctagaggactggaactgtagaaatttgtctctagagaaatattgtgattatccaatataatgatttttctacca

SEQ ID NO: 545129 - DNA, 151 bp, Homo sapiens
  misc_feature (15)..(15): n is a, c, g, or t
  misc_feature (100)..(100): n is a, c, g, or t
  misc_feature (105)..(105): n is a, c, g, or t
gagaatccaaaaatnattctaagtcattatgttacaataaaaacaatagtagcagcagcagcagcagcagcaacaacagctacgacttgttgatggccgnttganctccaggtgatgtgttaaagggctttccaggcacatttcctttagg

SEQ ID NO: 545130 - DNA, 436 bp, Homo sapiens
gtaccggacttgtactgtatatgccccagttgacagaatcatgcatcagaaagcttttatgtgaaagtggaatctttgattctggagaacatatcaaagctgtgactgtagtttgaaagccagcatcgttcgtacatgcgattgccttcttctaatgagctgcgccagtagtaactgaggtgtggtgattagcgaaaggtcactcctgccgtgccaccttccgtgccgatttccctagctaacacggggccagggaaggcagcgagcgcaataaatcagaacacaggtgcccattaacctgccgtgaggaacggtcagagagccttttccttgtttcattccaaaaaggtggggggagagagcaaggagaacaggtttttggcatattagaaccaagcacggtttgtgttaatcaaggacaccctgaatcagtgca

SEQ ID NO: 545131 - DNA, 271 bp, Homo sapiens
ttagcgaagcatgggaaacaattctgtgtatcagacatagctcgtattcggttctcgattcacgtctggccctgtagttaaatttttattcccgaacttagagaaactggattctttcaaacactgggctccagggtgtacttgcttctcaggaactcctcatactccaaagcaggaaggatataagctgagactacctttgcctcctcgctcatctgtccaacactcatttctcttgtcctttgcactatttccccaccaccccttcagc

SEQ ID NO: 545132 - DNA, 411 bp, Homo sapiens
  misc_feature (239)..(239): n is a, c, g, or t
cctgatcactatgccattttgaacatttttttaagtattccaaatgacttagaaaattctttttccatgactgcatcttactgtacagattgctgcttctgctctctttgtgatataggaataagaggatacacattgatttctttgtgcctgttttatgtgcacacattaggcattgagaatttgaacattttttttgtccatgtatctttggatctttgataaaaaaaaattaaaanaaaattatccctgttcatcataagcacttttacggggtggggggagggagtgttctgctggtctccaattaccaagaattctccaaaaattaattttctgcaggatgattgtacagaatcattgcttatgccatgatagctttctacactgtattacataaataaattaaat

SEQ ID NO: 545133 - DNA, 173 bp, Homo sapiens
gggccggcctcttgaacctctgtgtctctgagcaggtccaggttgccagaaggtccaggtatgccagaaggtccaggtatgccagaaggtccaggtatgccacgacaggtcccggtatgccacgaaggtccaggttgccagaaggtccaggtatgccagaaggtccaggtatg

SEQ ID NO: 545134 - DNA, 601 bp, Homo sapiens
cgcggtggctcacgcctgtaatcccagctctcagggaggctaagaggcgggaggatagcttgagcccaggagttcgagacctgcctgggcaatatagcgagaccccgttctccaaaaaaaaaaaaaaaaaaaaaaaaaaaaaagaggtgtgggggggccggggccccggagaaaagttttaagaaacaaggggggggggggggggcccagggggtaagaggagaaacaggggccaaagaggtgtggtcccctgagaggagaaaccggggccagagagaaaagaggggggggaattctctctcacaccaaataaaaaacgccccggggggaacaccggagaggcgtttggggaaaacaatccaagaggggagagtctgggagaggctccattagggggactctttataaaagcgggagagcccaaggcggaagccggaagaaaatacaagaatattgaccgcgcccccgcgggtcgcgggggggggcccacgccgacggacagcaaagaacgccaacacaaacacgaaaaaaaccaccacaacacaacaaccgacaggaaacgcagcaacaacacaaacaagaacagaaagaacaacaagca

SEQ ID NO: 545135 - DNA, 946 bp, Homo sapiens
ggagatagattgtgatcttccagaggaaggaggaggaggcggctgaagcgtcggacccagcctcagtctctctttcgttttccttttcccttcccccaagcctccgaacacttctctaagatcagccggccgttcctttgagcatcagatgaacccgatctggaacccggcccgatcacctcgaacggacggtgaatctcccgaccgtagagggtaacgcagcccagcgaggaacaaccagtaaggaaaggcccccgcggcaaggaggaacagaaagcacacggaagacagacacaatgggagaaacggtgggatggcccaaagagtgccccgtgacagccaaccatggtgtgttcgaagaagcccaccggtgcccgccggaaaacaggacagacagagaaccacacacggggccatgaacgccactcagggagaaggaggcaagatcacaacagacgacagcatccaaaaccacggaaacaaaaagaggcacgaacaggcacaatacaaatcacaaaggcgccaatcagagacacaaacccacacgagagcgaaacccacacggaacgcagaaaactcaggggcccactccatggcgacgcaagcgaaagcgaggaggttgaacagcacaacgacacagggcacactccaagtcacacccaccggagcacccgcaccagcccacgtaaggactccaatcaaggaagaaataacaacaacggaccaaacacacacgcaaaaagacgagcacgccactagctatcacacaacgacacaccgcgaacaaagatccctcacgaagaccgcgacgagcagcacggaccgagacgcagagacccgaaagaatgacagcacaatcgaaaaaaggagcgaacgaaccccccacgacaaagcagaagcgcacgacagaagacagacaagaacgaccagactacagagacgaaca

SEQ ID NO: 545136 - DNA, 432 bp, Homo sapiens
gcatggagagttctcagccttcggacagctccctcactgacatcacggagacccgcaggcagcctatgcccgaccctgtgcctgactgcccctgtctgacactgttgccgacttggcttggtccaccctggtacatgctgcccaagcctatgcggtcccgagagcctcattttttgctgctcgtgattaaaaccatcgccccttgagtgctcgcatccaacagtgatcagctggaggaccaggctctggcccatgattaagccttacagcagcagtaaagactcctctcccactctggcttctatagtgcaccagctcgaacgtctgctgaacatgcttcggcaagatttgaagaatgaaaaagaagaccaagctcaccttcaggcggatgtgcagcacctgcgagaggaccacctgaggctacaggaggag

SEQ ID NO: 545137 - DNA, 448 bp, Homo sapiens
ttaactagaatgccataaacagtgagttttatcttaatatcagcgggaaagtaagcagattcaaagtagtcagaaaaaagcaaacaaacaaaaaccagagagatagagaacttagaggactctacctgttaattctataattgctggattttcaagttattaccatttgagctctgaagtttccttggtgtaatttgtccatcattttaaaatgcacgcaagaatgggccatggtaggtagccagctggagtcccagaaaacctggcatggcttaatgtttcttattaatctcctgagagcaaagaatatcatataaatcctgttagggaatgttaggagttaaaaccagagttttagatggtggcaaccaccctggtttttaattagcttcttgagcccaccatccagaatgtttatttttgctcttagaatattttcaaaaacaaa

SEQ ID NO: 545138 - DNA, 1526 bp, Homo sapiens
tccctcccccccgggggtatttgggcaaaaaacacccaaagagagagagcccccccccccactgacaaggggagccccccaggggtggggggggggggggcggccccaacccctctctgtgtgcgccccctgtgtggtggagaaaaatatatattctctctcctcacaaacccttgatggaggggcgcccggggagacagggtgggagagcagcccagcgacgagagagacacacaagaacggggggcgcgggagcacgccgggcgcgcctgggggagagcagacctctgagggaccagggcgcacgtgtgtggcctgagcgcgccgtggcggcggtgggcgcgcgcggccacacacccgcgcgcgccctctctgtgtggaaacacgcgcggcgcgcacacacacacaccctctctccccacagagacgggggggggggcgcacaagaggaggagcgacaccacacacacaccacacaccggtcggccgagagagacacacccactctgtcggcgcgagcatatgtgcgcgcgcgtatacacacctctctgtcgtgtgagcgcgtatcaacacagagagcgcgccgctcctgtaggacacgcactctctcgcgcgcaagcgcgcgaccacaacctcaatctcgacgcagaacacgcgctcataggtgaagaagaagacatgctgtagagaagcgacgtccactcacttcctctactcttctcctcctcctcatatcatcgctcctcctcctatacaagaagtagtcgcagactgagcgtcctactcctcctactcgtgcctgagccactaccactacttcccttcctattcatatcatctcctcatcagacggaagacacatatctcgctgtggaggatggttggcacatcatctaccccacacaccctctccttctaattaataacacaacaacgactatgcacaagacaaaatatacttctgtagatagtcgtcgataaacatctcgcacggagtcggtcatcttacttctctgatagttgccaatacccctcacacttctgatcattgttgacggccggcaacctcaacttctttctctcgtgggatagactataacaaacgatagtcgatcactgatcttaatagcatatcatgattgacgcattgtcggccagtagatatacctcacctcacttcaccatactaatcatgctcatgttacctcaccaacgttactcatcttactgctcttctccagtcaccacataacacaactcattcccctccgtcgtagaacactcattcactctcactctcaactacactacaccacaccccacctcataacgttcattctgctacctctactcaccatcactcgcgtccacagcaaccttatactcttatcccaaacacccaaacttcactcacacatctgctcgcagtacttcctatctcatattcaacatccactcacatctcactcccactacaccatactcctctcttattacatcatcacctacctctatatacacaaccc

SEQ ID NO: 545139 - DNA, 566 bp, Homo sapiens
ggaccacccaggcaagagttcgccgcgacacaactcggtgagggcatctgcgaagtcaccaacaggcggccaccactagccgggtgcaggacaacaggcaaccccaaggaacgccccgggggtcacaccacaccgcatggagcaacaacaaggtgcctggcggcatcccaagatagcccaccatagtaccccgaaaggagtcgtccaaaagggcccacaacgggaagaatatccccccggtagacgcacgcaccccccaccgcctcaaatcaagcgggggaaacaagcgctccaggacaactgtgttttggacccaccgggcccatttacagtcagacgtccttaagcagcaggtttcaaagaaatccagggggttcgatgaccccggcccagagagagtgaagatatatctgtaggtgccagcaccttgttttgaatttattcggtgcttcgacgcaccgtatcaaggttgatatgattataatccccgtcccttttgggggaaaaaaaggtagccccccaaccccccgttgtcggccccccctaaataaaaaaaaaaaacaaac

SEQ ID NO: 545140 - DNA, 501 bp, Homo sapiens
tcatgatcaaaaactttcaacaaattagtcatagaaggatcatacctcaacataataaagaccacatgagagaaactcacagctatcatcacactgaatggggaaaggtgaaagcctttcctctaagaactagaacaatatggtcactttcaccagtctcattcaacatagcatgggaagtcctagcctgagcaatcaagcaaaagaaggaaataaacagcatccaaattggaaaagaggaagtcagatttttcctctttgcagataacatgctcttatatatagaaaatcctaaagacttcactaaaaaactcacagaactgattaacaaattcagggaagttgcaggatacgaaaatcaacatacatgagacaagaacttaggtggttaaaaaagtttaaaaatcagtgcacaaaaatcagtagtttacacaaaatatataccaacaacaaactagctgaaaaataatcaagaaaacaatcccatttacaattgctacc

SEQ ID NO: 545141 - DNA, 772 bp, Homo sapiens
agcggggggcgggccgggggcgcgcgctctgcgagctggatgtccaggctgcgggcgctgctgggcctccgggctgctggttcgcgggctcgcgcctgccgcgggtatcaaaacgccacgaccatcgcctggtcgactcgtggacccacctggctgcgttggaccgacagtcggctgaacctcgtggtgggccgcgtgggcactcagagcgtcatggcgtagcacgtgtggttgaagataccttgacccagtgagcgaggcccaaggccgtggcaccgacgagtctcatttacatcggatactatccatgtttcgagctgctggtacccaagcttactgtgaatctgggcctgggctgatgctgtgctactatgctcactccgcaaacgttgtcagtatctcccgccagcgatccattggtccatggagcactcccctacctgtgcctggtcaatcatgtgcgcccgcgaggcaactagagtgggacgagagaattgtgtgcttggatcattgttgctcagatctaccactctagagaagcattccttatgagcatcatcgggacggcgcacatcccaattcattactgtggactcccctaaaaatggtcgctaagacaaacgctccccgcttcttttccccgtagctaattcagggtagaagacctaagatgctcgaggcaaacaactgtgaacgatcgccctttatccctatgtgtgtgacacatggccccggccaagaaggccgcatggaccgactctggcatcgaacc

SEQ ID NO: 545142 - DNA, 146 bp, Homo sapiens
cattggcgtgagggtcgttggggcgagtaggtgacctcacctccgctgaggtgacctgtgtagggtctcatgcagaatgatggaatctgggcctgaaggcggcttggcgtgagtgccacggcattcacttgtatgcgctgcacctg

SEQ ID NO: 545143 - DNA, 324 bp, Homo sapiens
cctccttccctccccactacccttcccttctggtatccatccttctatcgccctgagttcagttgttttaatttttagctccacaaataattggaacatgtgaagtttgtcttcacatggcttatttcacttaacataatgtcctcgagttccatccatgctgttgcacatgacaggatctcattcttttttatggctgaatagtacttcattgtgtatatacaccacattttctttctaagtgtctgttgatggatgcttagtctgcttccagatcttggctattgtgaatagtgctgcaataaagatgggagtatctcttca

SEQ ID NO: 545144 - DNA, 1975 bp, Homo sapiens
cgccgcttcagcttctgctttagcccggagcccgaggccgaagccgaggccgcgcctggcccccggccctgtgagcggctgctgaaccgggtggctgcgctctttcctgtgctccggcccggcggctttcaggcgcactaccgcgatgaggatggggacttggttgccttttccagtgacgaggagctgacgatggcgatgtcatatgtgaaggatgacatcttccgcatttacattaaagagaagaaggagtgtcggagggatcagcgcccctcatgtgcccaggaggtgcccagaaacatggtgcaccccaacgtgatctgtgacggctgtaacgggcccgtggtggggacgcgctacaagtgcagcgtctgccctgactacgacctatgctccgcctgcgagggcaagggcctgcaccgggaacacggcaagctggctttccccagccccattgggcacttctctgagggcttctctcacagccgctggctccggaagctgaaacatgggcactttgggtggcctgcctgggacatgggcacaccggggaactggagcccacgtcctcctcaggcaggggatgcccaccctggccctgccacggaatcagcctctggtccatcggaagatcccagtgtgaatttcctcaagaacgtaggggagagtgtggcggctgccctcagccctctagggattgaagtcgatattgatgtggaacacggaggcaagagaagccgcctgacccccacctctgcaggcagttccagcacagaggagaagtgtagctctcagccaagcagctgctgctctgaccccagcaagccagacagggacgtggagggcacagcacagtctctgacggagcagatgaataagatcgccctggagtcagggggtcagcatgaggaacagatggagtctgataactgttcaggaggagatgatgactggactcatctgtcttcaaaagaggtggacccgtctacaggtgaactgcagtctctacagatgcctgagtctgaagggccaagctctctggatccttcccaggaaggacccacaggactgaaggaagctgcactgtacccacatctgccaccagaagctgacccccggctgattgagtccctctcccagatgctgtccatggggttctctgatgaaggtggctggctcaccaggcttctgcagaccaagaattacgacatcggggctgccctggacaccatccagtattcaaaacacccaccacctttgtgacgatgtttgctcacccattctgtgtcccctttcttgtctcatagtcgtgttgagttagtgtagaaccccagtgcctctaagtcccaatttctcgtcattcttctttcagaatctggggggtggggatgcacaaagccctttagggcagtagaacaagtgacacggggggagttccaagggtgtgagtgcggattctgagaaacactgatcagcttcccatggatgctggctccttccagccaggggaccccgccctggggcagagcgagagactcctcgctggggaggacgtggagaccatactgcatcttatccgtactctccctgcaggattacaccagcagtccagaagagatcttgccaaatggctttctgctttttctttcttttttaatgactataggacactgatatgtaactgattttctgctagaagtttgatatcctctgaatttagctaaaggatcaccagcattcacccggggtggaagaggctgtcctgtagcaattacagctcaggactgtggctaacatctgaggaataaagaagggctgacagaggaactgatgctgttcagagtactgcctatttcataaccactgtagttaccgtttccaaacctgtcagctgcttttaaagttaagaaaatcgctttgtaaccattctatttgtaaacaattttaattaattaaaggtataagcactttaatc

SEQ ID NO: 545145 - DNA, 157 bp, Homo sapiens
ccgggtcgtacatgtaaatatatgtatgcaatcttttgaacctatccatgtcaaagggtatttgaagccaaactgaaaactttcctagactacatgttgatgtatctagaatatccactggacgaggctagagacgaggtaccgacgctcgcaattc

SEQ ID NO: 545146 - DNA, 257 bp, Homo sapiens
  misc_feature (47)..(47): n is a, c, g, or t
gattacctcaacacagagaggcacattgaaaacatgggaagggccangcgcgatggctcatgcctgtaatcctagcattttgggaagctgaggcaggcaggtgattgagcccaggagtttgagaccagcctgggcaacacggcaagaccgtctacaaaaacatacaaaaatttacttggtgtggtggtgcgcatttgtagtcccagctactcaggaggctgaggtgggaagtcagggttttgggggaaattccctac

SEQ ID NO: 545147 - DNA, 198 bp, Homo sapiens
ggtcttctgcacgacatcgatcatgccgatcgcatgcccacgcgttggtggtgctgaatccggaacaggtcctgaagaacgaaaagtatgtgatgaaaatcaccggcgatgatgacgcaggcaaggcgcagctggataactttatcaatcctaagaaagcctacccggttatcgcgacgacctccgagttgatgacta

SEQ ID NO: 545148 - DNA, 442 bp, Homo sapiens
ggatacaggtatactgggcgtagtcttacagtgaggtgtactggtattacacgggacagcgtgttgaaagttggttccttctgcatgtggagatgtgttcagaattgcgggcttctgttgggtgcgtggtctcgttggactgaggggtgaagctgcagaccttcgcggtgagtgttacagttcttagggcggcgcgtctggagttgtcggttcctcccggtgggctcgtagtctcgctggcttcaggagtgaagctgcagaccttcgcggtgagtgttacagctcataaaggcagcgtggacctacagagtgagcagtagcaagatttattgcaaagagcaaaagaacaaagcttccacagcgtggaacgggatcccagcgggttgccactgcgggctggggcagcctgcttttattctcttatctggccccacccacatcc

SEQ ID NO: 545149 - DNA, 566 bp, Homo sapiens
gcacgaggcgtcttacgaatcccacagtttgaagtagttcctgagtagtttcagatttcagggtattgtttgaaagagattttgggtgaaaaatatgacatgatcgagacaatgtacgatatttcaacatggctatgtggaagaagtcaatcctcaaaaaaaggcgttggtcaattagtggttttgaaaggagtataaaatccttacgtctatgtttcaaatcctgttttcatttgttcatccattaccgccgtatttacaaagcagaaaattataaattaatgatcactgtttaagtttattctacaggaaataaaaggggaaaactggaagaagaaaacaagagaattgtaaaaatcttgtattgaattggtttataggttcacatgatatgagtataaatatgagtaacatacatgcgctgtctagtatttaaattatgacgacgttcattttacctaacaagttgttgcgtaaatctataaagtaaattgtcggttttaatatttcaagaatttttgataaacagtgttatcagtttcatcatgataagtgtagcctaaatc

SEQ ID NO: 545150 - DNA, 355 bp, Homo sapiens
gttgtgaactcacaggaatgcagggggctccaggagcctcatgcctcccggctggttggggaagacgtgcagcaggaagtctgaggtatgacccaccgcaatccccagaaggaccacgtggagggagtggcccagcagcagcgagaatctcatgagctctcaaggcaggaacggtgcctgcaaagtgagcagagcgaagaagttgaccctcacccgaggactgcggcggttccacacgtacaccagcatgaacgtgagggcctgccccaggaagaacagcctgcccaggaggcccaggaggatcaaaaggacgcccccgatgagaaacatgaagacgaagacgggcgtgcggccg

SEQ ID NO: 545151 - DNA, 223 bp, Homo sapiens
taaggaccagctccacagatttttctagtgtcaagagctgtctctttggactacagttaattacacgggattagagggtctggggcaacttaagtgaactaagatctatcttggacaccagctatcacccagctcggtaggtttgtcgctctactataatcttccatatttgtacctagacggtggctcttagctgtcttaggtagctcgcttggtgggagct

SEQ ID NO: 545152 - DNA, 215 bp, Homo sapiens
gcggaggtgcatgttttcatgttacttatactaacattagttcttctatcagggtgatcagcataggtcccaattgggtgtgcaggcagtccagttcatatgtttgggcattattcaggtcagcgggtgttgcagcttgacacgctttcttcaatatgcgctggctgcttcttagcgccgtcactcatgggtggacactgaaacattagccgggg

SEQ ID NO: 545153 - DNA, 110 bp, Homo sapiens
tgagctggaactttagcagcagcagcagcagcagcagcagcagcagtacccttagtaccaggtgcttgttagggagaagcttccaggagagctgccttttgaagcttctt

SEQ ID NO: 545154 - DNA, 155 bp, Homo sapiens
gccatgagatgtactgggacttgcctcaccttggcttgaggggacctcgagagcggtcccgtgcgaagcggtgttacacgtggtggtagaagtggagggcgtgtccgggtacttgagtacatagggcatatctacccgtccgcctactcagacct

SEQ ID NO: 545155 - DNA, 473 bp, Homo sapiens
acagaagtataaatctccagccccacttcctaaggaagccgctgttttgattattatttgtgtttgatgttggagtcttactctgttgcccagactagagtgcaatggcatgaacttgctcactgcgacctctgcctcctgggttcaagtgattctcttgcctcagcctcccaagtagctgggattacaggcacacaccaccatgcccagctaatatttgtatttttagtagagacggggtttcaccatgttggccaagctggtctcaaactcttgacattgggtgatctgccctgctttggcctcccaaagtgctggttttacaggtgtgagccaccatgcgtggccatgctttcactcttaaaaatgcttgggtttaagagttggtggacaaaggaaaaaaaaaaaatgccctgatctggatgatgagtttacggccatccggttgagactgttgtaaagtagaaattttc

SEQ ID NO: 545156 - DNA, 213 bp, Homo sapiens
ctacaacctcctattctcaatgaccgcgggaccctgcgagtccctgcggtcatcacgatcccactcaggcagccttctgtcagatctaatcattgctgaaccttaaagtttgccctactccttcagaatctccattatcgctgcttcttcttctttctgatcgatctcgagatgggttccgacgctcgaacttcctgatcgttgttcatggct

SEQ ID NO: 545157 - DNA, 358 bp, Homo sapiens
cgcagacatacacttctcaaactgaggctcgcactctcgcctccagcatgaaagtctctgtgcgcccttctgtgcctgctgctcatagcagccacacttcattccccaagggcttgctcaaccacgtaagggcccctcttcttctccttgagaccacattggcttctctctgaggtatcatggaccattcaagcagacgtggtacccacaggcttgcgtttaacgctacttttccaagataaggggactcagctagaattccagctgtgaacccctacagcttctttcaggaatccagctctgggcacacttagcgcaggtacttccccagctggtttcagcagagtttggggatccg

SEQ ID NO: 545158 - DNA, 271 bp, Homo sapiens
ctgcaacctctgcctcccaggtttaagtgattctcctacctcagcctcctgagtagctgggactacaggcacccaccaccacgcccagctaattttttctattttttagtagagacagggtttcaccatgttggccaggctggtctcgaactcctgacctcaggtaatccacccacctcagcctcccaaagtgctgggattccaggcgtgagccaccacgcccagccactcctttccagaggtaaaaattgagaatagatggaccctatgt

SEQ ID NO: 545159 - DNA, 166 bp, Homo sapiens
ggcaacctggaccttctggcatcctggaccttctggcataccgtggaccttctgggcatacctggagccttctggtcataccgtggaccttctggcatacgtggaccttctggcatacgtggaccttctggcatacctggaccttctggcataccttgaccgagga

SEQ ID NO: 545160 - DNA, 137 bp, Homo sapiens
ccggtcgtctactactactgttccgatgcgacaagacaacggacggggaatttcacactctggggactgacgtggggtggatggaggcaagaagcattacaacaaaccatgctgggttaataaattgcctcattcgc

SEQ ID NO: 545161 - DNA, 211 bp, Homo sapiens
gttagagatcctgaaaaacagcactatatacatgatactataacgttggcctgctttaagctacactctagggcgatgtacacatcggcactgccttacagctacactctaagaaaggttggacagccccctgctgcacagctctggggagtgcttgcccaggatgggagaggcagcatgcttgggctgagccagcatctcccagcaagag

SEQ ID NO: 545162 - DNA, 580 bp, Homo sapiens
gatccagccatgaagaaagccgtttcaaaattgctgatcagttgtcagatggaccattcatgtcctaggacttggtcatcatcattctcctgtgagctacagagcaggctgtcctctgactttgcattagtttaaatatatgttaaaaaaaaaacccacacatggagaatcctttctaaaacaggcgatccaatgaggaagttatgggaggaccgggaatagaaacgccaacatacgtgaatgcttcaggccttagctcaggtgtcctctcctcatcagggtgcacagtcttgatccaaactccctccattcctcacagacatggtgatgagacaagattgacttaacctccatgaacctcagtatcttctttagcatatgctggcatggttgtagcgagtatctaaggtggctccgggcccagagcagactacagtgggttctccagagaaacaaaagcactaggatgtgtgtctgtgtgtgcaagatggactgatttaaaggagttggcttagatgatttgaaaagggcatatcaactctgggaatgtcaaaggttgagagtaggaagagttgaatca

SEQ ID NO: 545163 - DNA, 440 bp, Homo sapiens
cgcttactaggctcgaggtcatccagcctcagtagcttctgtgagctcatccgctaaagccaccctctttcgtctctctagtcactcggtgtcatctggttattcctctaccgtatcttgcatccacactccgcggactattggcgttcaacgctccttctccttatgagcgatgctttctcagattggcccttgacatggccttgttgcctctttcaagtccatattccaactcaagtttgtcatagcggttatctctcacctcgcaatttattggtcactccccatcctttctgtacttcgcctgattacacatatcctgtaggccctggttctgtgtttgttccttctgctggtgctatgtatggggcatgaatccccgcaatagcttcgctgtgctcttctcggcggataacgggtggggaaacaggggggtcgac

SEQ ID NO: 545164 - DNA, 617 bp, Homo sapiens
ggtcgtactagaggatccccccttgacggtgctgacgtctgagagtactctaaggtagcccaggcagaggagtatatagccttatgtgccttgtcgtaggtcagcatcaggataagtaggatagggagagagtatacctataaataggtctcttaataggcttctagaaacagtagaaagataggtttatgtttctaggtacaaacaactgtatttatagttatttaaagaaaaatactacctaaaaggtgatgtaggcctttctatgacgtagcaaacttgaacactaacgtacttataaggcataactatacaagtcttcctgccgtaagtcattgctgtagcctgaaggtaactctagctaatatatttctttgtgtaacttgggagcttgtactaagagaaagtcctagcgtcttttactacactgtggtctgaggataccctggagctaaattaggcccctgacagagtcggactgggaagggggcggcagtgagcaggctgggaacagcagagataactagcagggcacaggtggataccttaccaagttctccaatactccttttatctcttatctaatttctgttaaaaataacttcgttgtcctttac

SEQ ID NO: 545165 - DNA, 837 bp, Homo sapiens
gtctagcatggggcttgtttaccactcctgctgtaagcatgccttcgacacctgtcctgccgacggtctccccaggccgtgtgcggtgagccccgtcacttgcccatgacctgactccgacagtccaccgcgggaggagcatggcatgcgtgtgtacgagcaagctcggcgctcctatccagttctgtcccagtgtgccagctgcccggtgtatcctgagtcgtgcctttaggcaggaggccttgctggatgaagatgaggcactggctggttgaggaagggtcgccctgacgtggagggatggatgctcatgctgatgattgtgccacaagcaaccagcacatgcacaatacaagagtcatacacgggcatgaaggtggggtgcataagctctgccctgtgtgattccactgagggtgcacgggacccgtttgggccaacagcaatggccatgatgaagatgtgcgcgtcaccagcgctctgtcgagagtactccaccccatgatagctacctggtcgactcctggaaggtagagtcttgtgcaagaactaactacgtcgccatgcacgcaccactgtacacaccgtggattcctggaccctcctagaaatactctgatcccactacaggggccgtgcccggagtactgccaggcggacacaggacaggaggcgcacccatacattcgaacggatgacgcaggattacaggctgtgtgtcctggatgactacttacgtcaccaaccgtgtgagtcacgtagcagtggggcaaccaggaggtctctaggggggaccttggcgaagggaaggggccttgctgccagactacggagagg

SEQ ID NO: 545166 - DNA, 255 bp, Homo sapiens
gcttcatacttcttcaaagaaaatatatatacaagatgtcaaatatgacatatgaacaggatgttcaagcatcaatcatcacatggggaaatgcagaatcaaaaccagaatgggataccacccaattcacaccgcattaggcataggttatacatttaaagaaacgaaacacagaagatggctagggcttgctggctcacacattgtaatcctcagcatttatggaggccaatgcaggcaggatcacttagaacc

SEQ ID NO: 545167 - DNA, 108 bp, Homo sapiens
ggagcccatgctggctgcatctgaataggcctaccgtcacccaccgaccagtttaatgtgcttagagcccaagaagatgggatctagcactaggaataaacctttcat

SEQ ID NO: 545168 - DNA, 104 bp, Homo sapiens
tgtaaacgacggcagttaaaactgatggccagttaaactgactggccagtgtaaaactgactggccagtgtaaaactgacggccagtgtaaaactgacggccag

SEQ ID NO: 545169 - DNA, 117 bp, Homo sapiens
  misc_feature (117)..(117): n is a, c, g, or t
tgaaacttagggaaagctcaaacattggacttaacagacaagacttttagtcaaattattattaacaacttcaaaagaataagagggaacccaggggaattatttcttacccaatan

SEQ ID NO: 545170 - DNA, 514 bp, Homo sapiens
  misc_feature (131)..(131): n is a, c, g, or t
  misc_feature (144)..(144): n is a, c, g, or t
  misc_feature (177)..(178): n is a, c, g, or t
  misc_feature (191)..(191): n is a, c, g, or t
  misc_feature (193)..(193): n is a, c, g, or t
  misc_feature (201)..(201): n is a, c, g, or t
  misc_feature (205)..(206): n is a, c, g, or t
  misc_feature (211)..(211): n is a, c, g, or t
  misc_feature (224)..(225): n is a, c, g, or t
  misc_feature (229)..(229): n is a, c, g, or t
  misc_feature (233)..(233): n is a, c, g, or t
  misc_feature (250)..(250): n is a, c, g, or t
  misc_feature (259)..(259): n is a, c, g, or t
ctcgcctgagcagatacacaaagagaaaagatccaaagcataccaatatagaaagtcatcaaaccacaaagaaggcaagagaggaaaaagaaacaaaggatttacaaaaaaaaaaaaaaaaaaaaaaaaanccatttaaaaaangggcccagggaagtccttattggtcggtatttnnttccagggtaatngnttaatttntccnntcaangggtatagggggnnggangggnataaaaaagacctaacnatgggatgnctacaagagactcacttaactttaaggactctcagacggaaggtggaggggagggagaaagacttcccatgcaatgtgggaaacaaaaaatgtctaggggtagctacttttttttcagacaaaacagattttagggaaaaaactgtgcaaaaggagacaaggaacttcattatatggtaggacgggtatccatccatcaggaggggtaaaccagtggtaattatttatggcccccaaaaccagaggccctaacat

SEQ ID NO: 545171 - DNA, 1137 bp, Homo sapiens
  misc_feature (381)..(381): n is a, c, g, or t
  misc_feature (898)..(898): n is a, c, g, or t
ggggggagacacgaggggggggtcacacgcacgcagttgtctgtttgcccccgcgggatgtgggtgtgcgacaccccggattggtgtgacgcgctgcccgccccccggcggggggagtatgcttgggagatcttttgtccgcgctctgggggtgccgcggctgctgtgtggagacgcgttttgcccctgatgaggcgcgcgggggggggcttggcggtcccacggcgcgggtggggtgcttgtggtgaaccggcgggcgcaccccgtcgtgaggggggcgctggttgtccctccggagagccgctgcgtgggccgcgaggaagaagagggggcggcagtggtgcttctccccgcgacgggggtggttggcccacacgcgcnattgtgtcccgcgggcgctgcccgcggggcctctctatggaaacgtctcgtcccgtggggcacacccacggtggaggacacgtgccggtgtcacgggccccgcgagttttcttctcgcgggtgggctgcttcacgaacccgccgtgcggcgccagcatggtgccccacgacaggggggcttcgcaccacgactgtgtgtgggcgcaccaacactgtgcgcactggtgtattggggccgcgcgcactgtcgagatgaatctctgtgggcaaaagatgtgagagcagagagcactctggggcgagatctcacgacgcgctctgtagagggggacccgctctcccagggagtcccacacagtgtggcccctctctgggagggggacagtagagtgtgtgtgccgctgtctaccgcgctagacgctgtcttgggggagacaccgcgggagaagagggcgtccagaggtagggcgctatatgtgtgttgcgcttgtgcgctgtaaagtgtttctctgggggngacacccaaaacaggagttctcccatagaggggcgctgcttcccctctcaaaacccgaggggcaccacaatgtgggagccttttctttacacctaattcacaggagaataccgtgcccttttttttataaagcgctttctattttattttgataaaaaaataagaaaatgcccccccaagcactatgctggtcatgaactgcattccaaatgtggaggtaaccccaaagcaactgtgta

SEQ ID NO: 545172 - DNA, 271 bp, Homo sapiens
taacaaaaacaagtgtatatggaaataaagtcagatggaaaattcatttaattaaattcccgtaatagtcactttatctgataaaagatggccatcttaccccttttcggccccatgtctctcagtaccccatggagctgggctcagtaaataggaattggtatacacgcactgaggcaattagacacgtttggaagactggcaataacctgatctcaccatggccgttaagcgtcatggctctaaattcacagatgctcctttcatcctc

SEQ ID NO: 545173 - DNA, 153 bp, Homo sapiens
catgtgttatatctgcggaccctgcatgggaaaatgtacattatgacaatctttggcaaatggtagcagagcaccctcttctaacaaaattactgttatcatgacaattaaccagccggtggaagaacacatctggattccaacacaagtaaa

SEQ ID NO: 545174 - DNA, 136 bp, Homo sapiens
  misc_feature (15)..(15): n is a, c, g, or t
  misc_feature (121)..(121): n is a, c, g, or t
  misc_feature (126)..(126): n is a, c, g, or t
tccctgtacttcggnttcctcatctgtaagatggagatgatggtactgcctcataggttaatgtgaccgtccagtgacattaagtgggtattcagccacagctgtggcacacagtacagtnatgcnagtacattgc

SEQ ID NO: 545175 - DNA, 290 bp, Homo sapiens
aacgatggtctcagctactggagataacctgagatgagagttgcttgagcatcaggaagtgtgatgctggtatgagacgtgtacatggcgagttgcactatattgtgtatgatgagactgaaactgtgtctcagagacataaaaatgtaaatatcgttggtagggaatcaattttttaggggagctgatagggatgctttatggaaggaaggaatcaaatgtcagtctgcctgaaatgaagaaactacctcatgactgctattttcagagcattcccaggcagtgcgtcg

SEQ ID NO: 545176 - DNA, 335 bp, Homo sapiens
gccggctccaagttatataagcgctcatgcaagactccacaatgcttttagccacagttgcgaatacagattcctgagtggtatccacatctgcaacatgatcaaacgtgaaggtcttgggctcagggttggagtgcagccggagactcgtggaggacagcacagataagcataagttctgctctccatcagctgacccagatctttctgcaggaggacgaattcgcacaaaaactttgatggcatcaccttcattacttggttggttagactgaccatttgtcacgctgcgtaactcagttttgcagccgggtgccatagcgccctcacccctc

SEQ ID NO: 545177 - DNA, 148 bp, Homo sapiens
gttttcaggacccccccggggcccttaaccgggggtgagggtcccctgttgttgggaagggaacccctccttttcccccaactcccaaccctgcctgtgggccgtttaaaagttgggggcccttaataaaaattagtaaatccttcca

SEQ ID NO: 545178 - DNA, 498 bp, Homo sapiens
tgttaatttttaatggccggatgattatataacttgattccagagcaaccaattgctcatttttggacttacaaatggcaggagttcaaagattaacagaagacactggaaacaggcttaatatttgcacttttagtgtaataaaggaaagaacgcccccgcagccaagtaatactggtataataccgctcctgatcttgtgagcaacaacctaaggcatcgggcgtttgaccggttacagaggggaagaaggccatgctgatttaatactattgggactcacatgtcttgattggaggttgaaacaaacttattggctaagcgcctgagttttccatgttttacaggacacattatttatgatttctatcatatacactatcaaattgaactgttcggctgatgaagcacaaagattgggtccctgatggaatgctcatattggagtggaggttggcacatttgccaaaacacgattacatcgccagttgaatacag

SEQ ID NO: 545179 - DNA, 541 bp, Homo sapiens
gcggccgcctactactactactactaaatacgcggccggtcgaccaggctcttgtcgatcaggaaggtgccactctgctgaccaatgcctttgaggcaatagcggctcagcaacgcgtacggcaggttgctcgcccgctccatcgggtagtgcccgctgcgggcttggcaatacctgggtgctgatatccgagccgatcacctcccacggcgtactgcccaggccctcgcagggtcatggccaggctgtagggttcttcgcccgaggagctggccgcgctccacacccggaaggtctttcccggcgcggcgcgggcaatacctgttggcgcaggaagtcgaagtgcttgggttcgcggaagaagtaggtctcgttggtggtcaacaggtcgagggccactgcagctaccagcgttctccttgcccatgatcagtttgaaataggcatcataactgtccagttcgtgatgcttgaggcgcttgaacagacgcacggcgaccagggcccttttcgcggccgacaagctgatcctcgccgccgc

SEQ ID NO: 545180 - DNA, 386 bp, Homo sapiens
  misc_feature (46)..(46): n is a, c, g, or t
  misc_feature (98)..(98): n is a, c, g, or t
  misc_feature (170)..(170): n is a, c, g, or t
atggcaagcaagggcttgcaggaccttaaacaacaggtggaggggnccgcccaggaaaccgtgtcaacggccggaacggcagctcaacaaatggtggnccaggccacaaaggcggggcaaaaaaccatggaccaactggccaagaccacccaggaaaccatcgacaagantgctaaccaggcctctgacaccttttctgggatcgggaaaaaattcggcctccttaaatgacaacagggaaacttgggtcggcctccttaaatgataacagggagacttgggtgaccccccttccaggggccatttagcacagcctggccctgatttccgggcaacccccacctcctcggtttgccccctcattaaaattcacgttccccccctga

SEQ ID NO: 545181 - DNA, 267 bp, Homo sapiens
taaaccccccccccttttcatggccaaaaaaaccggttttctttgggtgcttttccggggggtattccggggaatttgccccccctggggcccctccttgattgcctggccctggtttgccctgcccctccggggttcctccgggggggggttttttactttttgaaaaggggaagggggtttttagtggtttcccccattaaggtttttccgtttgcctgcccccccttttgccttgccccccccccccttaaaatttaacgttga

SEQ ID NO: 545182 - DNA, 584 bp, Homo sapiens
tgggccatctagctgctacgggccaccgctgaatgaggacctgtcagtactagccatcctgcttgtgggtccaatatgggctctcttgtcgagggaggttgaatgtagtacctgttggggtagaagtagaacgggtctgcacgagcgcttccatctggcatgaccgcaaggggaatgtggtccatggcgcagctccagatctggaacgggatggacgtcatggccacgagatgcccagcgggaatcacagcgactagacctagcgacccgagcaggcctccagccaggagtgcatcaacgtgcttctgcagtacggctgccccgacgagtgtgtgtagtatctgttttattggacagcagtctaccgtggtgcaaaaacaagaatgggaaaaatgataggataactcagtatttcaaaaggaaatcgacaaagttcagctaatattagcatgtgtcagtacttttaagtaaactaagtaaatacacaaaatggtgatttttctgaccataagacgtatcccaggtccttctgccaaggtggactttgttagtctaggcctcctggcacattgcccaagtatacc

SEQ ID NO: 545183 - DNA, 107 bp, Homo sapiens
gtacactctagagtatccccgtaacggacaatgcagatccacgcggccagagcagctcccatattgagcacctggctgaagatgcagctctgaggggggaaggatcc

SEQ ID NO: 545184 - DNA, 396 bp, Homo sapiens
catgatgtccgacctctctctttagcttccccggcgtcgaatacccgctctgctatctctgcggtactacactcccacgtacaccttgatacctatccgtctatcgccatgctggccaaagccaggagggtggactgcacctgtgtatggtcggtgttctcaaccaggtcgaaggcctcaaaaatgtcgtgaggctacaccccatactaggtgatggacttaacgaagtagccgatgtactccagatggtgccaatattgggtagactcattgatcttcttcacggagcctggctgcagctaatagataaactcgcaaagaatgatgccatctttgaggccgaccatgaagtagttgccgatgcgacggcctgtcaccccctcgaaccactctctc

SEQ ID NO: 545185 - DNA, 408 bp, Homo sapiens
gcacttctggccttatgatgaaaccttcgacttcagtgcactggcactgctgttacatgatcccgacgcagaacacacaggctcgtgctgtcttggacaagagaatttaacaaccttttggtcatggggactgatagaaggtttgatgaagatgatgattatagctttagatagagcaccttcatggtgccaaaagtttagaccagaggacattcgtgggcttagctgctgggtcagcagagactctccctgtaaacttccgggtgacttcttctatgtcttccccctctatgcagcctgcgaagatgcagatcgacggcaatgtatcaggaacacagaggttggattctgctacagtcaggacttactcctgctaatgtctcctgttgtttacccagactacttcta

SEQ ID NO: 545186 - DNA, 640 bp, Homo sapiens
  misc_feature (24)..(24): n is a, c, g, or t
  misc_feature (61)..(61): n is a, c, g, or t
  misc_feature (81)..(81): n is a, c, g, or t
  misc_feature (144)..(144): n is a, c, g, or t
  misc_feature (150)..(150): n is a, c, g, or t
  misc_feature (189)..(189): n is a, c, g, or t
  misc_feature (203)..(203): n is a, c, g, or t
  misc_feature (207)..(207): n is a, c, g, or t
  misc_feature (230)..(230): n is a, c, g, or t
  misc_feature (249)..(249): n is a, c, g, or t
  misc_feature (293)..(293): n is a, c, g, or t
  misc_feature (314)..(314): n is a, c, g, or t
  misc_feature (332)..(332): n is a, c, g, or t
  misc_feature (388)..(388): n is a, c, g, or t
  misc_feature (397)..(397): n is a, c, g, or t
  misc_feature (446)..(446): n is a, c, g, or t
  misc_feature (451)..(451): n is a, c, g, or t
  misc_feature (470)..(470): n is a, c, g, or t
  misc_feature (545)..(546): n is a, c, g, or t
  misc_feature (572)..(572): n is a, c, g, or t
  misc_feature (634)..(634): n is a, c, g, or t
aggtttggatgtgggcttgggttnttgctgacggaggtagttggtcctgcgtgggggattnggtggtaagggcagcttgancctcaggctgggtggatgctgatgtgctggccccagtctgcccagctcaccagctcactgatntggaancacagctggatctcccgctgggccccctccacggagttnctggcgtggatganattnctgctgatgtggacgctgaagtnaccccttatggttcctggngtagcctcagccgagtcggtgtgtccaatcatggccctcgaggngcggacgacattttacccttnccagaccatggccaccanaggcccagagctcatgtagcggatgagggcagggtagaagggcttcctccgcagtnctggtagtnctcggcaaggacgctctctggtgcctgcagcatcttcatccccattagngtgangttccgttttttaaagtgntggatcacgtccccaacgagccgccgttgcacgccatcgggcttcaccgccaccagggtccgctcccggggtccnngagggccctccttcaaaaggcaagangtcagaggcactgccacctcaccctttcacgtccccacgacccgggtttccagccagacccnaggggt

SEQ ID NO: 545187 - DNA, 948 bp, Homo sapiens
  misc_feature (260)..(260): n is a, c, g, or t
  misc_feature (262)..(262): n is a, c, g, or t
  misc_feature (307)..(307): n is a, c, g, or t
  misc_feature (311)..(311): n is a, c, g, or t
  misc_feature (329)..(329): n is a, c, g, or t
  misc_feature (347)..(347): n is a, c, g, or t
  misc_feature (382)..(382): n is a, c, g, or t
  misc_feature (415)..(415): n is a, c, g, or t
  misc_feature (429)..(429): n is a, c, g, or t
  misc_feature (431)..(431): n is a, c, g, or t
  misc_feature (439)..(439): n is a, c, g, or t
  misc_feature (443)..(443): n is a, c, g, or t
  misc_feature (467)..(467): n is a, c, g, or t
  misc_feature (485)..(485): n is a, c, g, or t
  misc_feature (488)..(488): n is a, c, g, or t
  misc_feature (499)..(499): n is a, c, g, or t
  misc_feature (508)..(509): n is a, c, g, or t
  misc_feature (511)..(511): n is a, c, g, or t
  misc_feature (520)..(520): n is a, c, g, or t
  misc_feature (620)..(620): n is a, c, g, or t
  misc_feature (644)..(644): n is a, c, g, or t
  misc_feature (651)..(652): n is a, c, g, or t
  misc_feature (654)..(654): n is a, c, g, or t
  misc_feature (663)..(663): n is a, c, g, or t
  misc_feature (667)..(667): n is a, c, g, or t
  misc_feature (676)..(676): n is a, c, g, or t
  misc_feature (680)..(680): n is a, c, g, or t
  misc_feature (692)..(692): n is a, c, g, or t
gtgatggtgaacactacatattttatagatggttaagttgagaattaattatgtttatcatggatggctactaataccaagctcatgattgttgcagcctcaacgtcttaggcagtaaaacttgtctgcagcactaaagggggagaaacccttatattttgcaaactgtccattcgttaaatttattgtaacctaataccaaaaactgccgtttttcatattatttccccacctcctactttttttttttttttggctantnggtaaaataaccctttctaaaaaataagcattaagggaatgtttnaaanaatttggcttcatttaantataagccattagtgaantcttacagagatgtactttaagataaaattagctngtgctaagtgtttaaaaacttggtttactggtnaagggggaatggcncnttatattnaacnggggatggtccctccctcagtttntttaaaaaaaagagtcanggnctcacaccaanttgtaggcnngngggagcttngccataggtagatacacgggtcaagaagtatcactttttcaacagcatgacgaagacaaggaacttcattataatgtcacaggtagaggacattattatncaagggatttgccagtcagtgaanaatgacnntnacaattttnctcngcagcttgnggcnaataaattctcntgcataaagtttgtcattcaattatgtgcctggtccctgattggcaagacatatatttttattctatggacgacagcatgactgattttggaagcaaatttcgacacggagaggtacgacggcagtaggcgggggaaaatattcaagaagttggcgtactgtcaaaaatgtacgggttgacattcacagcacggtatgccaaacgtctattagattacttccaaatagttctaaaaaaagggcagctcgacgctcg

SEQ ID NO: 545188 - DNA, 915 bp, Homo sapiens
ggggggatgtccattttggagggatccattttgatcctttgtactctataatgtgaactttcccctgttccaacacttaaaagagaattattagcacatatctaaaagatggaatttttttttttttctcttgagaacagagtctcgctctgtcgccaggctggatttgcacgtggggcgactctgggcctcactgcaacctttgtgcctccgtggggttaaagcgaattctccgtgcctaagcctcttggagttagctgggactactcgtgcattgccaccaggcccggctaattttggatattttcagtagagacagggtttcaccatatggcgccaggatggtctcgatctcttgacctcgtgatccacctgcctcggctcccaaattggctgggattacacgcactgtgccctcctaggaaattatttctcttaagtgaaacttttattctccattctttcttaaggatttgggtacgaaaaatgagtaggcctactcatcaatatcaaacgggcacattgagttccttcccttgagaacagcactttaattttaatttcagggctaatatgcatacctcagaacaagtgcgtgcatattttccttttagacacccctccagtgggtcctcaatattaccccattgttgtgttaccacgggtgactctgagaacatttgggtcggggctcaccatctaactgggcaactcatcagaattcgatttattattggcatgaaccttagacgccgaaacaataaaaggccatgttcttctacagacggtgtaacaaggcccaactttggtgatgggcctgcccctttggccattcggcgcacattggtcgatcgcagcaccaatgggactcttccccatgggggttacgccatacgtctgacagtggcgctaggt

SEQ ID NO: 545189 - DNA, 398 bp, Homo sapiens
tccggagcccttgatgtcctgcaaatgaaggaggaggatgtccttaagttccttgccagcaggcaacccacttaggtggcaccaatcttgcacttcccagcatggcaaccagtcacatctcatacaacaggcaacacagtgcatggccatctcatcatccatcaacatctccaagcaggcaccctgggcagcacagcttctgctggacagctccgtgccaattgtagcccattgacaaaccctgctgcatgtcagatgttatatccatccaggcaatacatggccagcagggcaagtgactgaacgtttgcatgctgccaactggcagccaatcccaattggctggccagcattcacatcctggacacccttcactcaaccagatcccaggacagaca

SEQ ID NO: 545190 - DNA, 130 bp, Homo sapiens
aatgggaccaggggaccttttggtgcagtgggtgtgcctgtaactcattatgatcgtactgaggcagcacttctgcagggtgcatacctgattgttgtattgtacagtactcttatagttaatgtagtga

SEQ ID NO: 545191 - DNA, 331 bp, Homo sapiens
aacgtgcgcctggaggaagaaattgctggttggcggcgaaggcggcccccgcgggaggtcaccgtggggccggacttgcctccgtggggcccggaccttggcttgggcgcagggatccgaggcaccctttttccttcgtgggcccagcggggggtccggaccgaggtaccctcccaggactctccggggtcctgtgagctcccgtcgggtgagcacgtttcccccaaaccctggaatgactgctttaaggtccgcaaggggggccagggccgggacgggggtcggttttggttaactgaaagaacccataaaatcatgttcctccccccca

SEQ ID NO: 545192 - DNA, 1912 bp, Homo sapiens
  misc_feature (1503)..(1503): n is a, c, g, or t
tttgttttttttttttgggaattaggattaacaaatttatatattctttcctagggaaaaagaaaaaaaaaaaccccaaaacaccccgggggtagggaaaaatctggaaggggtaagggcccaaggtgcgtctggcctataagcataacaaaaaggcaaaatctcagtgattccggggctttcccggtggtatttgtggagggtgggatgtgcagcctataacagcaacagcccctcgggggaaaaccggaatctcctttcaaacagagcccagagagaggccccgcgaaacccagcgggaaagaagccaacacgcggcaaaccttctcacagaatttcttctcaagcggagagggtcgccgagaagtgtggcgaggcctctcggcacatctcaagaaactgtggcccaaagagagagacagggacagccgcttctctcccgtggccagagcgtttctccccaaccgggcgcataacacagagggcgccatatttttccccctctatatataacacacagagacatgcgccaggcgcccacaacacacaaccagcgctacacagacgcgggagaagagacacacaccgagagcgctcccctctacaccgcggcgcacgagacccacaaggacaaatcttcctttacggggaaggatgcaccgcagcaaacggcggcgaggagcacactccctgaaggagagccgaccacaagctgtctccccaacacaagaacacgccgcaacaggagcgcccggagcgacgggtgcgcgagacccccaccactaccagcgaacgacacagagcgcccacagagcggcgccgcacaaccatgggggggggcgaccaccccccaccacaaaaatataaacacacaccctccctattgcggcccaacgaaacaggaggactccatggtggcacacaccaaccaaaggcgggggggaggaacagaacatactatcgtacacgacaacgtcgaccagctcagtccacggccggtgggtcaacacaccacagacagactcggacgggatccaccgagtgacgaagcccccctcacaagacagcggcactgacacgaccgatcctccccagacgacaccaacaatgtacggtggcggcccccccaagccatgagcggggcgacatcatcgactcaaacaaccacagccaggccgcgaaagttactccacccaaaaccaaacagcttctccactcacgacccaaacagacgaccgtggggaggtaaaaacaagaatgataatcagctccatcacacacagcaccagcgacctatggtgtggacaccaactaggcagacagactgcagagcagtccagcgaacaaaggagacgagagcgaactcccaccaggaaaagaggacgagacgcgaaaaaccacccccacagcagacaaccgtgtggccacgaaacgaggcgcaccaaccaagctatcgtgccaaccgagggcacacaggcgcccacacaaacactctacgagtgngagcgacacgagcacccacccgaggagggaactcaccccacctcagccacacgctgtgagcagccggacacacgagaagagatatcagggtggacaacaatccactagagcccgcgcagtggtatccacccagggagggagggcacaacaactggacaaaaacggccgggtggcgcgcacagcgggaaaacaccccccggcgtggtgcaacaacccccgcggaggaagcgagacaaaaggagagcgcagcaaactgagcgacatatacacctcccagaatgaagcgcacaagagcagacaacacaacagagcacaacacacacaaccgcagacgtaaacacacagcagaaaaacaaagaaggaacgccgacaacagagccaaccacacggcagggcaataatacacgcc

SEQ ID NO: 545193 - DNA, 491 bp, Homo sapiens
agtgcccattatggccgggggggggaaaaaaaaaaaaaaaaaaaaaaaaaaaatttttgggcggcctgggccctgaaaaagtttttaaaaccattggttggggggcggggcccagataggtatataggtgaacagtgggctcataaagggtggttttccataggaaattccgcggccatggacataggggctgtgggtattctcctcaccaataaaaaaagcgcccggggggcacacgagaggcgtttcggggaagcaaaatctcccaggaggggagcttctcgggggggctcccgataagggggatcttcttatcaacaccggggagtctccagagcgaaggctccgaaataataaaaattttaggccccccgacacgaggtgaagaatacgatgcgagatatatagctgtcaaacaactgacagccaatatcgacgccgacagaggcgatcgcaccaccaggacgggcacacgagagaacgaacaagag

SEQ ID NO: 545194 - DNA, 1493 bp, Homo sapiens
tggccaagaacaaggcgctcatacgagaaggctggtagaaaagggagccaagaagaaagtggttgatccattttctaagaaagatgggtatgatgtgaaagcacctgctatgttcaatactaagaaatacttggcaagacgctcgtcaccatggacccaaggaaccataaatggcattctgatgggtctcaacggggtcggtgtgtttgaaggtgagctcttgcgtgattctgcagatacttggatggacacgcttgcatctttaggaacatacttcagagccttgcagttgacgtcgcatatgcatgttccagtgctttaacagagactggccatgaacttaagctttcccagtggcaataggcagtctgtatcgccgagcacaaataagatgtcgataaccccagtggactccacaaacaagaatggggccagcagcgaaatgtagtgtggagagcttccgagcggtctcggagtgttctacaggtagcattacccgcgagtggggtcttagcatattggccttttgcgggtacctgggtcttcctggatgagtatggtgatatttcaaagcttagagaacacacaacggtcagacctagagtcctaggaatagctgagaatagggagccctccgttaattggccttcaaggccaccccacaatcaggactcacgacacgaaactcgcggaaaggaaatgactgcaatcgggaagagtcattgagccccggagggaatgtgtttggcaggaagcggatagcttgcatcctttggcacccacggaaaaggtttgtggattacaaacctaacagaccttgtggatgtttacccaacgaaccataagggcaaacttgggggcaaacacaacgcgtacgtaacttaggaacaccaacgcggtgattatgtcgccaaagatccattaaatttagtaatggcccctagcattgcagcaacttggtcaaactcggccgtccctctttccgggtagatagaggcacaacagagggtttacataacatagttggccttcgcgagaacggcgaaacgatcccaccaagaggagtatgcgaagaatttggggctggacaacacggagttgccatggcgacacgcttctattgtcgatcggggcatcgccaagcgagaggcgagcacctaaatgcgcacctggcggcctaagacacaaggagcccaacttaggagaggttggtacgaggaaagcaaccgacacagcacgacgtcaaacaacagggcgctgcaacacacgccaaggcgctggcactgggtgcaactaactaagcgcagcgcagcaaacccccagggacgcgcgaaacaggaaagtgcactgcgacgatcaaacaaccaatgatgcgcgcgcaccagtcgagccgaaacgacaacaagtggggcgacggaaagatacaaacacaaacgaatagggagaaccatgccgggaacggaaaagaagcaacagccaagagacaagaacaa

SEQ ID NO: 545195 - DNA, 427 bp, Homo sapiens
  misc_feature (415)..(415): n is a, c, g, or t
agtcgctgacttttcctgaatctgatcaagagaatttggctttataaatatttttcttgtcacattttgttacattgcaacggaacaacagggtgcccttccctccttttgtctgccccaaatgatgaggtagatctgaagtgagtgaggttatggaaacagccagcttttgttttattttttgagttgcaatgcgcctctaagaatcttgcctcgataacaaatgtattgtgaacttttcaccaaaagtaaaaataaagtcactttctaattttatttacgtatttttaggaatttacttattttttttaacctgttgtctcacaaaaatctgggatctaattgtgttttggattacctaatcgggcctacttagcctttggaggggtattttttaaaattttatggagtttantcatggattaaa

SEQ ID NO: 545196 - DNA, 990 bp, Homo sapiens
taacttaaaaatgctttatgggaattatttggataaaaccaaatactgtgtttttaaaacaaatttgggaaataaaacctatctcctgtgaagtcgccccctaaatttccagggctttttccccccaatagggtgacagctggcctcacacgggatattacagggaaatgttgtaagtcctaaggatatcgcccagcaccaggcgcgaaaattttggtgtcagcaaatctccatagcaaggaaggaaaacaggcatgtgggtctcctccaccttctctcccagcctgtaagggctcatagtttgcgggaactcacgtggtcataagcatttgacagccattacaaagctttctctctccagggagggggaagatctccaaacctttagacctttcatcttcaaatttagggcaaaactctcgtggtaaagggtgcttgtgctcccgtgggtgtgggcttcccagaagttcatccccgtggtaatcccagcaccttggggacaactgaggcaggaggactgtttgaccccaggagttagagaaccagccgtggacaaccttgtgcaaaacgcccgcttctttacccagggtataacaggggagataaactgttcttacaactccagttggttagagacgtacaccacggggccttgtgggcgccgatagccggatttccccctgccacagagcttaggtcaagtccccaagcaaatgaccccagaaactcccagtgttgcacaccggtagtttacaccacaatcggcacggtggggcacccggcccctttacttacccacagacaagggcccgaaaatgttggctcgccccgcccggttgtttggccagatggcgccacaaacccttgtgtgtaatcccccgtgttcccccctacattacaaggcgggccattaaaaacttctattttggccacccaagaaagcccacttccgcaaaacaaaaaacgagccgggccctatagaaaatccca

SEQ ID NO: 545197 - DNA, 193 bp, Homo sapiens
ttaggaggtggtattgataagtggggctgagggttttgccttcatgcatgaattgatccattcatgaattaatgggttatcatgggagtgagactggtggttttctaggaagaggaagagagacatgagctagcagacctagccccctcaccttgcgatggcctgtaccacctcctcacctccttaatgataa

SEQ ID NO: 545198 - DNA, 775 bp, Homo sapiens
  misc_feature (373)..(373): n is a, c, g, or t
  misc_feature (383)..(383): n is a, c, g, or t
cagcgcccctcccagcataccactccccagacgctgggaagtaggtccctgctcatcagcgaggcgggacaggcctggagtgctggccagacctgccagggtgccctgtgaagagctactcccacgcctaagcagctgcccgtggacgcaccgcccgagtgtcttccagatcccctggagccgaggacgaggaggaggactatgatgcagtgggctgtgtgatcaacagtttcatcccccagagggtagccagaacatctcgcgaaaggttgactatgagaaacttggtccagcgttctgtggcagtaagtgatggccccgagcttcatgaaacaatgtatgctcacttggacgtggacctcacgaacggatnacacctcgangcgagttgtcgccattttatgcgaccgatcatacgaattatgctcgcggcaattccgtctcactacaagcgcaacgcacaagtgtcggcttgaatatgacacgacaacgtgacacccacacggacgtgcggccgagcattgcccatctcgagcacaagttttctactcccctccagcagcgtacggtaagcaggtctcacagaaaccctttggccagaagcaacagttggcgaccagggctatcactacgtcggtaccgggggagtcccctgagcgatggcaacatcccatttggcccactccagcacaccaatcccgctgaagcacaccagggcatttcagtcattactgctatgaagccccaataagaccaaagggataccagttactac

SEQ ID NO: 545199 - DNA, 663 bp, Homo sapiens
cacgagactaagcgctttagagcatctgtagattgctgagaagtctctcaaggaaccggaagccatgttccaaccagttctttgttccctgtagcatggaaataatttaatcgaattgaacttattgcaaaagcctgctccattcagccagatgaggcactttcagagcaattagtcacaccttacttggaagccacaggatatatttaccagctgcccaggccctatgcagttgaacaagcagccaccccagggacgtgaatttctgactttaaattctctcccctaccgaaatgcttcccacttcctgaaatgactcagcaacatctgcaacaaaacaagtgtttacgtgccgcagtagcatttgcgaaaacactcactacattgacaaggtggtagtttactgctctaccagccgaaatgccagtatcaaaacctgaatgcacggcaacgacagaccagggatttcctgcaggagcaaatgagacgcgttcggccaagcgcatgctctcttgtagtcagcaccctgccccacaggacagcactgcctacacgtttaccggcagccttcccatcggccacaggacgacactcgccattgagtacacacgcacccacacctgtcaactccgtactcaccatacttctgagggcctctggccc

SEQ ID NO: 545200 - DNA, 375 bp, Homo sapiens
  misc_feature (22)..(22): n is a, c, g, or t
  misc_feature (29)..(29): n is a, c, g, or t
acttctaggtagatttcttagnactatgnaatttttttccttcataacagttaatattcttggatcaagctgcaggttttagctatactcattctctctgaaatgaattattaaccagtatcagttttacatttttcatttcttttcatagataaaagtaaattatgttgtcattgtaaaggaccagatgcagttttaaaaaatttttaacattcatggacttaataaaatttcttttctgaaacttttaaacaattttaaaagatcagtggttttttaatcaggacaactttgaaaagatgaacgtgttccagaaaggggatgacttcacattatagtaatatattgagaagatgattgttaagacggtgacaa

SEQ ID NO: 545201 - DNA, 486 bp, Homo sapiens
  misc_feature (115)..(115): n is a, c, g, or t
  misc_feature (401)..(401): n is a, c, g, or t
  misc_feature (423)..(423): n is a, c, g, or t
  misc_feature (467)..(467): n is a, c, g, or t
ttgatttcatatttatgaaacagcttaaatgtcagtttgagtgcaaaacgacaccttctccagcttctcacattagtcctctggctgcttggctgctgctgaacgtttctttctntctttttttttttaaaggcaactcgtgacttccctgcttggctcctttaaggcaggaatggaaagaagaggcatgaatggatggatggatggatggatggatggatggatggacggatggacggtcagatggatggatgcaaagatagatggatgagaccacaattaaatactctcaccagagaggagaaagaaagaaattggagaaaatgaaacaaaaatcaaatagaagaaatattttggttttatagggagttttgatcaattgagaggatcttgagacattnttgtgttatttgccctctatgntttaggttgaaaaagtaaacataaaaatttggaaaataaagatntcaagagataaaaaaaaaa

SEQ ID NO: 545202 - DNA, 149 bp, Homo sapiens
tgctgctgcggtgactctagcaggatcccgtatctctaacattacaatgaacattgatgttgaagaaaaactacagtacatggatattttcaaattgtatctagtgcagctgattttaacaataactactgtgttcctggcaatagtgt

SEQ ID NO: 545203 - DNA, 126 bp, Homo sapiens
gccatgtgaatttcttgaggcaatgggacatgagcaagcatgataccagcagggatctgattcttcctccacctcagctgaaaggcctcatcttgcagcacggcccaccattggaaaccctttgtg

SEQ ID NO: 545204 - DNA, 214 bp, Homo sapiens
tctgatactcaacgtgtgcccatcataccagaaagagctctccttgagctgtaccctgagggctacgtgcaccaaggagagtgatggggtcatccttcatacattacagaagaccgccgcactcgcatccatcgaggcacgcttgtccctccacgctggaacacagggatactgcttagagttacaggcaggtacagggtctaggggaccatga

SEQ ID NO: 545205 - DNA, 193 bp, Homo sapiens
tgtaaacattctttttcaaaattaattaagcccacattcagcttatttccacattcattcttgagtttttttgagaagaatttttgaacccaaaatctcaattagttgattaacatttattctcttcattaccaaaattactcgttgattaaattttgtggatctccagtttgattaaccgcgtttgttgatc

SEQ ID NO: 545206 - DNA, 115 bp, Homo sapiens
caggtcgatgatcggcaggacggtgccgcgcagattgatcacccccttcatatagccgggcgagcgcggcaggggggttgcgggcgtccagccgcggatttcgcgcaccgacatg

SEQ ID NO: 545207 - DNA, 578 bp, Homo sapiens
ggtccatccttacccttactggccctctgtggctgcagactgataccactgtcacatctgcagctgggggcccgtccctcattgtgttccctcctagatggttccttccccattttttttttttttcgagcacggagttctcgcttggttgcccaagctggagtccagagtggcgtgatctctgctcatggcgacctccgcttcccagattcaggcaattctcctgcctcagccttccgagtgggtgggattacaggcatgcaccgccacgcccagctaattttggtatttttagtagagatggggtttcgccatgttggccaggctggtctcgaactcctggcctcaagtgatccgcccaccttggccttacagccactgcgcctggccccaggggagcatttattcaccactcccaggagagctctgaaccactgaaggggaggaagaaatcaccagtgtgactctcagcctccctggggagctgcaccgttcttggcactgaaactccagcccctctcactcacaagtgtggggactgaggctcagaggagggaaggcacccggggcccagctgt

SEQ ID NO: 545208 - DNA, 433 bp, Homo sapiens
aatcaagataaaaaatacttatacagtgatgtgtcacttaatgacagggatatattctgagaaatggtgccgttacgggtttgtccctgtgccaacatcatagaatatacctactgcacacctaggctatatgatgtagtctattgctcctaagctacaaacctgtatagcatgttactgtactgaatactgtaggcaattgtaacagaatggtaaacatttgtgtatctaaacatagaaaaggtacagtaaaaacacagtataaaagtcaaaaaatggtacacttgcaagggcacttaccaggaatggagcttagaggttggaagttgctctgtatgagtcagtgagtgagtggtgagtgaatgtggaggcctaggaaattattctacactactgtagaatttatgaacatttgggctacactaaatttata

SEQ ID NO: 545209 - DNA, 158 bp, Homo sapiens
agcagaaccaggaatacaaaatactagctaggatagtagaagacgcggctaggagcaggagataagccacctaccgccgcctgctggagggagaggatagcccacctagactcagtacaagaaagaaccggtagaccacccgtacaggtagcgtacca

SEQ ID NO: 545210 - DNA, 293 bp, Homo sapiens
  misc_feature (135)..(135): n is a, c, g, or t
  misc_feature (192)..(192): n is a, c, g, or t
  misc_feature (203)..(203): n is a, c, g, or t
  misc_feature (263)..(263): n is a, c, g, or t
gtacgtttcagagaactttttttcctattgtgcaacacgaagcttccagaaccataaaatatcccgtcgataaggaacgaaaatgtcgttgtggttgtttttctgggaaacgtgcttgacaatccttgctgtacntctagacgctcagagaggacacagccgcgtcctccccgtgcctggctgattccatgngctgtggtgcntgattccaggtgctttcacggttggttccctggcgtgggaaactgctctcactttgcagncccaatttcccaaagctcctgttcaatgtt

SEQ ID NO: 545211 - DNA, 440 bp, Homo sapiens
actcgcaggacggacagatggagctctctatagctggagggcaggcggcttactctctggccgaggtctaagggtagtatcgcagaggtctgcaagtctgacccttaaatgcagattttcaatgctcctttgattctaagattatcatctccatccatatgtttgccaatgccattctattttacactcaagatcccagtggtactttactagaaagtaagacatctataatgataccattctgatcttgttcccatattctcaagagggcttgagttaaggtcaacagaaacgggcacgtctttctcccaagcttgggcacatccatcctcatcatgcctctaaccctcattgcgaccattagattttaggaagaacgagcaaaaaggcgcccgaagaagagaaagagaggagagaaaagtgcgagtgggacagtgggg

SEQ ID NO: 545212 - DNA, 207 bp, Homo sapiens
gggaggacctcttggctcaggagctgaagttctgagccaagaggtcctcccaacctaatgtcgaatattccctttgatgaaatgaaggaaagaatactgaaaattgtcactggatttatggtatccctttacatcagcgactattgaattgttacagatcaaggagaaactatcggaacagacaattctcagaggagtagaaagatg

SEQ ID NO: 545213 - DNA, 276 bp, Homo sapiens
gcctatctcataaagtccactaggcatattgagttggagcaatgattcgatgttgacaaagcagctgatcagcaggctcggtaggttcgtcgcgtctacctataaatcttcccactattattagctacatagtatgggtgtgctctttaagctgtacttaggtagctcgtctggttgcgaggggtcttagctttggtcctccttgccatagttgatttctagttgaatgcatgactgcagaaggtgataggggtatagaccattgcatatgcgatg

SEQ ID NO: 545214 - DNA, 465 bp, Homo sapiens
  misc_feature (104)..(104): n is a, c, g, or t
  misc_feature (133)..(133): n is a, c, g, or t
  misc_feature (164)..(164): n is a, c, g, or t
  misc_feature (169)..(169): n is a, c, g, or t
  misc_feature (173)..(173): n is a, c, g, or t
  misc_feature (187)..(187): n is a, c, g, or t
  misc_feature (191)..(191): n is a, c, g, or t
  misc_feature (193)..(193): n is a, c, g, or t
  misc_feature (225)..(225): n is a, c, g, or t
  misc_feature (228)..(228): n is a, c, g, or t
  misc_feature (278)..(278): n is a, c, g, or t
  misc_feature (294)..(295): n is a, c, g, or t
  misc_feature (297)..(297): n is a, c, g, or t
  misc_feature (303)..(303): n is a, c, g, or t
  misc_feature (346)..(347): n is a, c, g, or t
  misc_feature (352)..(352): n is a, c, g, or t
  misc_feature (354)..(354): n is a, c, g, or t
  misc_feature (356)..(356): n is a, c, g, or t
  misc_feature (364)..(364): n is a, c, g, or t
  misc_feature (381)..(381): n is a, c, g, or t
  misc_feature (393)..(393): n is a, c, g, or t
  misc_feature (399)..(399): n is a, c, g, or t
  misc_feature (405)..(405): n is a, c, g, or t
  misc_feature (458)..(458): n is a, c, g, or t
ttcgtgggcagccggcgggctccgaggccgtgagcgcaaagcctcaggccccggctccctcctgagctgcgccgtgccaggccgcccgccgggatgccgtgggncgtgggccggcggtgggcgtgggccgcgntgctcctggctgtcgcagcggtgctgacccnggtcntctngctctggctgggtncgcngngcttcgtcttccagcgcgaagagatagcgcanttngcgcggcagtacgctgggctggaccacgagctggccttctctcgtctgancgtggagctgcggcgnntncacccnagccacgtgctgcccgacgaggagctgcagtgggtgttcgtgnntacgngntncttgatgngcgccattttccttctncacgcctcgctntccgantatgtnctgactgcttcggcaccgccttgggctcccgcggccactgcggggcgctactnggctgac

SEQ ID NO: 545215 - DNA, 111 bp, Homo sapiens
cactctcgcgggggcttaccattttatcccaccgaggtcgaagcggccgtgcgctccatgccgctggttgaggacgtcgccgtcgtcggcctgcccgctgagagcggaacc

SEQ ID NO: 545216 - DNA, 393 bp, Homo sapiens
  misc_feature (5)..(5): n is a, c, g, or t
  misc_feature (243)..(243): n is a, c, g, or t
tcgtncttgaaaggagaagaagctcatggaagtcaaacttggagagctgccgagctggataatgatgcgggatttcacccccagtggcattgcggagcctttcggagagggtatgaccggtattacaacaagtacatcaacgttcggaaaggcagcatctcggggattagcatggtcctggcagcctacgtggttttcagctactgcatttcttacaaggaactcaaacatgagcggcgacgnaagtaccactgaagaggggtcgctggagggcattgcatggccgagcataactgcccgccccactccgacctaggaagaattcaactggctgaaccttcataccctgactgagaactagtgtccaataaaaggtgactggttcacatacca

SEQ ID NO: 545217 - DNA, 1359 bp, Homo sapiens
  misc_feature (322)..(322): n is a, c, g, or t
  misc_feature (396)..(396): n is a, c, g, or t
  misc_feature (693)..(693): n is a, c, g, or t
ggatcactttccaagggagcgatactaaggcagacgtgagcttctttgaaagatgggagggtcaggaggtggagagcgagaggaggatcccatctcacacaagacactgtccacagtgaggcagaggcagactttttccatttagtccatgaacctcctatgagagtgtcagttgctccaccggtcctacacggaaccgtgatcaggaaaatatttgggacaggggttcatgttgcatacattatgctagtcgatgcttgaagagcgaagagaagcacgttatgcgctagcaaggtggtggtagacgagacttttgtgctcnattctcggctcaatcaatcgagtggattctgtggcgaggtctttgtagaaaacataccttttcgaaccacgaantattagtgggcgaaggtgtttactggtaaatcgggcggtgcaaaatcggataactcgtagtagacagtttggttgtgagacaacggcaccaagatacgtacctcaagttcaataatcaagggtttcgcagggtcatattctcttccgcaaccattgggttgataaacttgcacggcataggacctgggattacctcgtttcctccctcgcattccacaccaccaaccgcacagagagaaggtgggggccggtactaagatatgctcgcagagtggaagacgttcgaaggttgaacangagaaataacaaatagcttggacagacactagtaacttagagacgtggaggtgaattgggtttgtgaggagtttagataggactcagatgggggcacccactgttgctaactggggttgaatcacgaacactgaatggaaagggctgaacgtgggtttggaaatagacagtttttaaaatatttggggcaatggggggggagtcggtgtggcgaatgggaggtgcgttcggcgtggcacggaacgcgggcaataggaaaaaaccgggcgaccacggaaaaagggactcacgggtgcggccccactacatggtaactcaacgttgccacacttgagggcacgaaacaagaaagaagcgggtcagaccaagccccacccgggagtcgggcgccacttaggtgacttcttaaccagaaagaccacactaggttggaacggttcaaagctaaaaacatacactggaacagagaaccaataccagccaccaggggcagtttcaccaccacaggagagcacaaaaaactatcaacggcttacaaaacacacaaatcacagtaggagccaaacagacagaagcagacagtcggccttcgaacagagtccctaccgggctcgttaccgcgagaggaaactaaaccgaggacgacacagaggaccagggacacag

SEQ ID NO: 545218 - DNA, 190 bp, Homo sapiens
ctgtaatggtctcagacaatgagctccaggaaatgtccaatcagggaagtaagtacgtcaataaggaaattcaagatgtttacaaatatgcgggtgtgtttcactttaagtgaaccaaaggtagagctccaagaataaaaaatatttaagaaaagagccaataatagataagaggttgcgttcaaatcta

SEQ ID NO: 545219 - DNA, 421 bp, Homo sapiens
  misc_feature (179)..(179): n is a, c, g, or t
  misc_feature (342)..(342): n is a, c, g, or t
  misc_feature (397)..(397): n is a, c, g, or t
  misc_feature (418)..(418): n is a, c, g, or t
gaaacatttggaaacaatttaaaaaaaaaccctcacagatgaaacctaccccatacccctagaaatatcaaaaaaatttaagagaaagatacggccataaatgtgtaaaaacatgtaaatactggccgggcacggtaagcctcacaactgtaaattcccagcactttgggaggcccaanacgggtgggtggatcacgaggtcaggcgtcaagatcggcccggcccaaaatggtgaaacctcatctctactaaaagtacacaaaaaattagcccaggcgtggtggtgggcgcctgcaatctcagctacttgggaggctgaggcaggagaactgcttaaacccnggaggcggaggatgtagtgagtcgagatcgcgcccctgcactactccagcctggngcgggagtgaaatccgtctcngga

SEQ ID NO: 545220 - DNA, 1077 bp, Homo sapiens
  misc_feature (1077)..(1077): n is a, c, g, or t
gacgcggtgggctagttctagatcgcgagcggccgtcctttagtgtgtgtatggttatcatttgttagaggtagtgatagcatggggagggataagacaagaagtcaaaatgaaagaacactaagggagacgaaaaaagggacgagggtttgccagaccacccccatcgaccagacacccgcccacacaccccacaacacaacccacccgcacgccccaccaacccccaacgccccacacacccactcgcccaacccacacacgcgagcacccgccgccaacgacacaccaaccccaaacaaaccaacaagacccacacacccacaacccacacacaacacggcaccacccgaacaccaccaccaaccccccacaacccaaccagaccacgcccacccacccacaccgcgcaccaaccacaacaaccaactccacggcacgcccaccccgtaaagcagctgaactcaaccacaccgcccgacaccgccaccaaagccagccacaacagccccccccaacaccaccacccacaaacaacccacgccacacaacgacccacccaccacaccacaccaactacaccaacacacagcctccagacacactgcccaccacccagcaagcccacgccctacatcaacccacaccacacacccacaccaccgcacaccccacaccacccccacccacgccccatcaccagccacacacaaacacaccacgcaccacccgccacccaccactggacccaccaaaacaccacacacaccacacctcaacacaccgcacggacagcacccgaccacacacacccaccagcgagccgctaacacacggacagacaaccacaagcaacaaacccacaccacagcagacgcaccacaagcacacaaccacacacaccaacgacccacacaaacaaccggcacacacacgcaacgacacacaccagcagcaaccacacacaacccagcaacccaccaccgcaccacccacaagcagacacacgaaacacaccccaaccacacacccagagccaccccccacacccacagcccgatcctacccccgcccgtn

SEQ ID NO: 545221 - DNA, 172 bp, Homo sapiens
gctgatcaggcatgcgtcagggcccattaaaagggagtgcttggtcgccttagggtggagttggtacggggaggtttcccatgcagttaatgttgaagccaggttctgagggatgagtaggagttatgacagtgcagaagaagcaactcgcagcaaaagctgtaagtctaaa

SEQ ID NO: 545222 - DNA, 237 bp, Homo sapiens
tcacgcggtagagtcgtcctaggtgagtgaacacagacccgtgtacctcataaagattaaacataaaagcacaaaaatggcgcaacagacaggattggcttcagacaggcaggtggcatggacgtctgacttgcagaccagtatgtccgtctccccctacgttgatgtgttctgacgatttcacagccttaactctgggaggcccgtgcagctggatgttggccgtgcccattggcc

SEQ ID NO: 545223 - DNA, 385 bp, Homo sapiens
actcagagatccgttggggctttggtttccttcgcttctttccttcgggagtggctaccttcccttatgtaccacttctcccctcatcatggctcttaaagcatcaggcctctgcctctagcgggggtggggctcaggggggtctcctcagcctccctcacagtcctctcagatttagttcctatcagggagggtgccattctctgcagggttcccaattcaaactcctacaagagaaaggcggataggccagctatctttggctcggaataggtctcggggcaagcggtggattcgcttccttccaggcagggggtcatacccggaaggaatgcagggtgctgacccaggggtcagagtcagtcctccttggaatggagccaag

SEQ ID NO: 545224 - DNA, 769 bp, Homo sapiens
agcgtatttgcacattcacttactgccatttcctgccctatgaggagttagatggtatgtgttcttcaagaaatatccagcacaacgatacagacgcaagtgacgagaagcgaagagaaagaggagggcttagagaacacgtagagcgcacaatggactagaaatggcagagacccggaaagcatggaaatggagaagcacaagatgagagcacagaaggaaggagaagaacctaacctcagaagacaggtaaatgatgagcaaatgaaatacgagagaacacaaacaagccagagcaccgccatgaacaatcaccagtccaagcggcgcacacacgcaagtgcaccagaccacgtacagcagactacagacaagcaagcatgcagcgttagtaataaccaaaaagaccagttagacacaggaacataacaaacacacaacgaacacaggaaggcgaaagaaacgaaaaaatactacaagtagtcgttgaaacagaaaaagcaagacaattaccaaaaagagccagagcacgcgaaggggcgtacaccgcacgagatccaacgttcgggacacaaagtaagtacctcggtagacagataacatagtgtcagcaaacccacatgcataacgcagcaacaaacagggaccaaccaagtgtgacgaggcgaagaagaagaacacgacaaatagaacacaaccacgagagatacagaacgctgagcgaacacaaatccagacataaagtgagaacgacggaacactcagccca

SEQ ID NO: 545225 - DNA, 405 bp, Homo sapiens
acagaatgctcaagccactgcactgccagatgaagatgatgatctgtgaggagcatgaagctggagcccagcgtcagaagtctagttttataggcaactgtcctgtgatgtggtgcagcgtgtttgccactctattatatagctgagcagaacatgtgcttaatctttttgggatgcagaaggagatgaatgggcttcggagtgaatgtggcagttcagaaaacaattcctttatattttggacctgcgtctttagctgtttggtactgcaaaatattctaccctcaagtttcaaatcttaagttaagactgctacagtctcgtcacaaaattcagtggtaaatcttgttactgtcattcccatacctttttcgtttagatcataataaagttatgtttcaaata

SEQ ID NO: 545226 - DNA, 866 bp, Homo sapiens
  misc_feature (437)..(437): n is a, c, g, or t
gccaggacacaccggccacgtctgcttcttggctgcagtccaactgccagatggcttcaacctgctctgcccaaccccagcacctcccccagatcacaggccccgataagctgcaatcactgagcacgggactccccttggcaactcgaagctccgtccctgccaggcctaaaatgctggttatctagtggaggttgatggtcgtatgagattacttcactgacttctatgcctaggttgtgaggtgcgtgaccatgtctagacgatgtgagactgctagtggtcgaagactatccgcacaaagctagctcctcctgtggagtgtttgtgacccctggtctgccggtggacccaagggagctcgcccgaccacccttgtcttcagcctgacttgtctcgtccctaatccgacacgcttacttcgcatcgacgcagtnatcccatcctgggggcatcaactatgtgcccttgcttggtctctgttctagtcttcgtgactcatgccattcctgattgggagacgacccaacttggaccaaatcaagagttcgaaggagttcttcctcggaccctctggtctgccccggatgcatttcctagttcgtgcatcgttggtgagtggcgtacttgttgggctgactcaggtactctgaacgccctggcgctggtctgctcaggtagatcccggtggagtctggatccccaccgggtgctggtgagtggctccatgtgtctgactatttggacgggtttctggagggcaggcacgaaggctgggggaaattcccatggtcacagtattttatgttccttttcacgactgttgtacctttccaggccctattttgccgtgaccctggtccctg

SEQ ID NO: 545227 - DNA, 635 bp, Homo sapiens
agaacctgcgttctctggtttccttcctgagtctggcacagacggggctattgtagttactgatcaagtccttggagtcagccttgcctggctctccttgtagcatattcagtcctacagactctctggctgccctttcagtgaacaagtatgctgtgcaattcaacctcttggacttgtctgctcctaagcctttgtttgctggccctgactattgtaagaggtgaaacattacctagtttcgtttgagaatgaccattttcctaatgtgtacaaccatctctctcaccacttttattagtaggactaacattcatatccgttataaatggttgagcaatttgaatgacttaacacagtgtcattatcttgctatataaactggtaacctcacaactgccacacttcatcaccatatgaagtattatcgcagctagctaagcggatgctgtatcaactagtaacttcgccattaaggattattttatagcatgaatttaagactatttactcaaatgatatcctactcgttgtattcactttgttcttagagttgctgacatgaatatttcagtgctgcttaattttgttctgaattcatgtttctgcttatactcctcgttggtataaactta

SEQ ID NO: 545228 - DNA, 205 bp, Homo sapiens
gtattcgacttagttgaaagtataggactatgataacagcagagacaagatgccgggtagaaacttttttaatttttttggaatggtaatcatgggtccgataactgttatagttgtttcttgatttttttctctgttgtatctctcattctgtctattgagtttcaccctattgacgttttttactgtagttattgtaactttc

SEQ ID NO: 545229 - DNA, 992 bp, Homo sapiens
ggaagtagtgagtatatcttagtcaaaagaattgtggagcttttaaaaagctgcagttcagtcctgctttggggaatgtgctatgaaagcatgctgccaaaataagctcatttattttctttcaatcccactcagtgctcaagtcacctatattctggttccctttttttttttttccacgtggtggctatattttgggttcccctttaatagtttgggaaaacgatggattttccagggcagaaacccgtgtgtttgtgtcccctttgcaaaggaggtcgatagggtctctaaactgtggtcaacggtcctttcccttgtaaggggtgggactcctctctataatggggggataatcgcaaaaactttccatgtaatacctgtagaaggtggccgacgacaagtgacactctcacacgtcgggccttttaattaaccacttgggtcatttttttgttctttggccaccttgtcaagatggttgggcccaggcctaaatttcaaggattattcccccaaaaaagaaggggcgcccaacgtgggggtcaccagcgtttttcccaatggaggcattaacctaatctctcttggccatggatgggtgaacgcctctaataatagggtcctctttggatgacctgtgttgccttacccaacaattaggagaatcagcgacaggttggtttcaagacaatctcacatagctaatgagactttacccctcagtggggtgggtatacctaataacgtgaccgtgtgttgtcgctataacagcgactaggtaggatatcgtggatagttcgatcatagagcacagaggggcgaacactcttttatcagaaccaggggacacgttttccattttcaacgcacgcttattctcttgagaaacttccttttttggtggagacacctcacaagggccgggtgggtgttgtccccaccctcctggtgtgacttcttttttattaacaccacatgttgtggctcca

SEQ ID NO: 545230 - DNA, 106 bp, Homo sapiens
tactcactttcctatctggcgactgtcactggttcagtgggcagcagagcacaggcagttacttcagaggacactgaacactatgatctgattgccattcttgctg

SEQ ID NO: 545231 - DNA, 366 bp, Homo sapiens
  misc_feature (35)..(35): n is a, c, g, or t
  misc_feature (247)..(247): n is a, c, g, or t
cgaaggcagagttcaacagggatcttttgtaaatnttcaacaagggccacaggagccatttattgaatttatccatcagttaacccaggcaattaagagcacacatggaacatcgaccattccacgggtatctcgtataaccctcaaggacaagccatagtggaacgtgcccattccacgcttaaaaatatgctttaaaaaaagggggaatatgaataaggaccctacaacactactagcacaagtnttattcacccttaatttcttaaatttagataataaatttcaatcagccctagaaaagcactttgctaaaacctccccaggtacaaggcttcagtgttttgggaaggtgttaatagtatc

SEQ ID NO: 545232 - DNA, 521 bp, Homo sapiens
  misc_feature (78)..(78): n is a, c, g, or t
  misc_feature (94)..(94): n is a, c, g, or t
  misc_feature (99)..(99): n is a, c, g, or t
  misc_feature (166)..(166): n is a, c, g, or t
  misc_feature (194)..(194): n is a, c, g, or t
  misc_feature (214)..(214): n is a, c, g, or t
  misc_feature (231)..(232): n is a, c, g, or t
  misc_feature (256)..(256): n is a, c, g, or t
  misc_feature (276)..(276): n is a, c, g, or t
  misc_feature (281)..(281): n is a, c, g, or t
  misc_feature (284)..(284): n is a, c, g, or t
  misc_feature (297)..(297): n is a, c, g, or t
  misc_feature (319)..(319): n is a, c, g, or t
  misc_feature (376)..(376): n is a, c, g, or t
  misc_feature (427)..(427): n is a, c, g, or t
  misc_feature (436)..(436): n is a, c, g, or t
  misc_feature (449)..(449): n is a, c, g, or t
  misc_feature (475)..(475): n is a, c, g, or t
  misc_feature (491)..(491): n is a, c, g, or t
  misc_feature (503)..(503): n is a, c, g, or t
atgcacgttgaatgatcgatattacatgtgactcttgatgagtgcaggagctagctgagattgttctgtccagatgtnatgtacccggacaggngacantgagcaggtggtccttctgccataggcaggccagctgttggtccagaaccgtggagcccatgggacntgtgctgagtacgtagttcatgctgacntcccaaatcttggaagtttngtccccataatcagagnncacatgggtgctgtcgagactccnactaattgtgtaaatcccancgtcntgngccttgcttccgnccagcgcgcacaccttctcccnagtcttcccgtcatagatgtatctcgggccgtcagcactggctgtggcaaatctgtncccatcaggagagaatcgcacacagttgacaaagcggctgtggtcgccaantgtgaactngaacttgaatggnggtccctcaaagaatgcgcgcagtantcatcgcttcccgtgnccagccggtatngccggctctgctagaatt

SEQ ID NO: 545233 - DNA, 1462 bp, Homo sapiens
tcttctgtgtgatgtgcctcgtgctttgttatactctttctactttttctgtgctttttgtgccttgttggggtctggggtggtctgccattattcggacttcttgtttctatcgcttgctttcttgttcttggaggttgtctctctgtttctctgcttgcttatgtctcttgtttgctatggtgttggttgtcctcgcctgctggtcgcttcggtcgtcccgagtgccgtttacgtggttctgggctcgcggtcggctcccatcttccctttttttgtccctctgttatgtttcttggtgtgctttgtttgttcatttgtttctcgtctgggctgtgctttattcgatgtgtcgtgcgttttgtggttctccttttgggtcgctgactggggtgatctggattgtcgtcaggggtggtgtccgggcctttgtttggttcctgttgtattattctccttgttgtttggtgttctggtactttgttcccgtgtgggtctgattggtgtcttgcgttgtatgcttcttttgtggaggcctgtctcggtggttccttatgtgtcgtccgtgctttttcgctttcgtgttcccttttcgtttggacgtgttcttggtctgtttgtgtttagctgtagcccattggcttgtggttgttgattgacgctgctgggggccactgggtctgtgtgttgcccgttgggttatctttcgtcgcgtttgggctgctgcttagcttctttccgttctctcttgagttgttcagtggccggtgatgccccttgtttcaatctcccctcgtgcaattgtttcggtgggtggtgtctgtattcctgtttttgtggttcttccatgtcgtgtcctcgggtctctgttcgtgccttggtcagcacctgctgctgggcgtgttggtatcccttgttccgtctgtgtggcccgtcgcccgcaggccctaattgcgggcttttattcctcccggtggtcttgttcatgtgtccctcgccagcttcttctccctttctgcccttcacacggtctctggatgatgttcgttgtacttcttccatctccctctggtgttctcggctactgtacgccagccgttctcgtctgtttgctgcgttgaacgggatgtgcgcgccggagtcctcagatggtcatgtggaatgcgagacgggtgccgtggcgtgttcgtggtgcgacgggcacactgtgccccgaccgctccatcccctcctcctccctaggaatgcatacagcctagccttgctccttcttgtcttgtgttctaaagttttcttgtgccagagtagatgtagctctattgtacagtaaagaatacttgaaaaattaattgtatgaatgtatgagaagacagagtctcctagttttgtatcttgtcgtatggactcgccatgagttccaccagaaacgccactctagttttggtctctgtgacatttgaaa

SEQ ID NO: 545234 - DNA, 241 bp, Homo sapiens
tatcgcctaaggtatcgcagcatcgcttattagacagaattcatctcttcccctttaaagtagttctctggccatacagactctttagatattcagcaaaactaaagaacaacatccttgatattatcttatcagaggaattgtatagtactgaacaggtaagtcatccctctagccatgagattagatctacttcttccatgcgtgatgtgtcgtcatctccagttaggggtaaggctga

SEQ ID NO: 545235 - DNA, 936 bp, Homo sapiens
tactaagttagtctggtccttaattttcctgtggaaaattacggggttacttatcaacaaaataactgtccatccggggtggggaagtgccatcggggggcttctatgtacaggcccatcccggggaaccacatttccagagggggcctccccctgaggcccccatgggccccctcccaggtatccaagaataagtcacatggtgacagctgccggcatgggctgagtgggacccaggcctattatacccggccaaagggttggggggcctctctccgtggaagcctgctctttccaaaccccctttcccagccaggctgtcttggacactcccggggctccgatgaggggcacatgattcccgcttgggacttcttttggacgatgtcattttaacactgaggcatcctgggcctcccttcccgagaagatgggtaattggcagtggctgagccataaccttataagtcccggttttggtccaacaaacaattgatattccccatgggacttgcattttggcccaagaaccaaaagtgcctcaacagtgtacagtttctgctgggtcactctggttccggcagggtctccttggtgacagccaggcccaacccaattccggcccgatgtccttccggagacacctcgtctccagcggtgtcagcaatacggggctcgtaaacactccaacttgtccagggaactctgcctgcgaagcgaacgggctccgcctcacaccttgctggcttgcgcatacagagaccggggctaaagtcacccggaactcaacgcctgccacaggtcgccctcctgcgacaccgttaagcccgtcccaagcggctggactccctaagggcccaacagccggatcccctcaggcttccagaggccacacaccgccggaacgctgacatgggccccaaggggacacgtacg

SEQ ID NO: 545236 - DNA, 325 bp, Homo sapiens
tcagctcaagtgcacaacagtctctgctgtcctggctgataagagaagagcaacagcacagcagcccaggaggcatgcacaggcagacccaaaggaggcctatggatgattatgaggggaaggatgtggccaccagggtcggagaggcctggcaggagaggcctggagctccaagaggtggccaaggagacccagctgtacccgctcatcaacctgcagatcccagcaccccagagcggcagagcagccccagcggatctgagcaacttgtcagacaagagagtagtggcagcagcgtgtagactgattcatacggggggaacag

SEQ ID NO: 545237 - DNA, 308 bp, Homo sapiens
cacatcatgcgtgtgtgtgtctttcatcagtcagccatgcattcatcacactcttggggtctataccccagtaatgggatgtagggtcaaatggtcatttctcattgtggatccctgaggaatcaccagactgtcttccacaatggttgaactaatttcacactcctcaccacggatgtaacacgtgtttctctttttccacatcctgtccagcatctgtggtatcctgaaaccttttcacgatcgcccttctacctggcgtgagactgatctctccttgtggattagacttcgcatttctctgatga

SEQ ID NO: 545238 - DNA, 488 bp, Homo sapiens
tctcgggccgaattcggcacgaggaaagcgaaaaaggaagctcctgcccctcctaaagctgaagccaaagcgaagggtttaaaggccaaaaagggagtgttgaaaggggtcccccgccccaaaaagaaaaaaatccgcacgtcacccacctttcggggggcgaagacactgggactccggggacagcccaaatattcttggaagagcgctcccaggagaaacaagcttggccactatgctttcattaagtttccgctgaccactgagtctgccctgaagaagattgaagacaacaacccacttgtgttcattggggatgttaaagcccacaagcaccagattaaacaggctgggaaaaagctgtatgacattgatgtggccaagggcaacaccctgattcggcctgatggagaaaaaaaaggatatgttcgactgggtcctgattaccaagctttggatgttgccaacaaaattgggatcatttaaac

SEQ ID NO: 545239 - DNA, 548 bp, Homo sapiens
acacaagactagcggataatctacaaaactggatgatctttaatatgcatgtatgtatctaaacacccacatatatttgtggtttaagtgtgcgaaatcttgctaatctatatgccacagaagagcaaaattgtctccaaatttaatgccactataaatttctctcaccacgagggcatcagcagcatgcatcactggtttttttatcttgaatttgccccatataattggtcaatggcataacttaataaattatgtgtgcatataaaagtagtgtatccatagtctcacagtttgatcttcatcccttcccattactgcaaaggtactgttagctggaacgaaaaacatttgggtacgcttagtatgccagtagtctttccctttatagtatctctataaaaactggtaataaaatcagtggaaaagggcaggttgactcaaggtgaatcaatctgaaattgagcacacctgcctgccatcgctgttccttcaactgcgtgctgcacatcatgggctctgtctgtcagagaacatcccggtgctag

SEQ ID NO: 545240 - DNA, 384 bp, Homo sapiens
gtttgctttcgtatggttctgaggtcagaaaatattaaatggaaatcgcagaaataagcacttcataagtttaaattgcacaccattctgagtattgtgatgaagttcatgccatccacttctgtcctatctggtctcacctgggacatgaatcattcctttgttcagtctatccacactatatacaccacctgccgttagtcactgtgtagccatctcggttatcagctcgactgctgtggtatcacagtgcttatgttcaagtaaccttattttacttaataatggccccaaaacacaagagttgtgatgctggcaattcaagaagctttaaagtgctccctttaagtgaaaaggtgaaagttcttgacttaagaaaggaaa

SEQ ID NO: 545241 - DNA, 482 bp, Homo sapiens
tctgctgcaccagattgatagcgagttctcctgttctcaggctcctgagtaacgtgggatcacaggcatgtcagccaccgatgcccagattatttgtatttttagtagagatggggtttaccatgattgcccaggctggtgctcgaactcttgacctcagatgatctcaccagcctctggctcccaaagtgctgggattacaggcggtgagcctagctgcccggcctagcatttcaaaatgctaaaatacaggttctggtagtcttttccttgggtccagcatcgtttgttgctgactatgtcaagtagctaccaagatggcgcagtgaaggtgatgcgcagtggagactgttcccctcgccgctccctggttcctgcagagagtcctgttggcagctcgttggaacaatggttttcccctggagtttgaggagcttgtcatgggtgtggtgcatccctacaccatgtgtacagtttccaga

SEQ ID NO: 545242 - DNA, 176 bp, Homo sapiens
tttctctgcctcccagattcaagcaattcccctgttctcagcctcccaagtactagggataacaggcatagagccaccgtgtcctgcctaatatctagtaactattagataaagtcataaagacctagttgtaagtaagtatatctacataagtaaatcaaacgtagcaagtaaat

SEQ ID NO: 545243 - DNA, 220 bp, Homo sapiens
tactaatggctgtctttactactatataaatggtgtctggacaatgctatgagggagaactacagatcattttaacttgtacttgatttttcttaataaaatgatgtttgtatggatagatcttcccagaaacgtaagggatatcattttcatcatttctgtaccttaattcaagtgtataaatattcttttggcaagggtatagaacgtaattacattt

SEQ ID NO: 545244 - DNA, 1407 bp, Homo sapiens
  misc_feature (279)..(279): n is a, c, g, or t
  misc_feature (285)..(285): n is a, c, g, or t
  misc_feature (641)..(641): n is a, c, g, or t
acatatttgagatagtttaacagatatctacaatataaaatgctatagttgtgtgataaagtaagcattagatccattcttcatgttgagtcgggactgatgttgacaagagtataatgctatggtttgggtttttaattatgttgtccaagtgtgtctgggtaaaaataaaatattgagcacttcgagacctctatgtactgttatatagacttgtcccatagtgccagcactttaacatatcaccatctatacacacgggaagggaccaggtgcgtntcactntcccttccttgggtgtcacttcggtgaggtgggtcgtgcaattaaagacgactgacaattctctgtcgaaactccagtcgagagatttagcttatgtgggctaacttatcaaagcctatagaaagcattggttagttgggtccctcggtttaagagggttccccttttgtgtccctgtgtatgtttctttacacttacacacactgggtgttcaactgcatgtgtgtgtattagccctccaataaaattcatcacctggtttaaattttatcccatgtatccacgcgcgcgaggaagtagtgggtctaacagcaaggactgttttgttctctcgaaattcactggagaggaggaanaaaaagtctaaggtaggccagtttatccgtgttcgttccatacccccccaagtttagtgtcctaactgtggggttttcttccccgtgcaaacctttagaagtcagtttggctcactccctcacgtcgtgttatagtgtcttctacgaaaaatatggccccgaaaacaaatgttattcttggagctcttcgtgggggtgtataaacaccaatttcttttctaaattctctccccaaatctcctctaaactggggataacatctgtgtgttgtcgccgtgttaacaaagttacgggggacagacccccaaaggttaattttgatcgtccctcccaagttggcttttttaaaaagagacgctgtaacagaggtgattttttttccagcaacacgttttcaaccacatttatattagggccatcttcaattctccttaaggaggagattttcgacgcaacactttgttgcccacgccggggaggcccccagaggagtccgtgggccgttgtgtgtgtgcccttagtaagtgggctcccctcccctgtgtgctgcgaacagcttttcgacatttctttgttcccacgcggggggcgtgcccactattcgcggaggaccctgttgccgcgcttctcggagacgtgccacttcttgctgctagaagcggtcatttattctcccccgagggggttccccccttttgcggaaagcaccctgtgctgtcccccccgtcggtctcggccggcaacttgtgttcccccggtctgtgcc

SEQ ID NO: 545245 - DNA, 964 bp, Homo sapiens
  misc_feature (325)..(325): n is a, c, g, or t
  misc_feature (355)..(355): n is a, c, g, or t
  misc_feature (364)..(364): n is a, c, g, or t
  misc_feature (379)..(379): n is a, c, g, or t
  misc_feature (394)..(394): n is a, c, g, or t
  misc_feature (464)..(464): n is a, c, g, or t
  misc_feature (468)..(468): n is a, c, g, or t
  misc_feature (470)..(470): n is a, c, g, or t
  misc_feature (475)..(475): n is a, c, g, or t
  misc_feature (481)..(481): n is a, c, g, or t
  misc_feature (485)..(485): n is a, c, g, or t
  misc_feature (492)..(492): n is a, c, g, or t
  misc_feature (497)..(497): n is a, c, g, or t
  misc_feature (508)..(509): n is a, c, g, or t
  misc_feature (514)..(515): n is a, c, g, or t
  misc_feature (518)..(519): n is a, c, g, or t
  misc_feature (524)..(524): n is a, c, g, or t
  misc_feature (532)..(532): n is a, c, g, or t
  misc_feature (557)..(557): n is a, c, g, or t
  misc_feature (581)..(581): n is a, c, g, or t
  misc_feature (588)..(588): n is a, c, g, or t
  misc_feature (591)..(591): n is a, c, g, or t
  misc_feature (609)..(609): n is a, c, g, or t
  misc_feature (624)..(624): n is a, c, g, or t
  misc_feature (630)..(630): n is a, c, g, or t
  misc_feature (633)..(633): n is a, c, g, or t
  misc_feature (659)..(659): n is a, c, g, or t
accagcgcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcgccccgtatgggcagggcccnccaatggtgcccccttcccagggtgggccncctcgcccnccgatgggaatgagnccccctgtaatgtcncaaggtggccgttactgatcttacttcatccagtctaataggtttggagattaaaccttttctccacttntgcngnttatntccccncccnccccccnataangccccattgtnnctttnncanncattntcttcccncataccaggaactattggacatttnttttactgggaaaattattggatnataagcnggnacttttcctgagttgcanttatacgtatggctnttttcntgnttctctaggtttttagagtgagtatngtaatttggttcgttaaatgtgaggcgctggattactgaactaccacctagtaaggcagttctgtaagcttacttgctatttgtaagtttgccttcacagctttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagac

SEQ ID NO: 545246 - DNA, 525 bp, Homo sapiens
  misc_feature (30)..(30): n is a, c, g, or t
  misc_feature (55)..(55): n is a, c, g, or t
  misc_feature (142)..(142): n is a, c, g, or t
  misc_feature (149)..(149): n is a, c, g, or t
  misc_feature (152)..(152): n is a, c, g, or t
  misc_feature (170)..(170): n is a, c, g, or t
  misc_feature (185)..(185): n is a, c, g, or t
  misc_feature (191)..(191): n is a, c, g, or t
  misc_feature (194)..(194): n is a, c, g, or t
  misc_feature (220)..(220): n is a, c, g, or t
ggccctgactactctccgtctatggttggngattaaccttctcactgtgctgttnttagcccagctccgtcataaggctccttgtacaccaactttctcccactaccggaactatggacattactgggaaaattattggatnataagcnggnacttttcctgagttgcanttatacgtatggctnttttcntgnttctctaggtttttagagtgagtatngtaatttggttcgttaaatgtgaggcgctggattactgaactaccacctagtaaggcagttctgtaagcttacttgctatttgtaagtttgccttcacagctttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagac

SEQ ID NO: 545247 - DNA, 382 bp, Homo sapiens
agcagtgaatgtgcagcggaatctgtgcaaaccgagccgttgatcattgttgggcctatcattgctatgcaaagtcctatgtagtggaaaagacagaggaggcactcacataccttttagatgaacatatatatagacataacatacaatctgtgggtgaggtgacacatagtagtagggggtccagtctgcataccctagtgagaaaataaaatacaatgtatcccccccaaccccatcctttactgtgcaggattctgctccaaagtaccaagtgaccagctaaagcaatgaggtacacaagaacaatattcccagctaactcatccaagcatctacgtgtggcacttgaggatggagctgcacagtgccctggacagag

SEQ ID NO: 545248 - DNA, 690 bp, Homo sapiens
  misc_feature (557)..(557): n is a, c, g, or t
accagggtgctcggtcttatatgtggccttggaagactgaggtccactcatgggtggtcagcgatatgtgacaagtgtgtccttatattacatgggactgttctatcattcgtgggccatacgttgagagttatgcctgaaataacagctctttgccatgccgactctttgtgatacttgttgcagaatgtgtgagacccgacctgcagcctggactaccctatcctcatctacagagacggaatgtaactgatcgcagtgacaggtgtcagggacctggggttccatgagacaggccatacacatggcttgtgcctatgaggcatctgacgcctgctgctgatatggtgtccatgagctacatcatggatgacagagtgccactcggtctttagctactcatgatactgctgcactctgagtctaactcatgtagctgcgctactcctagcagccgtccgagaacatgtcgagagtgaacgtagtcactgacaagactgacatcatagcattagcctgagcatcctgatacccttcatgtagctgatcatgacggntgcatgcatgcttaccgagcacgtccgttgctgcacgggcaagattgccttgacaccttagcagtagtaggcacttacccgctattacgcgttcagcaatgtccagagaggtgccctcgtggatcctagggtc

SEQ ID NO: 545249 - DNA, 487 bp, Homo sapiens
ctatccgacttcttgactgaagctttcttgtatagctatgttgtcaggaactgatgagacacctgatactaaatgagtatatatctatgtaagacaccaattagcagagacaagactgaacttcatgtgtcatgctcctctttgaatccggttcatcctagcatgaagcttgaacaggcaccaggacagaaatcaatagggtgggatgtgaagggaaaatacctatttttaatgactcagttgtccaatttccaacatgcaaccttggagttgcaaattttagagctgggagggattacatatatacacacacacacacacacacacacacacacacacacacacacacacacacacacacagagatatattcaaatctatattttctgtttcactgttgagaaacagaaaacagacagacaaacacaaaatctgttttgtccccaaaagagcacttatatagactgtatataaagtacacgccttc

SEQ ID NO: 545250 - DNA, 217 bp, Homo sapiens
gtacagatatgtggtgctgggcgcggtctcggcgggttgcgtgctggttgggaggctcacggaggaccccgccgagcgcgtgctgctgctggagtccgggcccaaggacgtgctcgcggggagcaagcggctttcgtggaagatccacatgcccgcgaccctggtggccaacctgtgcgacgacagggacaactggttctaccacaccgaagtgccg

SEQ ID NO: 545251 - DNA, 284 bp, Homo sapiens
ctgactctagaggagcttatgggtgcatgcatgtgcccaggtcagcctttcagccctcacctagcagcaggacaccgagtcacccccttctccaggacgacaccccgggcacaccaggggcacctccaggactcacagccacatgcacacccagcaagacccgcacctcgagcctgctgcccagcagccccacatcggcccccataaccacggtggtgaccacgggcctgtgaagccccaagtgtgcctgagtcagcagtggcctggactaacagctaacccca

SEQ ID NO: 545252 - DNA, 385 bp, Homo sapiens
acataccacatgtctagtaaccgcataggccctcaacatagacctacaacagacccatagacacagataattagcctgggactagaccatccctactaggaatgtgccacgcccctaaatagagactagtagagttttctctgcttaaagacaatcagaaaccaaaagctattatagctttctccttccagagatccaaggggcctcaaaaaatcttaaaatagggaaagcttagaaaggcagagttctgaggattcaacgattaggctgccttgagaaactcagagcagaaacctatgtagggtattaccctcgaggaacagagttagggatcaacaattcatggttctctgactggggccagaaccacaaatatcgggggatc

SEQ ID NO: 545253 - DNA, 171 bp, Homo sapiens
ctcatctcaccttaccgtcctcatctcccttaacgactcatctacccttaccgtcctcatctcccttacacgactacataatgtaaagcaaaccttgtcctcgtaaataatctgactatcccactccatatcacccgggaaacatcagtcctaccctgaattggagaggca

SEQ ID NO: 545254 - DNA, 1556 bp, Homo sapiens
  misc_feature (361)..(361): n is a, c, g, or t
gccgacacatcactgtggtttacatgcttttgatcgctacttctatgtccctcctgtactttttgcgggtcgcaacctcgtattatagagaacaacagctgttgtgtgttgtcaacacacgaaatacccacggtgctgtgggtcatccccgggtcctctcgcgtgatattttctcccgtccgggggaaattaatttctgctgctgtgataccctacctaaacgtgcgcttcctgcctcgcggggaaaccacgccctcgtggcgtgggaaattctttcctttgttgtaaagatattgtggcctcgcgccttcgagagaaacgctctgcgggcgctcgttcctccacatagtataggggactntctgtgtttatatgtcgctgctatctcccacatgggtctgtgtgcccgcgtctgtgtttggctttgttataaaaaggggcgccgacacatttttttaaagagagaaatttttgtaatcttcttcgcaggaatcctctcgtggcggagaggtagtgctctcctcccgccccgacgttgtttgcttgtgcccacaagtgacctggggcgctgctttaaccactatggtgtgtaaataaagagttaataattgttaatgggggaagaaaaggtgtttggttgtcctctttgtaataaaagcgtttgtgggtttatataatttatagtgaataataataggggggaatttttatagcgcgcacgtttagagatattcctaatttccacgccctcttggggggaaaccacgccttctttgtgtggctttttgttctccaccgctttttttctggggttacccccccgcgttaaacctgtggggttgatagagagaccggggggacccccccttttgtcgcgcgagataaataaggcgccccactggtggtttgtaccagcattgtgtctgtaatatcacaccgctgtccacacagcaccccgcgtctgtggtcgcgcctcggaggaaaacacacagcgtggagaaattccgtcgtggggtttagagaacacgcaccagcgcgctctgtgtaggggcttatacaaaattagaggggtatattatcacgctcatgagagatggttcccacacagtatatagacccacgagttccccccagcagggtatacactcgggcgttataggaaaaaattctcttttgacacactccctttaaactctcactcgtgtgagagtttgttggctcgtgggtggtcaccccacgaattctccacagagttaaccacgccccacgcgctcttgcccacaagcctctcttgtttttgtctctagactattataaatatttaataaagagttcccttgagatgtgcccacatatatatcccccgaggcactctcttcaccctctgcctccctccttggggccacacttgctaaagcccacaggtttcttctccacatgtccacactctttttcttaaggctcccctatttaactaattcacattttggacttcctttctgttttatttttttccccttagccttgcaagtgaataagcaaataatgtttaaaga

SEQ ID NO: 545255 - DNA, 264 bp, Homo sapiens
  misc_feature (83)..(83): n is a, c, g, or t
gagaagccgaaaagggacttgctttggacacagagcaagcggtttcagctgtactctgctaatgaaacagggaatgacttttntggagtgttttaagccaaggaaaggggatttgactcccttcctgcgcttgaaagcaagaaagaaacacacgttcacctctgtgaagggccccactctttctgagatctacatggttggaagtaaacttttggtttagatccagaagccaccttccaatatcaagaactccagaatgaccca

SEQ ID NO: 545256 - DNA, 217 bp, Homo sapiens
gtaatagacaacaggtgggagccaagacaagcaaatcacctgagagagatcctgtgattacagatataccagtggaatggtggaacaaaatggcggaggttttagaataaagcaaaatgcagagtagctaataagaagtattgggaaaatctgaaggctagagacagcacctcagctgtaaggctggtttataaggtctctggggaatacagaaaaa

SEQ ID NO: 545257 - DNA, 152 bp, Homo sapiens
cgagttgagtggaggagaccgcaagttgagtggaggaggcggcggtaggtcccggaccaggtgcctccatgcaggctctgaagagctagggctccaggaagacacgtgagggtcctagctgccttccttaggcgtggaaggctgccggctct

SEQ ID NO: 545258 - DNA, 181 bp, Homo sapiens
tcagagcgcaggcacatcatgtagacaacctagaatctgaagaagatgtgtcccgagcttaccttgaggctgttgctgaggacaagcctcatgtacagaccctattactctaagaccatcgcgatttagaagttgtggcgggcacgtgctgctcgctttgcctgcacgattgacggatacc

SEQ ID NO: 545259 - DNA, 115 bp, Homo sapiens
  misc_feature (12)..(12): n is a, c, g, or t
  misc_feature (21)..(21): n is a, c, g, or t
  misc_feature (47)..(47): n is a, c, g, or t
  misc_feature (60)..(60): n is a, c, g, or t
aaggttgtaagncagatgttnatttattaaatacaagttttgaaaanactactgccaggnaagtttgacaagaagtacccttcctggaatgtttcaaaatacagtcgcgttgatc

SEQ ID NO: 545260 - DNA, 629 bp, Homo sapiens
tgtgtacacttgagaaaaatatatattcttatgcttttgagtgggaagcactatagatgtctgttaagtctcatcggtttatattgttcaagtcttttatttccttactgttcttctgccttgttgttctaaccactattgaaagtgaggcattgaggccaggcatggttgcttacacctgtaatcccagcactttgggaggctgaggcaggtggatcatgaggtcaggagatcgagaccatcctggctaacacggtgaaaccccatctctactgctacaattagccaggcgtggtggtggttgcctgtagtcccagctacttgggaggctgtggcaggagaatggcgcgaacctgcgaggcggagcttgcagtgagctgagatcgcaccactgcactccgtcgtgcgtgacagagcgagactccgtctcacaacaacaactggatagatacctccaactattgctacatgtccgttcctcccttcacttctaactggtttggttcatggatttcggtgctctgttatgggggcatatcgggttatactcatatctttccctgatgagtttaccgtcgtttatagctattggcatccgtccctcaccttcgtcttctcttttcttccct

SEQ ID NO: 545261 - DNA, 438 bp, Homo sapiens
accccttcatggggttctggaggtgcgtgggttgtgtgcacaggtctaattaggggcctttagtcaacggtaggaacctgacccagctggcagctccttggcctgtgattcttcttctcctaagtactcagtgcagcgatgatgtctgaggtggtgtccaacgtccaggagtatcgtgagtttgtgcctcgttgtgagaagcctctgtgtggtatccagccgtaagggtcatttgaaagcccaactggaggttggctttccacctgtcatgtaacgttatatcctctgcagtttccatggatcaagacctcacattgtctacgtgaggcctgtatgggaggtattgacaagattttttgtttttagcaatttcatatgacagtgctattttggccttccttgtaagtactttatgtccatttgtcaattatttccctt

SEQ ID NO: 545262 - DNA, 832 bp, Homo sapiens
  misc_feature (452)..(453): n is a, c, g, or t
tgggatgctggggtccttgggggttccctcctaccctttttttttttggtttttgaaagtttccatgataaaaatgtttttaaaaaaaaaagggtgtcccttggcgtccaaacaatgttctggttatttaatctggaaaaaaaaatatatttggctttccctaatctgggccttgattaagaagggagaataaatgtgtcctggggaagataagatgaggctatgtgtttggtgagaaaagatatagaagggttgtagaaagaagtatagagatcatatccaggcgcccccccgaggacaccaagagaggaaacacactttatttacgagcaagagtataaagacacgtttgttagcttcatctctgtgtggcgctgtgaaagaggtatagagggtgcaaactatagagtgtggtctcaaagtctccgaggtctctccaaactctctgtggnncccccaaactctccccagagtctcccgatgtgggtctctctcacactactctcctttttctccccacaacagacggcctttctcctgtggagacgcttacgcaagagagagaagaggtgtgttcccccccaccctgtgagagaacacttaatctcccatattgtgggggcctgtgaaacaccgaaggccctcttttgtggcacacagagatgacacccccagaggaggcgcgagagaagtcatttattgcccccgaggtgaggggggggcgagcgccctgtgggacacgtaaaggatgaggcccttctgtgctcccttaaggggttcccctcaaacggagcctctctagggaactttccacctgtgggggggacagcgg

SEQ ID NO: 545263 - DNA, 185 bp, Homo sapiens
tgtgatctacagatcctaaggccgcccttttattaagggagggtgtagtagggaggtgatgattgggtttcgccatgtagcccaggctggtctcgaaactccttgagctcaagcgatccaacagcctcggcctcccaaagtgctggaattacaggtgtgagccaccatgcccggccgcaagtttt

SEQ ID NO: 545264 - DNA, 731 bp, Homo sapiens
  misc_feature (1)..(1): n is a, c, g, or t
  misc_feature (25)..(25): n is a, c, g, or t
  misc_feature (686)..(686): n is a, c, g, or t
ntcggtttgggatcggcgcccctgngggggccaacgggattcggccattatggccggggaggcttactttcaattggaagaagagagagcggtcaactatcacacatcaactgcacctacaaagccacccctgcccatgtacagcccctagaccctgaacaatatcactttttgcgagtaaacgctaccacgaagaaaaggacaggccgcaagaccctcagaaagcgcctatgttatttaaaaaggagggcggggccaaccagctcgcaagagaaggctttatgtggacgcgggcgcttgtccagagggaatgcggcacaatacactctgcaatcctgaaaaacgctcgcagcaaacacgaggaaatatggggagagacacggcaataatctagagggcgccagacccacaggagggggtaccatggcacgccgcatatctgaaagagaaaaggacgattgcatacacaagaactataaaccgggcccacccgtgatcccaaaaaggcgcaatagttccaccagagcccggcaagttttatcactccaacgggtgagccagttcggagggggacagggaaaatagaacggggacccaggctcacagaactgaatcgccccaatacgggggaaattgtcaaagcgagaaccacagaaagagcggagttttgtggagcgcgacagaanctagaggtaccctaacccgaggcgggctataagagagccgaaaac

SEQ ID NO: 545265 - DNA, 230 bp, Homo sapiens
gtaagatcctgcagacgcgagtacaggctgcaggtcgatcgcacactgaattcaggaacttgaaaagcttcccgggtcctggccgtgatttgcgaaccaaagcgaccattgagctcatggccctcaggctgctgaacttccagaggcagctgcgccaggaggtggtggtgtgccatgggagggacacagcgcttgagacagccctcaatgctcaggcttacaaagcgcag

SEQ ID NO: 545266 - DNA, 601 bp, Homo sapiens
ttcttatattggcaaattgtatgtccttgaagtttagtataggaatgatcccatcacccaggtagtgagcatagtacctaataggtaattttagaaccctcaccccactcccgacctccctcctagtagtactcagtgcattttgtttccatcttcatgtctgtgtatacacaatgtttaggtttagctctcacttataagtgaagacatactgtatttgatttcctgttcctgtgttgggttacttaggacaatggcttccagctgcatccattttgctgcaaaggatattaatttctttttttaaggctgcatggtattccatagtacatgtgtaccacatttttttaatccaatccactgttgatggacactagagttgattgcatgtctttgctattgtgaatagtgctgcagtgaacttacaagtgtatttgtctttttggtagaatattctatttttctttgagtatatacccagtaatgggattgctaggtcaaatggtagttctgttttaagttctttgagaaactccaaactgcttttcacagtggctgaactaatttgcattcccttttctcttccacctcaccaacatct

SEQ ID NO: 545267 - DNA, 796 bp, Homo sapiens
  misc_feature (1)..(1): n is a, c, g, or t
  misc_feature (31)..(32): n is a, c, g, or t
  misc_feature (38)..(38): n is a, c, g, or t
  misc_feature (41)..(41): n is a, c, g, or t
  misc_feature (212)..(212): n is a, c, g, or t
  misc_feature (638)..(638): n is a, c, g, or t
naaaggacttgcactgccgggtcacttgttnncaatcntgncaaccttttggacaacgtttttgaaattagcatccctttctggagatgtatgtacatatacagttcattagctctagaacatgttcatttaccactattttactctaaattccctagctggctgctttcaaagacattttgagagtaggaatcttcctaacactctctttngtgaggagtaagtagaataattcaaggaatcgtttggagtctgtccaatgaacgaatgctgcttctttaatcatgctgtaacccacctcctttaaggggtcagctggcatagctcctaaatgctgctttctgtggccctcaccttgtcacacggacagttctcatttgtgtctgttctctctcccttttacagaagctacagttttccccaccatccgcccccctctctggccttgtagaatggtgtgtgtgtgttttaactcctgctcttgttctgtggtgctgggcttcctatgatggggctttaaagtctctagatttcctgtggattgtttactttgttagcagtgcttttacattactttactaatgcatttccttactacttgcatctcatgatttttcttttttttttttttttttgtnattgacctgtactcacctgtcctacaggttcgtttttttcctcttttctcactgtggaagatgagtctaggtcctctttgcctcagttgtgatgatctgctaacatctctctctcctagaacctaccgtatgcagctgccatgttgtcacgattgtca

SEQ ID NO: 545268 - DNA, 249 bp, Homo sapiens
ctaaacgcactcactcatgtaacagcgaatgtgtttgctcaattaatgattaaaggtattaataaagtgactcatatacatgaagaaaaagtgtgtgtgtgcttgcgtgcgtgaagtgggttgtggtggtgatggcatgttcatacttagggccgttgtagtagcctaggtagttcacagaggtaattggattagcatgatggcagtgtagagaagtacatggaatagaaagatatttagatgataaag

SEQ ID NO: 545269 - DNA, 547 bp, Homo sapiens
attttaggttctgacttgggcaaacaacacaatactcgaatggagcgcctgtccagagcacatgaacatgtcgagtgtgattccacagtgcccatatgcataacagagtcctatccatgcttatattgtaattgacaaggtgacagtgactatgacgatcggaaacggattggaataagaaccacaatgcctattagagacaacatatattaaaaagatttggagaacttatgtataacaggagctaccctaactaaattgaactcacatttgcaaatcatattcgagcactggacattaaataatgaacttcttatgtctctgagaactactaactgatagagcacagttagagaaatgctgtcaggaacatggcctggatcgttagatctagtcatgacgatgagtggatcgaccatacttggtgttttctcgagtgctaacatattacatgggacagcagatccagcaactcagtatgggtgcatagtagcttacaccttggatgataaaataccttgattgaaataagagtgaatcattatgg

SEQ ID NO: 545270 - DNA, 139 bp, Homo sapiens
atggagacgccgagtgtccagactcttaaaatcaggtcttagtggacgaagttgttgctgcacacgccgaatgcccacacccacggggacctgcaacaacttcgtccattcggatttgtatggacactcggcgtgtgca

SEQ ID NO: 545271 - DNA, 124 bp, Homo sapiens
ttcattttctacactctacaagcatgcaggcttggatgcgaatccttttccctgataggttcatatgacatgagtgaggcgcaatcgggaaaagaattcgcatccaagctgcatgcttgttgaa

SEQ ID NO: 545272 - DNA, 216 bp, Homo sapiens
gagaagtttgtggtatataatgtttacatggcagggaggcagctgtgttctaagcggtacccggagtttgctatcctacaccagaacctgaagggagaggtttgccaactttacattttctggacttccaggggaggttggcatttttattattagacaacaatttaggttgcccacggtcgggatttggaaggatattcaggaaaaggtgtgtta

SEQ ID NO: 545273 - DNA, 1008 bp, Homo sapiens
gagcggagaagagaacggacggtgatggtcgacggtcgcagtccaaatccagctggctgctgcggcgagcatgtgcgcggcggcagcggcggtgactgaggatagagagccacagcacgaggagctgccaggcctggacatgccatgtgtgcgccagatagaaaactggctgagagtgggcgataactgtccactgcgggccggcgaaagctggttccttgtggagaatgcactggtataatgcagttgtggatggcataccgtgcatgtgggaggggaccagtgactccaagcaccttccctggctgcatcaacaatgccacactctttcaagatgacgataacactcggcgcctcaacggagggactggtggaaggcgaggatcactgtgctgctcccagcagctgcttgggcattacctggtcagctggtatggtctaagagcatggccagccacccattgaaccgcaggtccatagagctgcccaacatccagaaggtcgaacgttgtacccagtacgaacctgctgcttgtccgggcacattgattctgggccaaatctcacactgtatcagtttcagccactaccgatctctatagcgcctaggtatttgcgcacagctcgggaagcggttactggtggacagccccagtgacagacacctcgggctttgggcccatgaactccgacaggctcttttgcataggcttgcatgacacacaccatcaccggttctcgactgccgccccttgacaaactggtgcagagcttaggaaacccatccagttgcactaacccccgctaaccaaacatgactttgcccctttttgtctcccccttgcgcaccagaacgttgcctttgtcctggttgaacccccttgcgggcaaatactgggctccgatctgcggcgcggtcacacgcagaagggcacatggttatcgccacactcacaaattgcagccctatgcacgcatgccctcacgtcatcaggtcttcatctcacc

SEQ ID NO: 545274 - DNA, 200 bp, Homo sapiens
tgagatggagtctccgccctgttgcccaggctggagtgcagtggcatgatcttggctcactgcaagctccgcctcccgggttcatgccattctcctgcctcattcctcccatagtatactgtacagtacacaagctagaagaggagagctcattaataaagtcaccataaaggatattttttatatgaataaagacatca

SEQ ID NO: 545275 - DNA, 181 bp, Homo sapiens
cacctgaccagtgtgacaagtgccgggagatcttgtctgtggactgttccaccaacaacccctcccaggctaagttgcggcgcgagctcgacgaatccctccaggccgctgagaggttgaccaggaaatacaacgagctcgctaaagtcctaccagaggaagatgctcaacacctcctcct

SEQ ID NO: 545276 - DNA, 837 bp, Homo sapiens
catggtggctcacgcctgtcatcccagcactttgggatgtcgatgcgggcagatcacctgatggtattaggaggtggggcctttggcaggtgattagaagttacgggattgatgcccttataaaagagaccttggagagctcctttacctcttccaccatataaagacatggtaagaatatggctgtctgtgaaccagaaagcaggccctcaccagacatgaaatctgtcaacactttgatctagcaaggcccagcctccagatttagtttataaaacaattattctctatattactcacaattgtctgtgaatttacagttatctcaataaaaataaatggaatgagatgtgcaagggactgctgagttttacaacaaactttttttgtactattttaccttacctatgaacatgtattattttgactaaaaagaaaacatgttttcccttaaatgaggtactctatgcaaagtgcttgacatatagaaagctttcaataaaagctctctttcctctctttccctttggtttgaggaataagacaacctctaggccaggcacagtggttcacgctgtaaccccagcactttggggaggccaaggagaaagaacggcttgaggtccaggaattcgagaaccaggctcgggaacacagcaagaactctatctctacaaataactttcaattattagccaggcacagtggcaatgccctgtggtcccagttactcaggaggcgaaatgcgaggatcacttgagccaggagctcaagaatgaagtgagcatgatagcaccctgaacccagctgggcgacagagtagactgtctcaaaaaa

SEQ ID NO: 545277 - DNA, 668 bp, Homo sapiens
catggcttctgtgcaatctgcgaggatggcttgtggccgaagggttgctctgcccggcgcgcgctcagctgtgagctgcagcagaagctcctgggctcgagcagaaccgccaaaagcctgtggcttcagtcctgcgtctgcaccgacagattcaatcaggatcgtttcgttatggtgtttaaaggaaaggtgagattgcgctctggttcttcatgagcacattgtgatataggcgtcttatgtctgtcaattccttgctcatttcgttatcggggaacgaaatctgtactgtaattgggattgtacacacgagcagtcctctggccactccacgacagggttctagcagcaacattaaactgcttgtgtccctgtcgttctgtccaaaacataatcaagcacagacacagaacgagacacaagaagagagagaaactcgcgggaggccctgttacccgtggggtgtgtcggccagacatagtgagcgcaggtcactgtaaaggacgggacgcaccagtgttcacgcaaaaacgtcgagttcgccaggcagggagccaccctatcgattggtgtctgacgcaacggggctggaactataccttcgcacggggggcctccgcacagtttgaggggcctgcgcaagtatcaacctttcgtcacaataaaac

SEQ ID NO: 545278 - DNA, 657 bp, Homo sapiens
tctcttcctcttaaactccttgtttccgttgatggcaccacttcttccctcattgcacaaactggaaacctgtgtcttttccctctttctgtgcctaattcttcctcaaggccctctcctttttacttgctgtatcctttagaccgtgaccctctatttcaacccgatggctgctgcctccattcagactttgctcattttaactggccatggctcccacctgccccctgctctacttgccccttctctccttagacacctgttagtgatgtcgcctcctgcttaaactcatcctgccttcttagtttaatgctaagaagaaagggaataaatgaactagatgctgaacttgagctgcgagaagaggtaataagggaaattagaaggcctaatacagcaaagctggtataaatgaattagaaataaagcagcagtggaattgagaaatagacccgggttgtttttttaaaaaaagaatgattaagaagttctggaggtcagtgtgcatatacctaatactactgaaccatacaaactaaaaatggctaaggcgattgcttttatgtgatgtgtgttttttttttaaccacaataaaacaaaaaggcccccccccccaccaccataggaaaacaaattcttaagtgataaaaaaaaaa

SEQ ID NO: 545279 - DNA, 854 bp, Homo sapiens
tgggccccgggcaagcgcggttacacgagctgggcagcggcatgtagtgcgtgaagggccaggcccaagcatgtctgggacgaccattggagaggcgaaattggatgccacaacacaagcgccacctgtacgtacgacagtcacgtcggcagccacgcgcgctcggcagcctcaaaggaggccaagtcgggcccaacgtccagcggagcaaaggtgggcgtctagcgccaaggtcccatgagtgacaagcgccgtcggagaagctgcaaggagtgaggtcgcttcaagggagacaagtatggtcaggcaggccagggagccagcgagtacaccgactgactgtcgcgcaccttcccttcatcagccttcgctcagggccaaggacggagacagcaggatgacatcagtctagcataggggcaaagtgatccttactcatgcgtcggtctggtttattggaacagctgatcatccgaggctggtgtctgagctccaggagcagactgcacgcagcttcacagtcgcgctcagtctcctaagcactctctttcccgcatgcgtgtccccatgtcgaccgctcagctcctctggtgtccgctcgtgccgcgatgcacagccatcctcagccagcccccaggtagaaacgtgggttaagctcttgcgtgccccgttacagcttcactcccacccttgtcagcagtcctgcccctatcaccttgacccgggttccccacactcccattccgtggcatctgccataatattgttgttcaactgctccctccttccagaggggcctacagggcttgtggggggtaggctgagaccccattaccaaagggtaagtgagtccc

SEQ ID NO: 545280 - DNA, 523 bp, Homo sapiens
agccccggcaaaaaaccttcagtcagcacgtggaaaactgcgagccagcattacccccgggaccattttgttcatcctccctggacgccacaggggcaaaagggtggttttcctaaaacagctgggtagtggcttattacttggggctgggcctttggtcctcaatcgggttcctttacgaagaaccccccagaaatttgtctttgccccttcaaccaaaatggatatcagcaatggaaaaatccccaaacctttttttgatgctttcttcaaaaagaagaagctgcggaagccccgcccccaggaaggtgggtttttcgccccagaaaaagagaaatttgggatttcggggcagggcaagattggtcagaaagctgggggctccccaatttttcccaaaaatcaaaggttttcctcagctccaggggtccctgcgatttgggtttgctttgacgaatgggatttttccccccaaattggggttttaaatgttttaagaccctaatttaatagctggccccca

SEQ ID NO: 545281 - DNA, 927 bp, Homo sapiens
ggctgcggagggagccgccgacatgtctgcgcatctgcaatggatggtcgtgctggatactgctcgcagttatcctgcatcaatgaggcaatagagcagacctaccagcagtgagcccaataacttgaaggcccgcaattccttccggtacaacggactgattctccgcaagacctgtgggcgtggacaccggtaagccgagcggcaatgggtgtcgctggtggtcagttacagcggcgactccgggccaggcgtgaacgcctgtccacgcatccgtagtggtggcggaccacgcatcaaacatagacatgctcgacgccaccggctcacgcatgcaatcagacagcatgaatccgacaaggaatcaagatacacggcacccgtaccatgccgccatggcccagcactagtccagccaaggggaacagcgctcaatcctagctgacagaccaagcaagaccgggtgcatggggtggcaaagcagagcaacgcggagaacacctgccgcctaaccaaatgagaggtacactagaagaacccacctagtctcagccacagtaagccaacatgaacacagtcacagattagggactgtaaccgtacagaacttggccctccgaaactaggacggaccatacacactataataacgaacaaacggcaatccatgagcgtaaacgcacactccctagagcaaccccgtaggataggattggattcagagatcgaaatcacccacaagggacacaccaaataggttacaatgtcacaacacaaacatcgttacattgccaagatggcgtaaaaaccacagtctgggctaaccaaaatacaattgcgcacagaggttgccactcgattcacaaatctggtgcaattgatcgaaccacacgatggcaataggaaagagtccaccgatggaaatag

SEQ ID NO: 545282 - DNA, 357 bp, Homo sapiens
cccatgcaataaagaaaaatcacgacgtcctcttcagaacagtactcctcatcacaatatataaatatgttaaataggaacacaagggcaggggcgaggaaaactggcattttccagaatactgcagaagccgacagagactacaatttgagggcttaggtttggggacaaacaaagaggcacaaattcaaatacaatttcgaacatgacttcaaggctgggcgcaatggctcacacccacccataatcccagcacttagggaagtcaaggtgggcggatcgcttgaggccaggagtttgagaccaatctggccaacatggcaaaacactgtgtctactaaaaattcaaaaattacc

SEQ ID NO: 545283 - DNA, 139 bp, Homo sapiens
aatgtctacggtgagtggtacgaacttttcacataccatgtgttataaaatcggttcttacctggaatcaccccgtatggtgttcgaattcataagaacagggaggttagaagcagggtcttgggaccagcacaacctg

SEQ ID NO: 545284 - DNA, 489 bp, Homo sapiens
gggcgacctgaggaccccgaggacgcatcatttgacttcatacaaagatatgttatcttcaatgaatagaaatgattgaaatatggtatatacaaacatcaaatcacatcagtcccaaaaagaccatacctaccaattatttgcatagcggagagagaactgagacagagctcagatgacaacgtgatccttatatagataaagttttctttctactacagttcctagtatgatcacatcagaaagttcatcacaagatacttcccgctacttagcatgtatgtcagaaatggaacacaagtcacatgggcccagtctttagaagctagatgggaattagatgaaagctccaaggtattcccgggagctggactaatcctggggctccttgacccacagcaagaggacagctgcctggagtacgggtggtgaaagctgccttcaattacagtgccctggatggggggacaggatactgaatgcgtccgt

SEQ ID NO: 545285 - DNA, 702 bp, Homo sapiens
tgcccctgcgggcagcagtattcatcatgtgtgagctgccgcagccgtcttcgtggaccacatgatagaacatgctgctctcagctcacaaccatcatggtgcgcagggacccgtagacgcatcccaccgtgtgtagagccactgtctgatgtgggagagagctactccatagtgagcactacccactccgctcgaaggacagatcgacatgagacctgttctcagggaaggggtgacatcgatacctgctgcattctgtctgagtgactcggtggatctagtcgtaacatgggaatgctggttgtggcgcatacccgacatgacatactatgtgtctctagcccacactgataccacagcggcgtgtcggatagttgcacacccaagtgcggatgctgctcgagttatagagctggtgaagataatgctacacgcttatgctcgttgactgtagctaacatctgcgcagtgggactgagactatcatgtggacacagcgatgtactacctcgtttattacaagcgctgctgttacgtgctctgtatattgtgagatattgttgtaacgcggactgctgagcttacacaacctggtagaatggtgtatctgcccacaaattgacactctacctctcgaatgtgtgacacgagagtagaagggcacgccttctgtcttgaaacacgtgtggctactggggtgc

SEQ ID NO: 545286 - DNA, 292 bp, Homo sapiens
tcatggggtacctggagacatcataaagactatatagagcgaggaagactggccctgtagcttgtcgcaaatgccggaacggcagcagtaggacacactgatcagattgggagattgaaagaactctgtgagcagtatggcatatggcttcatgtggagggtgtgaatctggcaacattgggtctgggttatgtctcctcatcagtgctggctgcagccgaatgtgattgcatgacgataactcctggcccgtggcctgggttggccagctgttcctgccgtgacactgtat

SEQ ID NO: 545287 - DNA, 1627 bp, Homo sapiens
cctcatacacaacactaacacatccagacaacatagaagcaacataatcttctattttgaattaacttctcctgcctctttatgtatgatcctggttccgtatatcattatactcgtttttctttcttccatactcccattgggttttcttgaacactactccatttgaccccgttttctacaataaaccaacaccattgttgttcccccccacaatttttcttgctcacaatgatttttgtcgcaacgaccaccagtttggttttactgaaggcccaatcgttggtggtaccacccacaatgtttatatcgggcgctttttcgccgccccatagtagtggcaacattgttgtttcacaaggcgcccagtggtccgcgggttctcttgggagggcgcttttttattccagaggggcccagtatgttttttgcggggcctcccccccccccttggtttgggggccctttcctgttctcaacagctcctattggtcgtgccacccccacggagacttttttggttggtgtccgcccctagcctgtgcggtgggacaccactttcatggggctccagccgctttggggtgtgtttaattctttgtcggagggcagttttgggggggtgatagcgccacactcccctgttgctctggcgccttgttcccaggtgctctacggccccacagggttaacccccagggcccccgggtccaagaaaccataggggccccccttggggggagtgatataaaaaaatttagcccccttgtatagagttgtggaattacaccccattggaggcgtttctgtccaaccactatggtccggcgaggatcttgggtcgagagctttccgcacacaataggtgtgggaaatattcccgcaaaaaagtgttttctcccccttataatggggtgggccttcttctatagatgtcctcttttgagagccccctcgtctctataggaatttataggttgggtgccctccaccacgagcggttggggcgcactacaccacagcgttccctgccctgccacagctgtcacatagctggccacagttttcctcgttctctgtgttttcacccaccatttccccaccacacccacacttgccacacttaatttatattgcacttctcacaggaaaatataaagagaaagtgttcttgcgaataagtttataacaggcactcacgttcttaacttacacctggtccccccaccccccaccttatagggaaaatgtcctatgaactcctgggaaaattgaggcgcttcttttgaatggtgaagtggaagaacaaagattatagaaggaagaaaggtctgcccctgaaagctgctgttataggagaaggcaggatagaggaatccagccttaggagggttcccatgcccagctgtccatttggccaagagaccctggcaccagatgacattttgcctcttgaacattccactcgttcttcttttcctccaaatgggcgttcataatagctttcccctcaaggcttaacactgagaatttaatgaggtgcaccaatgtgaagacctggcaccagtaccaccaccagatattcccattaaagtgtggtcccccattaaacaaaagaaaaaaaaaa

SEQ ID NO: 545288 - DNA, 673 bp, Homo sapiens
cgcttccacaattttttccactttattcttccggaatcgtatgttgccccaacatcttgaactgaatatctttttcacacgggggacaccaatgcaccataattacggcaaactccgggtgaaccctcgcgagaagggcacaaaagctggcgcgccacccggttgtgggcggttctactttgagtggatcccccgggggcatgttattcggcacgagggaaaacctaaaaacagtgaggcggccataatttgataaaaaactaccacaattggggcaagcagtaacaaccagcgtgttaaaaggcagacgattgttcatcatcctgtgtatggcccagaacaaaacgtagaagattacatgtaccctttgaaatttcagtgatccatcatgattttgacctgcatctactcgtgaaaccaacataaatttttcatcacttcccaaatttccccatgcccctccagagggggcaggcaaacattgtttcattgtgcttaacaaaaaatgctagtattttttttttttaattaaaggtctgtggctcccttgcaacaagcaagtcaccgcgcaccctttttccaatggcatctgcatgcttcttgtctatgtgtcacaacctggtaatttttacaataaaacaagctttcccataatgaattgctgcaatcccat

SEQ ID NO: 545289 - DNA, 218 bp, Homo sapiens
aggggcagtgcacagacttatcgagctctgaatgtcgcggtcgcacgacgcgatcgatggcgcagtgcaggcggcgcaatgcatctaggcctatatattcggagatacgtagccggtactgtaacaccggtactctagaatatagtagcatgcgcaaattaaagcgctgatatcgatcgcgcgcagatctgtcatgatgatcattgcaattggctcca

SEQ ID NO: 545290 - DNA, 714 bp, Homo sapiens
attatctgagcaactatcctatgccttgagaagatagatcctaacttctaatgatacagcaagatgctccactcccatacaaggattctttggaaatgtacactcattttgctttttgtttatttttgtattttctatatgtaaatacattgagaaagatttccttttttgggtgacttctggcactcaaaattctataaatacatggaagttgtaaaggagcttataaaggttttgaggaccttataaagatatcttctaaggttttgtttattttattttatttttgccatacattttggaaagcgatgcatggagctgattacaactggcaccgtcatcgtttataagccatgtttcttcccataggagattttgccacttaagggtctctgtatatttttagtcttaaaatgtttcatgttatttattccatcactaattttatttcacagttttcagcttgggatatttttaaacttgtttatgacacctgtaaaaataaaaatattgcatttataacaaacaaaaaaacaaaaaacaaacaaaaacaaacaaaaaccaacacaaccaaaaaaaacaccagaggggcggggcacaaaaaagacaccccacgacggggcacaccggtgcaggtcacactcggggacaacacgtgcccccaaacatgggccaaatataacacagaacctgggccgcgaaacaccctgggca

SEQ ID NO: 545291 - DNA, 206 bp, Homo sapiens
tataactaaatgtgaaatcacatgttactaccgtatcatataaacagccaaccacaggaaacagactggccaagattcaaacatgtaggcaaaaaccggcagagcactgaatagacgtccatcatggacccaaggcagcatccagaaaacggcacatcacagacggtaagaaaggcagacgcatcaaggagggaacagggatgccc

SEQ ID NO: 545292 - DNA, 809 bp, Homo sapiens
  misc_feature (498)..(498): n is a, c, g, or t
acccaggctggagtgcagtggcacgatcttggctcactgcaacctccatctcccgggttcaggcaattcttctgcctcagcctcctgagtagctgggactacaggcgcgtgccaccatgcccggctagtttattgtatttttggtagagatggggttttactgtgttggccaggatggtctcaatctcctgacctcataatctgcccacctcagcctcccaaagtgctgggattacaggcgtgagccactgcacccagcctttttaaagtttttaattgacatataattgtacgtatttacagggtaaataatgatgttttgatacatatataatgatcagatcagaacaattagcatatccatcacattgaacatttatcatttatttgtgttgagcctttagttctttttgttttttggggatagagtctcactctgtcacccaggctggagtacaggggtgtgatctgggctcacggaaacctccacccaccggnttcaacgcgattctcctgcctcagcctccctagtaactggggattacaggcacctgccaccagacccaattttggtattttgagtagagacggggtttcaccatctgtggccaggccaggcgggtcttgatctcctgacctgtgtgatccacccagctcagtttcccaaactgtgggattacaggcatgagccaggccccagccagagacagtcttgcttgtcgccaggctggagtgtagtgggcatcctgggtcactggaactccaatccctggttcaggcgggtctcctgcctcagctcccaagtagtg

SEQ ID NO: 545293 - DNA, 410 bp, Homo sapiens
  misc_feature (367)..(367): n is a, c, g, or t
ttagagtatccccgccgttgaccagtgcacagcgtatcatcaatcaagttatttcgttgttcctaccaagcaggattaatagctgctctcatcccagttctacggagctctccctccattcgcatgctcccaactcctaaaacgtagtggtaaaacccagttcagatttttttcctgtatttaacatgactcgtaaaaattataagaacacataattaactgatatgatcaaactagctcctatgagacacaaagcagtcttgtgaaatggttacttgtcacgatagttatgttcatttttccagctagtttttattcttggattgtcgtcagcacataggtgatctcttaactgaaattacggatnatgtacatttatgacaagttttacaaatcactaccaaaaagca

SEQ ID NO: 545294 - DNA, 160 bp, Homo sapiens
atccttccctcctcacggttatcctgcctgagcagcctgactgggcagtcttgctgcattctctgatgactccgtcttcctctttccacaatggctattcttttttttgagacggattttcactcttgtcacccaggctggagggcagtggcacaatttt

SEQ ID NO: 545295 - DNA, 299 bp, Homo sapiens
tgccccaatctctctctgaacacccccattctccacctgttggtggggggtgctcctcgtcccacccagatttgaccgttcagggggcctcccctgctatccctcctcccttcctgtaccccccttttctggggcctcatcactgtggaagacggggatcgtaagagataagtgggtgagagacacggggtagattttggagtagataaccggggtgtgtttgaaagggggaagactttgatcccctggagaggagcccatcattgtctaaaggctacgtcggcatttttaaaaaacaa

SEQ ID NO: 545296 - DNA, 493 bp, Homo sapiens
ttcttttcataacttttttggtgactcctatttgatagatggcagctagccagggaagattactgagctaattataactggaggggtctccgaggaatacagagatgagaagcattctggggcctggttcttctcaaatcctaaaaccaaatttagcctgttgctgattatttagatgatgaggacacttttagcacagggatagtggcatggatttgagtgaggacaagagccatgaaaataatgactagggcatacccctcattttttaaagatctgatttaagatttattatattatttgaagagaagggtttagttaaattcagtcacagttataaatgtaaaaaaaaattctaaagaaatttaaaatgaagagttgagctgatgaaaagtgctgttttccaacatggaccttgtaatctctgtggttaaattgtccgtgttcttgctaactcagcctttcttctaataagatggatgattttcatttg

SEQ ID NO: 545297 - DNA, 243 bp, Homo sapiens
ggtttccacgcatggagcacatagaatcacctgtaagggtcaccacgcatggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagacacctggagggtcaccatgcgtggattgccag

SEQ ID NO: 545298 - DNA, 180 bp, Homo sapiens
gtaccagcttcatataccacttattagaggttgccacgtgtgatatctaggtcttaatctagaaattacgctaatgaggccctatttacacaatagactcctctatcccccttagtcactttttatttaagaatagtcttgtcctataaatcagatctcttgtgtgttatctgtacctgt

SEQ ID NO: 545299 - DNA, 172 bp, Homo sapiens
cggtgacctagaggaccccatcgtgcagaagaaagaatcagtgagcttacaagcatagcacggtttgaaaatgccaatcagcaggagaacagcaaaaggtatgaagatctaccaagatataaaatattatctcaaaagattaaatctaatgaattggtactcgagggaggga

SEQ ID NO: 545300 - DNA, 122 bp, Homo sapiens
cagccatcatcagcgtagatctattcagtatggataaaacacgtatctcaggatagaggtggatcagtgtaatgacacctgccactatggcaactgactgatgaccctggtggaatggtgtc

SEQ ID NO: 545301 - DNA, 291 bp, Homo sapiens
cggtcctgggagatgaggcggcagatactgaggtcaggagtcagaccagctgacaacatggagaaacctcgtctctacaaaaaaatacaaaagaattagccaggcatggtggcgtgtgcctgtagtcccagctaccccagagactgaggtgggaagatcgattgagcacaggtggttgaggctgcagtgaaccagtcattgcaccactgtacttcagcctgagtcacagaacgagaccctgtctcaaaaaaataaataaataaaattctattactgagtgttgggcgataa

SEQ ID NO: 545302 - DNA, 247 bp, Homo sapiens
gaattcgggcgggcttagagaggaggggacagagaggtgtcctgggcctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaag

SEQ ID NO: 545303 - DNA, 116 bp, Homo sapiens
tggtgatagaggatctggctccatggtgcggtctctgcctatcggtcctaacaagtcacaaggcccaaagacaccctccagtcccttcccttccttagccaagcaagggggaggcg

SEQ ID NO: 545304 - DNA, 1005 bp, Homo sapiens
  misc_feature (1)..(1): n is a, c, g, or t
  misc_feature (267)..(267): n is a, c, g, or t
  misc_feature (393)..(393): n is a, c, g, or t
  misc_feature (399)..(399): n is a, c, g, or t
  misc_feature (402)..(402): n is a, c, g, or t
  misc_feature (490)..(490): n is a, c, g, or t
  misc_feature (527)..(527): n is a, c, g, or t
  misc_feature (531)..(531): n is a, c, g, or t
  misc_feature (533)..(534): n is a, c, g, or t
  misc_feature (537)..(538): n is a, c, g, or t
  misc_feature (549)..(549): n is a, c, g, or t
  misc_feature (655)..(655): n is a, c, g, or t
  misc_feature (672)..(672): n is a, c, g, or t
  misc_feature (914)..(914): n is a, c, g, or t
  misc_feature (922)..(922): n is a, c, g, or t
  misc_feature (937)..(937): n is a, c, g, or t
  misc_feature (991)..(991): n is a, c, g, or t
ntataaatgaaaattatgtttataaataatattagaaataaaagaaagaatgattataaaataatgtgaaatttaaaatttaagaaatatggatgaataaatggtggaaaaagtaaatgaaaaatgaaaaaataatttgtggagtggagtagagttaagtgttagaagtagaatattaaaaaaatgtttaaaaaagaaatgataggtttgattttataaaagtggttgataattgtattaagttgatgataagtgattttgaaaatntaatttataataatagaaataaaattaaataagtaatgtttatgaaggttaaaatgtatgataagataagtaatataaatttaaaagttaataatgaaaatgaaaaagagggaaagtgtaaatatnattgtnttnattagaaggaaggatgaaaaaaaatgtgagaaaaatgatgttaataaaagtagtttaattttagagggatgtgagaattagtttgaanttaattaaagatgtgaatgaataaaaagaaaaataanattntnnttnnttttggggagnaattttggtggaaaaaaggatggtgtggggtagtggagagagaaatgagattagagtaaaaaaaagatgaaaatgatatggtattaaatagatgtgtgaattgggnaagaagattgaagtatntgagaatatgagataaatgatggaagaggagaaaaatgaaaaaataaaaaggatgtgatgagagagggaattgatattggatatgaaaatgatgaaatggaaaagaggtaggagatgagaaaaaatgatggatgaataaaaaaatgtaatgaagggtgaaaagaaaatttaatatgaaaaagatggaaggaaaagattaaatatgaaaaaaaaaagaaatgagtggaaaattaatttgttgnatttttgnaaggttgatgtttgnaaagaagggaaatattataaaaatttaaaaaaaaaaataagagggggaataaanattgtttaaatata

SEQ ID NO: 545305 - DNA, 378 bp, Homo sapiens
ataagaggtggtgtctcccgcacctgtttgtcagcacctccatcacttctcctgcacaggagggttgaatactgtggtcgacgccatacggtctcgcatgtagtacggtgggaccttcgcctgcggtggggcggcgttgttgggcctggccttcgtgagcactctccgatacctcgttcttttccccactctcactattctggtaattttgctggtaattgcgtggaggaccccctacgacgtggatagcgtctataatggttacggtctgctgcatattttactgccttgaactggaacaccaccaggacccgtaacatttgctggctccggacccttttctccttcaacaacatcaaactccacagtctctccatc

SEQ ID NO: 545306 - DNA, 193 bp, Homo sapiens
tgggctcgggcctatttcctctatcgcgacgcccgacctctcatccctggcccgatcctccggagctggacctggatcggttactcgtctacgttgggtggttgggtaccctgcgtgcggacggaccccggacggtacgacggcaccccgcgacggtacgacggaccccgcgacggtcacgggtaccgacgct

SEQ ID NO: 545307 - DNA, 200 bp, Homo sapiens
attgtatgactcaggctgtatcactcctgtgtagcacagagcactgaaacgcactaggcaaggagcgcagagttcctgggttccactcatggcactatgcaggcccaaatgggcagcacagcacttgcactgctttcttcacgggagcgggagcagggtggtggtggtaaatcatatctgtgatctgggatacgtcatca

SEQ ID NO: 545308 - DNA, 476 bp, Homo sapiens
gacttagtagcggactggcgtggtctaagctcgttctgtgacagagaggtgcgcactcgatggaggtattgtccagaacagcagacaagaagggtcgggtagaattgacaggactggtgggtgacatcatatggtcccggagccctgaagcttttctccgggagctgcccagcctctggtgccaacactgctgctgtcccatttcccgttgctgcccttggggtgatagcacactcagataagaatcgcatgacaccccacaagctgggaattgtgtttgggccaaacccctgtttctggcagagcaggagacatctgacccagcagcccatgctctctacccagggcagcttggtccagctgatgctcaccaacttcaccagcctcttcccctgatgcagggaaggacgaagagaaaacatatttccggtcatctctggtggtgagaggctggtgttctgtcttgaggatatccc

SEQ ID NO: 545309 - DNA, 420 bp, Homo sapiens
gacaaaatacaaaaattagctgggcatgatagcgggcgcccgtaatcccagctactgaggaggctgaggcaggagaattgcttgaacccaggaggcggaggttgcagtgagccgagatcacaccactgtactccagcctgggcaacagagtgggactccatcttaaaaaaaaaaaaaaaaaaagtattgtaggctgggcgtggtagctcacgcttgtaatcccacatgttgggagggcgaggcaggcagatcacctgaggtcaggaggcaagaccagcctggccaacatggcgaaaccccgtctctacaaaaatacaaaagattagccgagtgtggtgtctcgtgcctgtgtgtgtgtgtgtatgtgcatgtgtatatatgtgtacacacacacacacacgttgttctgccttgtcgacg

SEQ ID NO: 545310 - DNA, 104 bp, Homo sapiens
acggccgtgtattactgtgtgagactcttgggtgattacgtttgggggagttatcgtttgaatgcttttgatatctggggccaagggacaatggtcaccgtctc

SEQ ID NO: 545311 - DNA, 397 bp, Homo sapiens
atttctggcaaggccagaggtgcgggacactgaatggtcccgcgacgcgggaagggcgaaggcactcgaagcgaagagctttaactcatcttctccaggattgggggcacgggaccctgtctcctgaccttcgtgccttacctcggagggtgctgcccacgacgggacttggtgacctcgcggggtctggtccccatacgttccggggacgaccggacactacccaggagaccacgaccggaaccgacacggaccccgggacgacggacgcgacggcagacggaccggggacacggtcgtttgcctgggaagggccctcataaaactacccctgtgttatcctcctcggctgacctgtgggggacacggcagacggaccaattcaccccaccttaca

SEQ ID NO: 545312 - DNA, 1636 bp, Homo sapiens
actttctctatctttcgccacccgacctcctgcgtgccccctccactacgggtctcctctagtattgtgtacgtcgtggtctgtcctctgtcctcgcttctccctgttctccgctctctctgtctatctgctctatcgtgtcgtgttgcttgctttttcttatctcttttctctttgcctcgtctcctccgatcttctctccctcctcttccttcccttgtctctcccctctcttccctctcccgctcttcgtctcttgttgctgtgccttgtgtgttcgtttctgcttgttctggtctttgctcttgtgggtcctgtgttgcgccgctgcgtgttcatctttccgtgtcttcgctcgcccgttccgctctggctgtgtctctcttgttcttcgtgttcgttgcttctctcgtactgtctgttgttgtatttgtgctcgattgctttgtctcgactgccccgcttctggtcttctgttgcttcgtggcgccgtgtttcttctcgtcttcgtctctgttcttctggtttgtgtgatgtcgttattgattgttgtggcgttatacacgatttattgagatgattatgacaatatatctagtaagcgttcgtataacgcctatggtgtttgtatgtcggaggctttccctgctagtggggttctcaagaatctctgtcttaagaacgggttctcgtgacccccttctaaagagatccttaagggtcttacaggggtctcccgaagaagatggctcttggagaaaatcttctttgggtgatccccttgtgtgtttagtttgaaaagcaatttagacgtgtacgccaatttacccatttttaggctttgaaaggaggaaactgtggattcatgggagaggacccggaaggccaccctctgctggagttcttgctggaacaagccaaaggttgtctggccaattccgggggaaagcagatttggataagtggacagtgacttctggataagacgattggaggcagaagtgaagtgtttttgaaaatgggcaagaataaccaatagtgcactgctatatggaactctgagctctgaggcgcctcaggacgagggagtctacccgtaagtgggatactgctgcaagtgatatccacggattcacaaggggtgcattttgaagaggaagatgtcttacgatttggtcccagcttcaataactactgtatctccgatgtaacgtgagggaatgctcaaggccatatggatggatgaatattcaaggaggatcacagatttcttccagaggacgaatcagatgtatagttacttcactgttcacccgcctgggggaccctactggcaggaggtcaagacttcctattttccacaatttttcttctctaatcgaggaaagaatccgggatgttcagcatgagcgttccgcttgataagatcatcttctataggattcaccttggctgataaagtggatgcatccattcttcctggacgatagattgttaattggcgtgtttacatgatccagcatcatacagaagaatttgcgctatgaaaattctaccagagcttaacccaggctttattaaataaagatcatactggtagtttttacttacctaaggtctaagggtactagcatca

SEQ ID NO: 545313 - DNA, 610 bp, Homo sapiens
aagcttagtaggcgccgccggaccagcggaccggggccgctttgcaccagcagcgcccgtgggcaccagccagccactcgcgtccccgtacagtagagcttgatcctggactgctgcgcggacacgcctgggcggtaggcgcacgggacagtgtcagtctgcaactaccacggtgtcggcgtgagccaagggctaagcccatctgaccgggacggccgctgcgtgtccaacggagtggggcggctaaccaggaccttacgggccctaagatactcgaggatcgggccctaagaggaacgcccggtaagactcctctggctggctgcctaaggccctagctggcctatagactcgtactctctcctagagccggccttagcagtagcgcgtaaagcctaagactggccttaggtgactgaagggcagagtagagctagttaagttcaagactgagttaaagcgattacgtagacctagaatcaaggatccttaggtgactgaagggcagagtagagctagttaagttcaagactgagttaaagcgattacgagacctagaatcaaggatcttagaccagacctgggaagctggttacctgggatcctgtgc

SEQ ID NO: 545314 - DNA, 531 bp, Homo sapiens
taggaaacaaaaggtttattgaaatgcatgaagataaattatcattaccataaaactgaaatggagatttcaacatggggacgtaaagctcttaaaatgaagcgaagcttatgcatgacacattgtccaataggaaaaataatatatatctctgtacagaaaaagtcctttaaaaacagacaatctttatagaaacggtctcttaaacgtatacagactgttaggctccccccaggtggtgaatgctagcccttctccaattgtgaacatgtatgaatgggaggtatcacacatacatggaattcttcatggaataccacgcgttgtctcaagtagcccaaataatgccatgctcataaccatcactagaccatgctactgagctagggccaacatgcggataaactccatacaaatgggcagggtgacaatcgtacatgcaccaaccagagccatgctgctcagtacagatgccttaaaacatatcattggcatcggaccaagtactgaactgaatgccattctggcctg

SEQ ID NO: 545315 - DNA, 213 bp, Homo sapiens
aggatcctatacggctctgtgtaggagtagttcctgtctagagagggtagactgttcaactgttctgctcgggctcactatagcagatggcgagcaggagtaggagagaagggaaggtaaagaagtcagaaagcttatgttgtttatgcggggaaacgccatatcgggggcaccgattattaggggaactagccagttgccaaaagcctccga

SEQ ID NO: 545316 - DNA, 1222 bp, Homo sapiens
  misc_feature (280)..(280): n is a, c, g, or t
tcacttccttattgactgaatctatattagacgtcccctctaaattcatgcatgagtactttctttattcaagagtaccgaggcatacaaacaatcaggtatccaagcctgcatctacattgccttcaccatgaatctcccttcgattgtctgccacctggcattagaacagagcatgattagcaagtgtcactcaggtaaaactaagaatgaacatagcaaaaacagaatgatacacgctttctgcaagagaagcaggatggcttagacatcagagagncaacatgcgaattcacgaagttacgaagtagaccatgtgcattcttattctaatagagacaggtcactttaagtcttgaggccttagagtgactcaagagcagtgcttgtcttgcatgtgttgtatcgaagcctcgagtggcctgtcgtcacaggtggtggactaaattagtcacttacgatgcattgtgaaatataggcttacagaatcaaataccgtaattacgttgcaactgtaacatgtgactttcacgtttagttatgcctaacaagggttgtttaacagttaccaattgcatggttactttaagctaatatgtcgtcgaaataacctcctttcgtcagaaaggtgagccttggcctgttaccgtactagtaccaagcttttcctcaagtgtctttccaacttttcccaatgccaaatagttcacgcggaaggaagacaagaccaaccagaataccacgaggaccttttcccttctatggaaactctgtttgacacacggtaagcacggttctccgtgtgtctaatacggacactgtctactttaacgacgtttgggatctcccgttttacttgttacactttgggacctatccagcctaactgggccttggggttaccctgtaaggtgtttaatcccacgtggattgcggccaaagtacaagaaatttaatcaacaaagccaacactaggaaaaaggaccaagcgttaacgtgtttcttcgaacgaagaggtgtttaactccaagaaggaattatactccaaagtttggaccacttgaaacagtcaaagggacacggcgtcgacatgggttattacctcttgccccattgcacacacttctcgcagcgggagacaaaatgtgaaccccaacatttcaaccattctgaatggtccaagcgtctaagagcaaggacctatattaaacccttggttgga

SEQ ID NO: 545317 - DNA, 918 bp, Homo sapiens
ccattgtccataaaagaagaaatccagaggacttggacttcgccgccagcagaaggctgaccgataagaacctgggcttccagatgctgcagcaagatgggctggaaggagggccatggcctgggctccctcggaaagggcatcagggagtccggtcagcgtgggaaccccctcggaaggggaagggttgggtgctgacgggcaggagcacggagaagaagacacattcgatgtgttgcctgactagaggtatgatgcaggatgtacagcacacaagcggtgccgaacacaatagttccagggtcacccccgtagaggactaacaggcatctggaagatgctctctcgaccaacgtctgggtgcttacactagtctctggcttgttttcccatcactggaaatcacttatgaagaattgtagtgtctcagggtccttgataataggcgctagaagacatttgtgatgttacagaaatggaagttttctttttagtatatgctggttctctaagatctaagaatgttgtgaatgttgtgaatcatttaagcccgttgcaaataaatgtagaggaaatgcaggtgtgagcaaaacaaaagcagcagcacccaagaccaacgaatgaagcagagagcccaggctgaaaaacgagggagggagggggccgcacgaatagtggccacacccagggaaggggccgccaacttcgggggaacatgccacgggctctcggtaacgaagcagagggacgcgacagatgacgagaaggctttacatgaaaagcgaactaacgcagaggcgcggtctgcaacacaagaccgcggggaggcaacaaaaggctgacggagcgtcagacttggcgagaagccacgcagaacgcaggagcgccaagcacagggagccaacacccgcggaggac

SEQ ID NO: 545318 - DNA, 129 bp, Homo sapiens
tatacgaagcccggaataataggatcctcaggatatacaaccctgcacccgtctccttcatatcttattcagcttcctacactattaaagtttaccacaaccaccaccccatcatactctttcacccac

SEQ ID NO: 545319 - DNA, 226 bp, Homo sapiens
acggacgacgacgacgacgacgacgacgacgacgacgaacgacgacgacgacgacgacgacgacgacgacgacgacgacgacgacgacgacgacgacgacgacgacgacgacgacagacaaaaacgacgacaatgacgaagacgacgaaatcgcccacggacgtagcacgtgactaacgcatgagacctaaactagaggccgcaagcaacactctaccagtagtcc

SEQ ID NO: 545320 - DNA, 402 bp, Homo sapiens
cgagccccaccactgcaatgatcaaacctttatttatttgttacagataatgtatttcatttgatattttcttttgagaccaagtctcgctctgtcaccctggcttgagtgcagtggtgcaatcacagttcactgcagcctcgaactcctggacttaagtgatcctcctgccttggccttccgagtagctggcactaaaggtgtgcaccaccaggcctagataatttttcgtatttttagtagagacggggtttcaccatgttggccaggatggtcttgatctcctgacctgatgatccgcccgcctcggcctcacaaagtgctgggattacaggcataagccaccgcacccggccctgaagagcttttttaaaaactgcccatcccaaaaacttaatttca

SEQ ID NO: 545321 - DNA, 1085 bp, Homo sapiens
gaccggaacgtggggcgaggcgctgttgcatcaaagaaaaagggttcttttaggtcacccaccactggtccccatggctgccgtgcagatggatcctgagcgtagccaagacgcctcttctttgaagggggccactgatggtcatcctgaagcatgcccaagggaagcagagtattgggatatgactataactcctgggagtgtcagggcccgaagtatccgggagacgtgaagcatgatcccatccagtggatcctagcttgcctccgacgtacaagcatcgtgatgtgacaaggagctatatcacgagaggacagtacggcaccatcagttatgaggatttcgttaccattatgccatgcagccatgcgaggcggctgcacatgtgactgcagatgtgagcacgactcgagggcaagacggtagaccatgtcagccagtaccacaggtagtctgagagtgagaggccagatgagggcacaagcctccaaggaagctggacgcagtagccatggcgacattagccgatatgccaaccatgaagaagtggatgtcactcaccaacgttcatcagagaagacacagtggagaagctacagaccgagaatcgacagatctgtgcctaagacgatgtgctacctgtgctctccatgaaagcacacaaggaacgcgtggggcagaatctacccgatgtggcatagagtgcaaaagctaccaagagggacctgggaccggataacgagaagatgcagcccagaagcgtgaccgcagatccgaatcacagacagatgccaaagcgagatgtccagagggtccacggcaagaatgaaaaacacagacagctggacgctacgctatgccggcacgggcccaaaaaggagaaccgccaaaacgcccaagcagtgcaaggcaaacacgatgcgcgaggagacacagcagggaagtgatcgaagagcctagcaccgataccggcgaccagagcctctacggccaaaagcaggaagaaagacgaaccgcagacgcacgatacgaggaagcgtggcaacacgagacaagaaaggacaaagcaagaggcgagagagacg

SEQ ID NO: 545322 - DNA, 157 bp, Homo sapiens
tgaggtgtactggcggcctccggatcttcactacgacaatcatgtgtcatagctgacacccaatgagaatttaccacatgtttaaaaaagaattaatacaaagacacagaaaagaaccaaagtataccactacagaaaataatcagggtaccgagct

SEQ ID NO: 545323 - DNA, 141 bp, Homo sapiens
  misc_feature (45)..(45): n is a, c, g, or t
  misc_feature (65)..(65): n is a, c, g, or t
tttgcaatagcccaatctcattttttaaatcacctagacatttgnaaaatttttcaaagttaggnaaatgcagttattaatatgcttcattcagttaacctatatctgcaaatatcctgtacaccttagtacaactggatc

SEQ ID NO: 545324 - DNA, 971 bp, Homo sapiens
ggaatcacctgtgtgtaagtcaccatgtagcggggttcatcgacctgattgtgcttgccggcctagctgaacgcatagcttgggccacttgctcgtgaacactggtgctcgcttccctcgacctgcttttgcttcactgcctcggattggtgcccctgaaccagccggggtatacacacacttcctgggcgctcactgggtgacctcggcatgctcaatgcccacgtcataaattgcttcgacgtacgccagatatatctttgagtggctcgatctgctatgccggatcctcggccgatatctgagtgtgtttgcctatctttccgagtggctcttgtgtcgcattacagtgaggtggagcgagtcgatgactgcctcaaacgtgcatgagatcaaagaacagctatgctagcttcgtggagtgtatccccgaacaacgtgaagacggccgtgtgcgagctatcccgtcgctcctgggaggcctgatagatgtcaggccaccttcatcggctacagcacgggcatccaggagctgttcaagctgcatctccgatgcagttcacggccatgttccggcgcaaggccttcctgcactggtacacgggcgagggcatggacgagatggagttcacctgaggccgatagcaacatgaacgacctggtgtcctgagtaccagcagtacccagggacgcccacgggcgacgaacaaggggaggtcgagaaggaaggaggccaagaacgaacggctttaaaaacgttcttcagaattcattcgtggcaatcccttagggtgaagctttctgttgtccttcaagccttgtcttcttacttggtaaccctattgcgcccacgattggcctctgttaaaaattcccctgtccgtgtattgatgtggcatctcctaaataccccattgccggaaaggccatccatacaaaaccttttaaacacacactcaaagatggcgctc

SEQ ID NO: 545325 - DNA, 187 bp, Homo sapiens
gtctgctgctcatgtcacccctctcgtgcgtccatggctactcgctctccttcctcatggctgcggcctgctcgtgcgcattgcttctgcagtggtctcttgcttttgccacgtctgcctggcccttgctgcaccactctgcctcacccgcctccaccattcacactccagccgttctttttttttt

SEQ ID NO: 545326 - DNA, 161 bp, Homo sapiens
gggggggggggggtttttttttttgggggggggcccccccccctccccccggggggttttttttgcccccggccccccccccgtggggggggggctttttttttttggggggcccgttttttttttttttccccccccaatttttttttttggggggggga

SEQ ID NO: 545327 - DNA, 334 bp, Homo sapiens
tcataggttcgcaggaaggagacatttggaaagaaaatgaaatgagaatatgaattcgcctacagaaatcaaatcaaggccagtcttcaagtactccaacagctgtgtcatgaaccttctacaatgtcattaggaagaagcagaaacaagctcagctgttggtcaagaccaagcctgccttttatcttactatatgttatgctcgtagcagagtaatactataatactgtgcataattacgtgttacctgttcgtctcaataggagctattctatctagatcaatttaaactgtgaagtttcactatacatgaaggattaatacaagttactct

SEQ ID NO: 545328 - DNA, 370 bp, Homo sapiens
cgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactctatataaatatctcatggggttgtatattaccattaggcgttgttgtatgttacaaaaatcttctgatccagaaaacgactgctgtggcactcaaacatgtcccttcgacctttcatggtgcatgtgactgccgaacttagcatagaatatgataccctaggtatgctacactgcatcc

SEQ ID NO: 545329 - DNA, 107 bp, Homo sapiens
  misc_feature (76)..(76): n is a, c, g, or t
ccgctctaccacaggcccctaggtgtggcggacctttggacatataaaggaagcagttttagtatcagaaaagatntattagaaaattctcacgctgaactggtgta

SEQ ID NO: 545330 - DNA, 1184 bp, Homo sapiens
agcggaatcggaagataggcaggatttaggaatctatttgaaatattcattacctattttgaattggtcttaccaatttaacagaacatagtaaagctggataattaaagaataaactaactacacacggaacgaactgcaacggttatctatgctgtgacacgcaacctgagacttacttactgactccttcggcggcacgtcgacacttcgttctctacgaacgctctctcgtccggccacctaccaggcagacaacggaacgaacgaacaaactgaccctctggaatcgaaacaactttcacagttacctccactctaacccacctatgcaatgatcagtccttagtctacaccacaccccaagccccatcactctgctctgccacctcgcgcagctcagcacctcttaaccacaaagacagatcatctctaaccctagcccctcactagactaccctgaacgcacgcgcctaatgacctgaaaacaagccaacacactaaacctcctctagccccttatcccgccgctgacgcgcaccagcagcctatcctccccagcgcctctgcacactctgcaacacactccacccctgcgacacgccgcggacctcccgactctcccataccacgcgaacgcctacgagatatcaccccataaacgcgttcccgtaccactctacgcacgaatcacaccacaaggcaaacgaacctctcctacctccacaccgcaacgccaacacaacctcctcactcttgcacccaaacccactccacctgcacgcaacccacactaccaactggcagccacactcacacccgctctccccacacggccttacctctcctcaacttcacacatgctccacctcacgcacaacgccaccaaccacgcccacaaacacgccgacacaccctccacggcgcacccacacactcacccacttacacccctcccgcgcaagccaactcctggcaacccaccacacacgggctcacaccacacacagctcgcacaatcacactagcagcatcgcaccacacagcacacacacatcacccatcgcgcccagcaccacatcccccagcacaccggcacatcgcgccccacaccccccccacaacgcacaacgcctcatcacccccacacacacacgcccgccaagcccacatcccacgcagag

SEQ ID NO: 545331 - DNA, 115 bp, Homo sapiens
tggcaagcaccgtatattatggaggctctgtgactgggcactgcagagctggcagcagctgatgtgatgcttctcgtggtggtgcttcctcagccgaatcgtgcacatcatcaat

SEQ ID NO: 545332 - DNA, 694 bp, Homo sapiens
cttaaagccatagattttattccagaaaggagaaagtacatggcattaataaaccacacatgccatgaattttagaacactaaattatttttctctggcttatcaaccagttatatccatgggctgcaaattatatccatgacaaaattgataacattttgcaacatgtcaaagaaagaccaacatttttgcctgagtgtcccactaatctttatctagagttattattcttggactttctacaaaagtttcttttcaaataatttatgaattacaacaactggaaagaatactgggagaacctgaatacttcaattaaacacttgaaggaacaattttcctctttaaaccaatttttctggctgaaattttatattctaaaataaccccactcctttattttttgaggaagtggccaaataaagggggatttctttggccgcacaaattccaaggcaaaacatcttcattctttaatggtctaaccaaaagttcttgccctgcaactcaaggcttggtgaaataaacttggtctcaatgagagagaccttttcccaagttaaaaaaacttgaaagcggtcttggaataagaaggacttgttaaggccctataaaaactggcgggattatagggttaagacaaattgcattttttttccccacaatttgtttgccggtagtgaacctttttaca

SEQ ID NO: 545333 - DNA, 163 bp, Homo sapiens
ttattctgctcactcctaatagtggattaaggtgctgtagcacactggtgatgttgatttagagagacggcgtcacatgttgatcaggttgactcgaactctaactcagtgatcaccgcttggctcccaagtgtggcattcaggcgtgagtcactgcacgggc

SEQ ID NO: 545334 - DNA, 387 bp, Homo sapiens
  misc_feature (380)..(380): n is a, c, g, or t
aaacaatggagaataattaatgacatcaaaagttggttctttgaaaagattaataaagtcagtaaatcctacctagactaatcaagaaagttaaataaaaggggggaaggcagaaataaattaccaatattgggaatgaagaggagctatcttatagttccttcatatagtaaaaggttagttaaggaatgttatggtcaaactttatgtcaacaaattcaacaacctagatgaagtgaacatatttcatcacaacttatcaaaactcacagaaaaaaatataaaaatctggaatagtcttttgtgtattctagggcccagatgtcttcacttgtgaattctagccaaacatttaaggaaataatgcccatcttacacanacttttc

SEQ ID NO: 545335 - DNA, 340 bp, Homo sapiens
ggttcctctccttccacagggagatgggtggtgcatgtggatgcagcccaggccttcctgctgctctcggatctgcgtcagaggccagagtgggtacttatagcactatcggagcgtgcgagctagtgtcagcaggtagacgaggacgacgccatctaccagtcacagtccctgccctcggaggtcacagaaagccccaggacttcgtgatcctggtctcgagggctggacgccttgtgactagagtggtggagcccctatgtcagtcgcgcgtagaggtcggtcacgctgcccaggaccaccgagagacgccagagtacagaggcggagagaccctctg

SEQ ID NO: 545336 - DNA, 100 bp, Homo sapiens
ggtcaatcagcagcaccaagaccccctcacacagtactcccagatacactagcatcaatcagcaccacatgagatccacatcacacagtactccacagct

SEQ ID NO: 545337 - DNA, 538 bp, Homo sapiens
tcactttttttctagatttaaggtcttgaatcataaaatacttaccaaaactacctcacacaaaatattacctatgtaaaaatcatcaagtcgatccacgtacgcatccatagaactcaaaagcagaatccggaaacccaaaacagaaagagtcacatcaaccggagaagacacacaacaaggagagagagaagagatagcacgaagacaagagaagcgcgcaagagcacagaccagaaaaacgaaaaaaagcgcagtgcagcaaccaacacaaggaagaagagagagcacaggaagagcagatgagataacgagaagaagacaagaaagaacgaaacgacaacagcgaacaacaacaaacagaacacaaaagacgaaacacgcaaagaacagaagaaaaaacaaacaggcgacaaccaccaggccgacgagagcaacaaaagaaaagacagacgaacgagaaaaaaaaagaaggagcacaagacccacaacagagacaggaccaacagagacaaggagagagaacgagcgcccacag

SEQ ID NO: 545338 - DNA, 266 bp, Homo sapiens
cccccttgtggcttcacaacaggtgactcggaaagcaaaggcgcttggctaagctggtggaagctatcagggccaatttccaatgacagattcgatgagatccccccgtccctggggtggcaatgtcctgggtcctaagtttgtggctcggatcgccaagctcgaaaaggcaaagggtaaagaacttgcccctaaactggggtaaatggaccctggtgagttttctggacataaaaataattgaaataataccaattttccttcca

SEQ ID NO: 545339 - DNA, 352 bp, Homo sapiens
aggatatagcaaaaagatagaataatacatggtcaagaatataagaatcggatggatacttatcctctacttaacttgatgcatacaaaagcaacgactggataaaaatcaatgtaaaaaagaaaaatagatacccatgccaaaatacaagggtataaacagccaacagagccaaacttacaaagaaaataaaagactagtatctggacagtgattttattggtacagatataagacatataggctctataaaaaactcaggtcataaagccctaagccttattaatgtattgctacagtctctttcttctaaggggaagaaaatctccccaagaataggatgctacctgag

SEQ ID NO: 545340 - DNA, 115 bp, Homo sapiens
ctgcatgtgttgactctatgagtgattccccgtgtgaggctgagtgcagtgagaatctgcttgtaacctagtgagcctggagtgtgtgtagtaatgtggtgtacctgatgctcga

SEQ ID NO: 545341 - DNA, 359 bp, Homo sapiens
agtctaaaaaggacagagtcactaagtagtcgtcatccttaacactgtgcatgcagactactgtgactctttcctttttagactcacatatcatcgtctcatcatcccatatcatggatcactgccctgttctctccttccttaccctcttcttggaattggaagtatttttcaaagactgaggcaaaacaatttcgcttcaacatgccagcttgatgcacctatggagtccttggtatgccgcgaagtattttcaagtgtcatataggcagagcagtacattgtactccttgattctggtatttaccaggtaaactcccgatagaccactctttcaataactcatcctccatggctgg

SEQ ID NO: 545342 - DNA, 720 bp, Homo sapiens
  misc_feature (104)..(104): n is a, c, g, or t
gacagcaacagagccttggcagagggacggctctagctcagtgtagcactaacagcaccattatcgagcagcgccggagggatgtagggatgagagagtgtgcntatgggccgggctagaacagtgggtcagggccccccacccgggaaaaccaacggagtcctaagacgtgtcttattttcttgaattggttggttgctttgtgggtgcgtctcataaggtccttcctttgtttgcttctttctgtctccttgttgcggtgggccccgagatttgtagagtgtgctcgtttgtctggagggagccttggtgccaagcttgtccatggggcgaggcctgggtctctcctctcctcaggactggagttcacacgaagtcggtggcattgggaaaccgggtgcacagggacggatttcctcgtggctggcaatgacactatccttcccctggggaaagcagcccacgggttctggagtggaggtcttggctggggtctgtgggacccgctgcccctgcccgccccttcccccggcttgcacggttgccgcgtcgctggaagaatgaatggaattgcctgggaatccggggagcgtgaagacacccgggacctcagggaacccgtgacttcgccctcagggtcggtcccgtcgcgccaggataggagccgggctctggtggggctgccgagagtcggagtgggacccggacgggctcacatga

SEQ ID NO: 545343 - DNA, 1167 bp, Homo sapiens
ccaccaacaagcacgaaagagttaggaagaacgagtacgggtgtgtttatttcagttacgaggcggggggttgtcctcataccggatggatcagcaggcatgacgattccgccagctgcctagtttcctccccctcctcttctccctcctctctcctcttcccagaccacctccttctttcccgcccctgcgcttcttttcccttacccatctgtcctccctccctccccatcatgcccatcatcaacattacaccatatacatcacatacacaacccaaatacacacaccacaaacccaccacatcacaaacaacacacacacacccccacacacagaaacataacacagacatacacacactaaaaaaacaaaagaaacaaccagaaaaaaaaaccacaaaacacacaacacagatcctcccagactacattcaacttcccattccacctcctccccacgccatcccatacaaaacaaactgcaaacaaactagaccctacaccatccacacacctccaacacacaaacaaacatgacaaacaaccactcacgaagccaacaaacaatcacataccgctctaaaaccacagacaacaacaacaacaaccacaataaaccatcacaacacaacgccatgaaataattaactacagtaccacaccacaactccccatacatcaaaaacaaaacgaaataactaactaacacaacaacctaccccgagagcaaactcatcatcacataccacaacactcaaccaaacgaacaataaaacttacaaaaaccatcaataaactcgacaaccaaacaaaccaaagttacaaatagcaaccatcatacagtacacgcatacacactacatcatgctatcacgagcctaccccaccagataaacaaccaagactcatatacacgtcatcagtaaacaagatatcacacatatatacctacataacgcgacactattacatctactcagtatcatacactctgacacatccacagtagatctcacacactcagtaacgcctacagcatagacaccacacaccacactactaaccaacgaaccaccaataccaatacgccaacggcaaactcacaacgccacacaaccagacaagctcactacagacttgccccacaagatcactcctccacaca

SEQ ID NO: 545344 - DNA, 671 bp, Homo sapiens
  misc_feature (268)..(268): n is a, c, g, or t
  misc_feature (292)..(292): n is a, c, g, or t
  misc_feature (308)..(309): n is a, c, g, or t
  misc_feature (312)..(313): n is a, c, g, or t
aactgcatccgttggaaaaatgctcgtcaaggttttcaaaagtaaaacaaaagacccaagttatccggccagttcaatttaagaagtgtttttctcccagacgcaacgccaaatttcctttaaggccttcgccaatccgggggccccattttttgccctcttcttaccccaatttttttgtattaccctcccaaaaaaattttttattgagcactttgcggcggaaaggcggcctctcccctttttttttttaaattttaaataatcnaaattaattgtttgttgtggggtnaaaagcaaagtttttnnatnnaatttttcccccatcccatcccccccctggattcatttgagaaaacttgaaaaatgttttaaaactccccctgctgcatgtagctcttgcttatttactggtttgggaaacaggatgtgtttcctttttttaaaagccaattgacagattacccctaaaaactcccccttttggatcattcacccctttgttttaggtttggtaagttttaaaaaatttcaccaccaaagttgttattcagtgggcccaatggactccaaatcccccaagttatgtaaacctgtcccaaatgtaaacttcattgtcctttgttggatgatattttaaatggaaataaaataaattggtttaaagggca

SEQ ID NO: 545345 - DNA, 930 bp, Homo sapiens
atctcacgatggagcgggaccgacagcagatgagggatatggccttgagattccagacctgctacatgcaccgtaatcgtcgaaaacatttagggaatgggagttatgattctgaagaaattatcaagatattaaaatgagtagaaatttttgcagtctaaatgatggtcatattccgctagaggacgtgcaagaggtaggagactactataagctgtaggaccaagcactgttgtgggcaattggagagctaagagcgagttgagatgcaagtgattcagatgaggaatgtgagtgcaggtggcctaaagtatgtccttcatgtttgatatctgaacacataatatagagttgtgagaggcttgcaaattatattgcatggattggatggtacctgaagttgtcaaagatacgagaaacatttgagtactgacgagttctcttatgatgatgagagttgtgcagtttgcgtttccaaaacaaatggtgttgatgatacttatttgtaaaaatgaagatggcttttcattatccattgaagttgctacccatagatagatgtgatctgcagaagttgtgtagtcttcatctgaatttcaggctgggagggagcaatataactgaggtccagacttgatggttgttcgctctcggtgttttatgctcacctacttcccgtttgggtactggccgtacctgtttcctgaagatgctgggggttcttggggctgtggtaatagccacctgctgccgggcttatatcccacatggctcgttaaccttaaccggtggtcctcttaccgaccacgcccgggccgagtcgcgtccccgcgggtcccatttttcctgggcccccggccgaaaccgtgtgtttttgttccccatcttgggagcggaggggcccgggacctgggcgtgggcgaagaggtc

SEQ ID NO: 545346 - DNA, 858 bp, Homo sapiens
aaactacgggtccaagacgggtatttgcagaggagaacaagtggggtgagaaggccgtgcgctttgccacaagatctcgttgtcaaaaaaaaaggcccgttacccctatgtgaagtctggtagagccagttgaagctgcaccatgtgaatcccggcccccaacgccccctgggtgtatatcccccgcaccccggccaggagcgaggcttccgcattttatggaaatcgaaaggggttaaccgccctggacccccatcggctttatggttcgacccgccacgcctccgtccaggggtatctgtcgaacagacacctaaagcatactggcgaataaacaaaggcctgctcgccccaggtggaacgagcgccccccaggccaagggggaagcagagccccgcagcagcacctgttagcgaccccggtgacccctccgtaaaccccgggccaagccgaagatgaaacataactggaataaggcgaacaaacatgcaagaagaaacccccagaggacattgtaccaacgtgagaaaagatgggatatcctcaatagttgatactttcgcaccccttacgactcccagtgtacgagagagggaatgagcaaacactacatccattcttccctatgggagagacgatacatgtggatccgcccacatatccgccaggtctcacgtctgcgaacttgctaaaactgtgggattatcggtgccaccacggcaacaaactcgggttattttagaggataactactctggtagacccactaccctccatcgaacagtaatattggtaccatttaactgggcgaatttgggaaggaacatattgccaacgggtataaacaataaacaaga

SEQ ID NO: 545347 - DNA, 1007 bp, Homo sapiens
gcacgaaggaacttaattcagagtccgtgagagcaatgcacggaagcagaaccaggctgctccccctcctggctctagaacatcactggcagccactgctaacgggagggacaaggctggtgggatgccaggactcagctgggtgccagtggctcctgtcctcttccccgtgacattccggcttgccttatggcgggacacccaggggcagggaacgggaaatgtcaggtgctgttagggaaacacagcctgaggaagcccccagggagagacacgctgggacatcccagacgttacacggacgctgggcacacgagaagacttgcttctctaggacgacaatggtctcataacgaacgacaggacggacactcactaaaccaaccagaaactgtattctctcatagcttctggagaccagaaatctgaactcagggtgtaggcagagctgcactccctctagagattctagggggagacttcattctttccccatgtgcgacaacggccgggagggatgccaggcaccgacctatgcacctaactgcgagcaacagatacaggatgcagaggcatgcaatggtggcccccagccgacatgcccactgcgcatatgttgccccagaaaacgtgagaactgttgacttcatatggacacaaccgggctcctccacaacaccacgacttaccttcagggaacccctgcagcactgagactgcatcctggcttaatccagggctgggccactggcacatcaaaagcacccgtggaccttgcaacgagcacacagaactaaccccaccccacgtcccaccaagccggccagccgcagaatcggacgtgcccgccttgcccaccaatcccacacacgcgtaaccatggcacccggcccacccacctctaccccccgcacccgacgcaaaccacacggcgcatggtaaacgagcaccgtcccacaacactcctcggctgccacacgcccccggcgacctcgccaccaatccgc

SEQ ID NO: 545348 - DNA, 1011 bp, Homo sapiens
aaggcagaggggctccaggtcctgtttccagctcccctcactgcacatggtgaagctcgctccctccctcccctcccttcccgcttttccccagagctaatacacaggtgctattattcagaaaaaaactggtcagctctagccaaagtgaggtatcatgtttacttctgccctagctatgtgtagcctcttatgctgaagtcggctactgctggctcctcgcgctttcagagcccctgacacaacgacacacaggatctgtccctacccagcaccagcacaactggtctgtagtacttgccacaacgcccctcataacgccctccggcttgagggcgcagagtgtctcgctcatgggttctgcctctgtgcccttgctggccgcttctcctctgccttctttctggatctccagcggtgtggggactgagcctgtacagggacctcatgcacgacttgcatgtgagacaactccacaaagatgtgaccctacttcccatcttacacacatcaaggtgtctctggcacaggactttgggcacctaaagactcccatgctcgagtacaccagggctatgtgcggccccacccgttgtatccacgcctgctcccttagcaagcccgaccgtgctctcagtcaggacacctaaaatgctcgttgaaggagacctgggcagccagtcaagaacagtggacaggcaggccagaagaagcggttgtcccacataggagactggtgcgtgcaagcacaggcattggccgtccaggcctagaatgaatttaccccacatgcggcctgcaaagatacctgacgactacgtcactgaacttcacggaaggggtagtgacgggatcgaaagcagagccctgtcggacgacacctagcacaacgcctccgaaaggagaaacttacaacccacgtcccccaacaccacggtgcatcagccgcaacgtgcacaaactacacgtaggcacatagcagagtcacacaacttccacctttgtatacac

SEQ ID NO: 545349 - DNA, 963 bp, Homo sapiens
attcgcggccgcgtcgaccttcagcatgagcatcaaccagtatccttgtcaggtggcccccattcctctacattcctggatggtttgggatcccacagaactctaatgattacataagaagagtggcccgtcctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaacaaaaaaaaaaaaaaagggggggcccccacaacaggccatagcaggggagagaacgaaagacacccacaacaaaagcaacactaggagaggacaaagaaaagcaagcaaaaagaacaacacagcagcgcgggaggacacaacagaaggagaagaacgacacaccaacaggcagagagaccgcagagaagaacaaaacaaagggaaggagggaggaaccgagccgacaacacacgcccaacacaaagagcgcgagcacaaacagacagaaaacagaaag

SEQ ID NO: 545350 - DNA, 745 bp, Homo sapiens
  misc_feature (602)..(602): n is a, c, g, or t
  misc_feature (634)..(634): n is a, c, g, or t
  misc_feature (643)..(644): n is a, c, g, or t
  misc_feature (646)..(646): n is a, c, g, or t
  misc_feature (650)..(651): n is a, c, g, or t
  misc_feature (662)..(662): n is a, c, g, or t
  misc_feature (680)..(680): n is a, c, g, or t
  misc_feature (686)..(686): n is a, c, g, or t
attcgcggccgcgtcgaccttcagcatgagcatcaaccagtatccttgtcaggtggcccccattcctctacattcctggatggtttgggatcccacagaactctaatgattacataagaagagtggcccgtcctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacaaaaaaacaaaaaaaacaagaaaaaaaaacaanttgtggcgcgccacctagggccctggaaaacntttttaaanncnattnngttgggcaccngggccccagtatgttacntgaacnctggccaaaaagatgtccccaagaaaaaccctggtcagagcactggtgctgatttcccc

SEQ ID NO: 545351 - DNA, 920 bp, Homo sapiens
attcgcggccgcgtcgaccttcagcatgagcatcaaccagtatccttgtcaggtggcccccattcctctacattcctggatggtttgggatcccacagaactctaatgattacataagaagagtggcccgtcctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacaaaaaaaaaaaaaaaaaaaaaaaaaaaaaaaaaaaaaaaaaaaaaaaagggggggggcataaaaaaacgccaggagggcgcaacaacgcacagacaacccgcctaggagaaaaaggggaccacaagagagggacaatacaagcaacgaaagccagaccagaaaacccccccacgaggaaaacaacgcgcccgaaacacacgagagaaaaccaaaccccagagagggagcaaacaaaggagcacacacacaacgacagacacaacacaacagaagcacaacaccaccaggagagcacaggaaaaacaagcgaacgccgccacacaaaaagaccagaaaaaaaaacaaatcgg

SEQ ID NO: 545352 - DNA, 131 bp, Homo sapiens
gaggcaaacgggaaaggagaggaatgcttaaaatatacagtgaaatttgagttggattctctactcaaagacttctctgggaaggtgtccagaagttgaccacacagtgtgctgacgagtagaaacgaaca

SEQ ID NO: 545353 - DNA, 706 bp, Homo sapiens
attcgcggccgcgtcgaccttcagcatgagcatcaaccagtatccttgtcaggtggcccccattcctctacattcctggatggtttgggatcccacagaactctaatgattacataagaagagtggcccgtcctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagtccatttcagacctgcggaacaaaaaaaaaaaaacagaaacacaagagacgtcagacaacacgcagacaacgacaaaagaggtcgaccgagaggaacaccacgcgcacacgcaggaggagatcgccaaagcgggcagggagaagtgtagacgggagtggcacagcacactaggaacaaagaagg

SEQ ID NO: 545354 - DNA, 952 bp, Homo sapiens
  misc_feature (54)..(54): n is a, c, g, or t
accaaagaacaacccatggcagtgatgaggccgtgcggctaagcgggcacgagngccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaaaaaaaaaaaaaaaaaaaaaaaaaaaaaaaacaaaaaaaaaccggggggactaatttgggggggggggaaaaagggggtatagaaagggcgcacagtgtggacaaaagcagtatttacatgagacccagattttttgtgtgtacccacggggggaaaaatcgaggcgggtcccctaatataggaggacgccgcctatataatttcacataaacccgggtgtaacccgggcggtatataatacgtgtgcggtagacaaacctcagcaatgcaagccgccgctaatgacagagccggacagagcgtagcgatagcgcgtatgagagagacagggggatgagccgacaaccagtagtatctgctacgcagagcaacaaagccgcgtggcacgtaaagtacgagcacgcaaggatctcatacactggtactatgtagaccagccatataatccaagcgagcttctttcttataggcagag

SEQ ID NO: 545355 - DNA, 383 bp, Homo sapiens
  misc_feature (304)..(304): n is a, c, g, or t
ggtcggacggcacgttgctggaccaggaagtcggtaggcggggtgtggatggcgcgcaccccttcggtgttctgggccaccaaggaggtgacgacaaccatcgcatatccacctgccgcgacgattgatttggtgtcggctgcggtgccagctccaccggacggatcggtacccgcaattgacaggacgcggggaattgttccccgctcggcaagcgcatcactagtggtcatctcggacatcccttcgccagtacgaactagatcaggttccacgggtgtgatctcagcgccaccgaggcganccccggtgtccaaagaccagtatgtcaccccaccacaacttgcgctccgccgctgaaaaccgaccgaacacctgcaaaa

SEQ ID NO: 545356 - DNA, 945 bp, Homo sapiens
gaccacgcgtcgggacgcgtgggtcgacccacgcgtcgccacgcgtcgccacgcgtcgaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaaaaaaaaaaaaaaaaaaaaaaaaaaaaaaaacaaaaaaaaaccggggggactaatttgggggggggggaaaaagggggtatagaaagggcgcacagtgtggacaaaagcagtatttacatgagacccagattttttgtgtgtacccacggggggaaaaatcgaggcgggtcccctaatataggaggacgccgcctatataatttcacataaacccgggtgtaacccgggcggtatataatacgtgtgcggtagacaaacctcagcaatgcaagccgccgctaatgacagagccggacagagcgtagcgatagcgcgtatgagagagacagggggatgagccgacaaccagtagtatctgctacgcagagcaacaaagccgcgtggcacgtaaagtacgagcacgcaaggatctcatacactggtactatgtagaccagccatataatccaagcgagcttctttcttataggcagag

SEQ ID NO: 545357 - DNA, 138 bp, Homo sapiens
  misc_feature (17)..(17): n is a, c, g, or t
ctcacctcgacgctcgntcccggttggacgtcattacaacgctgttttggcctcagcagaacttgttgccttaaaaatgttctgccgggccgagttgtattggctccacgctgtatcaccacttgggggctccagtgt

SEQ ID NO: 545358 - DNA, 481 bp, Homo sapiens
tgggacggcaccacctcagtgcagctgctccgtccccttgcatgtccccttgtctcccaaaggctccatgtccccttgggccaggaaagaggaggcactgccatgtcccattgtctacaaagtcctgtgcaggctgcacgccaggcagggcacagtccctcctcaactcaccagcagaggctgtggctcctctggcaactctacagtcacacctgttagctctgccagctcctgaccttggatttcctgctcagagaccggggtgggctgcaagtatctgtaactcagggtctcgtggcgggcattgtcctccgccccaggaactcgtgaaggacatgaccgccgccggaaaaggaccttggaaagacaaagagcccattcaagtccacaccctgggctcagcttcggggtccccagtacacagctgggacctgccatccccaaccccccttgaatgggagccaggggttgttgttctttt

SEQ ID NO: 545359 - DNA, 966 bp, Homo sapiens
  misc_feature (217)..(218): n is a, c, g, or t
  misc_feature (222)..(222): n is a, c, g, or t
  misc_feature (237)..(237): n is a, c, g, or t
  misc_feature (242)..(242): n is a, c, g, or t
  misc_feature (246)..(246): n is a, c, g, or t
  misc_feature (249)..(249): n is a, c, g, or t
attcgcggccgcgtcgaccttcagcatgagcatcaaccagtatccttgtcaggtggcccccattcctctacattcctggatggtttgggatcccacagaactctaatgattacataagaagagtggcccgtcctctctccggtccgtgcctccaagatgacaaagaaaagaaggaacaatggtcgtgccaaaaagggccgcggccacgtcagggggnngccncccttaaaatttttnccccngggnccntgccacgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacaaaaaaaaaaaaaaaaaaaaaaaaaaaaaaaaaaaaaaaaaaaaaaaagggggggggcataaaaaaacgccaggagggcgcaacaacgcacagacaacccgcctaggagaaaaaggggaccacaagagagggacaatacaagcaacgaaagccagaccagaaaacccccccacgaggaaaacaacgcgcccgaaacacacgagagaaaaccaaaccccagagagggagcaaacaaaggagcacacacacaacgacagacacaacacaacagaagcacaacaccaccaggagagcacaggaaaaacaagcgaacgccgccacacaaaaagaccagaaaaaaaaacaaatcgg

SEQ ID NO: 545360 - DNA, 228 bp, Homo sapiens
tcagatggacagaaatagtttctttaggattgatctcttaaatttgactttgggaagatactggcagtccaggttttgtgacagagatccatcctggagatctttggtaaaatggacaaaagccttgaaatgccagcggtttctttattggctaaggagagtttgatgggatttcaggacaaaatggggaataatagtagattgttgcaattgaattttgtttgactt

SEQ ID NO: 545361 - DNA, 522 bp, Homo sapiens
attcgcggccgcgtcgaccttcagcatgagcatcaaccagtatccttgtcaggtggcccccattcctctacattcctggatggtttgggatcccacagaactctaatgattacataagaagagtggcccgtcctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccacctgccacaaccaggttgtggcaggtgtgattgctgctgtgccatcgtcctagtccacctccacgccggtcc

SEQ ID NO: 545362 - DNA, 1292 bp, Homo sapiens
cggacgcgtgggtcgacccacgcgatcgcaggcctcagcagggaatggggcgtatatgttagtgttgctgcaacaattaaagcctgttgcatctctcatgccaaaaaaaaaaaaaaaaggggcggccgcccatttttttgtattattgtattttgtccccagaagaagggcattttttttttattccaagttacgtggcaaattgggaacccaaagtagaggggccccccagaggcgggccgagcaagatctcgagggtaacccgctctcgccaaaagagaaacagagggggaagggaggggtggcccgtataaacgccgttagaggggtcgaatatgcgggccgccgtggcgcacaacatcgggggacacaggaatccaagaggggcgaaaggagcggcccagaactactatcaccggaggagaccacgtgggcgagatgaacgcggacccccccacagaccttagcaagatgcgcccaaaaccacctgttatccccccaaaaaagagaagtaatctcagggggaggaaggcgaaccagggggcgcaaaaacaaagagggacggcgacaaaagaggagatcagaacctctatcgaggccgacggggaacaaacccgcccgccctatggcggaactttgccagacaaccagcgggaacacatggggaccacaaaaatcacagaccaaccactggcgcgccaaagaagagaataggggaagaacaagagagcgaaaaggtgggcgaagcccaaagaaacactagaaggggccaacaggagagagaccaaagcaggaggcgatactagaacccgagaacacccgatagaacacccgcgatgaaaaaacgggggagccccaagtagacacaacaagacgagaaactgggataacaaggggagcgaaacacagacaaaggagagggaggaagacacccccacgaccaccctcagaggaggcggcacaaggggcagcatgtagggcccaacagggaagcaaggagacgaggaaatacacacacaacgaaaaagggatacaaacgcccggggagataaaggggacggcgcaacagggaagaaggaaagggccacccccacggccatggacagaggggcgcaacacagagggacgagcaagagcaccgtacaaacgccccgggtaacaaatgcgcgaaacggggaccccaacggaacctcgtgcaaaaggggcacaaaagacaaagcagaacgacgaagaacagaaaggcaaaagaaaacacaaagagacaagaaaggagacgatggggccgcggtgag

SEQ ID NO: 545363 - DNA, 105 bp, Homo sapiens
tctttctttctttctctctctttctttccgtctttttcttttcttttcttttctcttctcttttttctttctcttttcttttctttccagggtctatgctatgct

SEQ ID NO: 545364 - DNA, 617 bp, Homo sapiens
attcgcggccgcgtcgaccttcagcatgagcatcaaccagtatccttgtcaggtggcccccattcctctacattcctggatggtttgggatcccacagaactctaatgattacataagaagagtggcccgtcctctctccggtccgtgcctccaagatgacaaagaaaagaaggaacaatggtcgtgccaaaaagggccgcggccacgtacgagatcatgtgcatgatatgtgctggaataattgtgacctgaatggcgtgcccggggacaaggcgcagtgatacaagatacagtactactcccgattgaacaagtaagtggagggcagtaactgtctgggaacattagggatcgcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgt

SEQ ID NO: 545365 - DNA, 446 bp, Homo sapiens
  misc_feature (306)..(306): n is a, c, g, or t
tttacgttccacgctagttgggcgggtgacggtgacgaggattgcttgagccctgggaggtgaacggctgatgtgagccatgattgtacccctgtgctccattctggtgtgatagacgcaagaccctgtctcaaaaaagacacggaaatgtacagaaaaatgttcaagcttttcacgaacgagcaggatcgaccacaaaaatacttcctcttggccaggtgcgatggatcatccccgtgatcccagcactttggaaggccgaggcggccggatcacctgaggtccggagttcaagactagcccggncaaacacggtgaaaccccatctctacaaaacataaaaacttacgccgggcatgattggcgggtgcctgtaatcccagatactcagggggccgaggcggagaatcgcttgaacccgcgacagccacgcctggggtaccgag

SEQ ID NO: 545366 - DNA, 165 bp, Homo sapiens
agaatgtccccagtaggatgcactgagtcagagctaatggattggtgacaagcgctgaactctgcccgcagcacccggacccttcaatggcagcctgcatgcaggtgcccttccttgcagcacaagcctcgcccgaaacagaacgcctgagagcagcctcgacgg

SEQ ID NO: 545367 - DNA, 233 bp, Homo sapiens
ggctaagtctctaatatatgtctttggcaatattagttttctttaaaaatacaaaataggccgggagtggtggctcacacttctaatcccagcactttgggaaaccgaggcaggtggatcacctgaggtcaggagttcgagaccagcttgtccaacatggcgaaaccctgtctctactaaagatacaaaaattagcctggtgtggtggtacgcgcctgtaatcccagctactc

SEQ ID NO: 545368 - DNA, 118 bp, Homo sapiens
  misc_feature (24)..(24): n is a, c, g, or t
tcgagctccgttccgcattaacgngctaaatatggtattgtgatggatggaggttccagaacgtgttaaatatggtattgtgaccccccatctatcacaataccatatttaacacgtt

SEQ ID NO: 545369 - DNA, 223 bp, Homo sapiens
tttgggcccggggtgaaaaagggttaaaaaagatttttttttttaattttgggaaaaattccgggtttttttgtttaatttaaaggcagggggaaaaatttgttttcaaacccagggaaaaattttggttcatatattttaaggcaaattcccttgtagggggttaggcaaatttttttaaagggccccccggtttaaaaattaaacttttttggacttttca

SEQ ID NO: 545370 - DNA, 245 bp, Homo sapiens
ctcgactctcgagtatcccctacggccggtgctctagctactggtgatgctagaggtgatgtttaggtaacaggcagggtaagattgccgagttccttttacttttcttaacctttgccttatgagcatgcctgtgtttgggttgacagctcgagggttatcaattgacttgttggttgattgtcgatgttgggctgtttattgtcagttcagggtcttaatctgaccgcaggcttatgcggcgg

SEQ ID NO: 545371 - DNA, 326 bp, Homo sapiens
  misc_feature (48)..(48): n is a, c, g, or t
  misc_feature (244)..(244): n is a, c, g, or t
  misc_feature (259)..(259): n is a, c, g, or t
  misc_feature (268)..(268): n is a, c, g, or t
  misc_feature (271)..(271): n is a, c, g, or t
  misc_feature (292)..(293): n is a, c, g, or t
ctatgtgtattgattttttcctaagttgggtgtgcctgccttccaggnaaacaaacaaaaaaaaaaaaaacccaaaattttactttaacctgtatgtgtatacatacctgtgtatatataaaaggtcaatttatatatttttctatagaaatggagttaaaaacaaaaaaaggtttttttcccccccctttaattctcccatatttatttgtccatagtaaaatggccacattgatgataattnttccttttaaagggnaaaaaaaanccntttaaggggtttcttttcccnnttgggagattgtcagccctttgtctaaaataat

SEQ ID NO: 545372 - DNA, 310 bp, Homo sapiens
  misc_feature (252)..(252): n is a, c, g, or t
cagacctgggcggggctcccactccatgaggtatttcttcacatccgtgttccggcccggccgcggggaggccccgctttcattggccgtgggctaacgttggaccgacacggagttcgtgccgtttcgacagcgacgccgcgagcgagaggatggagcgcgggcgcggtgtgatagagcaggaggtgccgagtgattgggaccagagacaagaatgtgaagtcccaagtgacagcttacccagttgacctngggaccttcgcgctactacaaccagagcgaggcgagtctaaacatcagataattatgc

SEQ ID NO: 545373 - DNA, 461 bp, Homo sapiens
  misc_feature (29)..(29): n is a, c, g, or t
ccactcctgttgacagtgcgcctgaaggncgggcgtgctctcttggtgttgcatgctcgtgacactcaagaaattttgaactgatgagggaggaagactggggaaagaaagaaagcacacacaggtactggacagagggattctggtatgacctgtggctgtgaggtctcatatagcatatttataaatgttactcaggtttaaagtatttaaaatatagttacctaattgtaaataggctgttaaccaaaagagcttcccctcccccaagttttcttttatgaccactgatgactgcggctgtctcgacagtcatcttcacatctgctcccctccacagtcactagagggctctctaatgctttctaaaggagccaccacctgctccgtggccactcctgtcaccctgtctaattgcaccattcaagaagagcacaggcgctgttggacaaggcgcccac

SEQ ID NO: 545374 - DNA, 175 bp, Homo sapiens
atggctctggtattaaatctgggaggtggaaacctgcttacaggaccccctttctttgctgagatctttcttttcgctgaatacattccagccctcctcacccttcaatgcgtctacatgcctaattctttctggttgtgagacaagaacccagcctagctaaaaaacaacacca

SEQ ID NO: 545375 - DNA, 845 bp, Homo sapiens
  misc_feature (845)..(845): n is a, c, g, or t
aatcaagaagtggtggactttgaaaagttggatgactacgctctctgcctttcaaggtcatgatgtgggacttctgatgcctgggtaccaccagagggaaagctggggcggagggatttagatctgtgttgactcgagattatgtgctgaactctgcagagctggcgaaagctgaaaggtgcaaacatttcaacttgctatcctctggaggagctgataaatcaagcaattctttatatctacaagttatgggagatgtagaagccaaggatgaagaattaaaatttgatcgttactctgtatttatgcctgcagttctgatatgtgataggcaagaatctctcccaggtgaatggctggttagaaagttctttggctccttaccagactctagggccagtgggcattctgtgcctgtggagaccgtggctagagcaatgctgaacaatgtggtgagaccaatagacaagctgatggaactgctggagaacatggccatccatgacctgtggaaagcgcatggatctctcaagccatgaccacattgaagaaatgagtcttattgtcgaccttaacacccatcaccaaatttaggatttcacggtctaaaaaattcaacatgtttaacttatgtgtatacatcctacgctccattcaataaaactgatggtgtctgataagtggctagagcctgttatcatataaaccctcatgagcttggaaaataatatttgcaccctactaaacttattaaattttaggtggggaccaaatctgatttcttggtaactccctgtgcccggtccatgcctggtgggggctgttttatgcttgttcaagccacn

SEQ ID NO: 545376 - DNA, 1016 bp, Homo sapiens
ggaaaatgctcgtgttgaagggtggctcctcattgaatcaacgttctgaagtgcactcttgattgtggccaccctgtagaaaatggattcataggatgctgtcacgtctagtgcagtttttgcgagacaggatcgaggatgctcggaacagctgagaacctcgtgtggagggttgctgaccatcgaactcgagcacccagcaacgatcaacgtgacactaccgaggtgcctcttctccaatcggtattcgaaattagtctcatcctagaaaaattattagaacgaagatactagatctacgtgactgattgcggctgtagttgcgtaactacggcaaagatagttagcccaagttatcggtcaacttctcgagagttaacgcatcgactaagaagaggaggaagacgcacgattaaaatttccatcttatctgcgacaataattccgtagtgaggatcttgcagtcaaaattgcaaaccaaacatggtgagttatgtcctatggtattcattcgtagccatttgatgctagtttgtggccagatagaacttgtgaagagtcagaaggtacaaaggggggtgcgccttggtgcggcaagtcagtgtacttttgtcacttgacgtgacctatgaatgtgcttggcattaccctggttttttgatggctcgtgttctatactcactcactaggttggaatggagaagggttgactatgccgagcacggccgtgctccgagctggcggactgtgtgtcgtctctagtgctgggtgtgaccggtctgtgactgggtggcttccacgctgtgtggccggtcgtagcgtctccggcatgtcacagacttctgcgtgttcggatggcgctcccgttcgtgcctttaatggatagcggacgtttacaagatttcggggggacgatgtcaaccgcgtttcggccctcgcctctgctgttcgtccccttcttctgcccccattttggacctccttccaaaaacggccccggtggcaagggtggccct

SEQ ID NO: 545377 - DNA, 151 bp, Homo sapiens
gtgatagtcaattgggtgtgagcagtcagttatatgttgggattcgaagagtatgtgggtgtggagcttgaacgctttcttaattggtggctgctgtttagagcctactatgggtgtcaaatttattagctcttactctacgaggattttt

SEQ ID NO: 545378 - DNA, 299 bp, Homo sapiens
atctgcaagaggacatttagagcgctttgcagcctatggtagaaaaggaaatatcttcacataacatctagacagaagcaatctgagaaacttctttgtgatgtgtgcattcttcccatagagttaaaccttcattttgattgaggaggtttgaaactctctttttgtagaatctgcaagtagacatttggagcgctttgacgcctaccgtggaaaggaaatatcttcacataaaaactagacagaagaattctgaccaacttctttgtgatgtgtgctggcatctcacagatttgaaa

SEQ ID NO: 545379 - DNA, 1769 bp, Homo sapiens
  misc_feature (1)..(1): n is a, c, g, or t
  misc_feature (1223)..(1223): n is a, c, g, or t
ntgttgcgcgtctcatgattgatgatggtcgggctggtctgtcgacgagttgttgttccggcgtagcatccggttgcttcgtttggatcgacctgaatcgtctgtctggtgtctagtctcttgctccagtggatctccctcctctgtggtggtgattatgccgcgatatcgtcttccttttgggggggacgacacacacaatggcggggagctccagaacagagtggccacggatagctttccgccgactgttctccctctcttcgggtggaaagcgttcttgttcttttctatggggcgacacagtaacccgccctgagtggggtccattagggctcattactcacgaggccaccccttgtgggttgatctcacagctccccggtgcttttttgggaggataactcctctctctgcgctccgttaattattccccgggggggaaaatatttgggccgctctttgtggtggttctaccacgtccgactgggaggagcctctcttcctcccttggtaggatattcataagggggacaatcgttggttggtcttgcggccacactaatttaaagaggagtggttcacgccatgcctgtatgcgtttcccccacatggtgttctctgtgggtggcgccaccacatgtgggccgctcccctaaggtgtgtggaggagtgttccacccatcgggtgggccacacaagcctccccccaggtaaccacacctgtggggttttctgtctcggggggccccctcgtctaggatgaatgagtcctctccctcctgcttgttgttgccaccagagtcttttttttaggagggtaatttcacaccccgcagcgttgtggtagagattgttctctccacacagaaggggggggccacccacgccatcgtggtggaaaattctcctcttgtgaggagttggaaatatgtggccaacaccgttgggtcttctgctcagaaactttgtgggagagcaccccacaaagagttgggggggagactctcctactcggtgataatgactcccaacacgctcttgtcgtttgtgaaaacaaaagtagcggctcttcacacacattctttcctctccgcctcttttctctctcctatgtgggggcgctgtggtctcacacccccagcacagaggtgtgtgtctgcgacccaatagggcgcgagcgacatattttcgcacgacccccctgtgagagatgtctcttngtgatatatctccacacagagagaggaacacatctctgctgcatatctctctcgctctgtctctctgtgggagagggtgttgctccgcccaaatagtgttgcccaccagaggtgtctcgtgtctttgcacaggagatttgtgcggtacacccacacagtgtgtgtgcgcacactcaggtacaccccatattttaatccattctccacaggggtacacaaacaggagatctccggacccttgttcttgtgggagacaccgggatttaccacccttctcccacacttgctgaaaaaggtccaaggccctttttggctaatccaatctgccctttgtggctgctgccccctgtggctgctgccacaccacacacagctgctcctgcgtgctgctgcacagccccacagctaaaggttaaagcccaaggaagaatcggaggaatcggacgaggatatgggatttggtctctttgactaatcaccccaaagccacccacttagcccgttttatttgccaaacaccagggaataaaggcttactttccttta

SEQ ID NO: 545380 - DNA, 746 bp, Homo sapiens
cgttacttttgcaactgccacctatggaaagggatatgtcatagcgataatccatggggtgagacttagctacatgatgctaaccacgatgtacgatggagcacaacggaaggatttgggaatgaagttttgaaaatgtgtcgctctttgtatgaccccagccagatgctgcctccagagggtgtgaaggaactgtgtctgctgctgcttaacccagtccctcctgcgttccatctctgagaacttctcctcgagagcccagatgagcatctgcacgagatggccactggagccaaatcacggccagtcactacggtgaatgattcccattgtgacccagaacttccttttccctgctcctggatgcccagctgctggtgaagtgtgtctcccactcccttctatccacgtattgttgaccccacctcttggctagcctcccagcaagggcgctgggatgccagaggagctgggccagacacctgcgggaggccggcccatgaagccgaagccgggtctctccttctggccctgagggggactcacccaggccttccagaacccttccagtaccagccctccgcgcagcacagcactgggtgtgagggccccctgtggccctgctccttagccagaaaaagcatctggagttgaatgctgttccccagaagccacatgtgtatctgtccgattgttttccctggttccccaccaattgccaaattaaacctgtatggaaacgatga

SEQ ID NO: 545381 - DNA, 462 bp, Homo sapiens
gacggcttcaacggaacttttaattgtgatgtagggtgtaaattttggatctttcctgctttctcttggtgggcatttagtgctataaatttccctctacacacgctttgaatgcgtcccagagattctggtatgttgtgtctttgttctcgttggtttcaaagaacatctttatttctgccttcatttcgttatgtgcccagtagtcattcaggagcaggttgttcagtttccatgtagttgagcggttttgagtgagattcttaatcctgagttctagtttgattgcactgtggtctgagagatagtttgttataatttctgttcttttccatttgctgaggagtgctttacttccaagtatgtggtcaattttggaataggtgtggtgtggtgctgaaaaaaatgtatattctgttgatttggggtggaaagttccgttgaagccgcgggtaccgagct

SEQ ID NO: 545382 - DNA, 168 bp, Homo sapiens
gtaggagtgaggcaaggacgacaaggtagagcccaacaggacaaatcagttgggcctctcccccaggcggaccctggaggtgggcacggtgccattcaaacaacagacaggaaaaaagccccaggaccctggggacccctgtcaagtacaaccaggaccacatgaatg

SEQ ID NO: 545383 - DNA, 799 bp, Homo sapiens
aattgagtggggcctgcctgagtgccgccaaagcgggctggtgctgggagtgtgccattgccagctggtgtgcctggagctctgtgtgacatcacctggtgctggccctgcctctagtcttggtgtgcttgatgtgttgttgagtgccctggagccatttcttggtgtgcctggtgaggatccatcttgcactaggtgtgtgttgagatgatgaagctgcctgcatgccaaccatgggtcatgtgctgtgctcacagtttcctcttgctggcatgtaaatgtgctccacaaatgtgatgtttggtgacgttcacaacttgatgtgcttgctgcgtgacgtgcctgatgtgatggaccccaatgccctggacctgcctgagctgtggcacttgagtgcatgctggcttgactgctactgtgagtggaaagaagtgttgtgagcatgcccctgcagtgacccctggccagccctgtgccccagcctctgccggagccctctgtggaggcagagccatgttggatgcccagtgagtgcagtggctgcttgagcaagccacctgagaccttgcaactcagtgaacccctccagagtgccatggacaagtgctgcccctgactgacgtgccagggtgaaagcattgtgagtgagccgccccggagcccaagcaggagggaagaggctttcatagattctattcacaaagaataaccacattttgcaatgaacatgatgccactgtgcgtgacaatgcttggtggtcggactgctggctgcattggagctttagcaagccagatg

SEQ ID NO: 545384 - DNA, 518 bp, Homo sapiens
  misc_feature (124)..(124): n is a, c, g, or t
  misc_feature (172)..(172): n is a, c, g, or t
  misc_feature (175)..(176): n is a, c, g, or t
  misc_feature (257)..(257): n is a, c, g, or t
  misc_feature (281)..(281): n is a, c, g, or t
  misc_feature (307)..(307): n is a, c, g, or t
  misc_feature (334)..(334): n is a, c, g, or t
  misc_feature (365)..(365): n is a, c, g, or t
  misc_feature (434)..(434): n is a, c, g, or t
  misc_feature (452)..(452): n is a, c, g, or t
gcgtccataagaacgtagcccggagccttctgatggagcgtgatgccttgaagccccaactcgcccctgaccgagcggctcatccgaagcagctaccgtccacctcatgcagtgagcagcctgncgcctccaccctgcagaacctcagtggtggcgtactgcgtcagtcagntgnncaccgggttagggtcaggagacggccagagcatgtttgttagggctgttagagggtgatcttcagttttcaggaagtgggncacgggttaattttaaatgtgatncgaatctctttcagtctcgagaaggncaatgagcatttttcagcagtcacagncagtgtgagtgctgctctttccacctgcttnaaattctgtttcccaggggaatgtgctactgctggtggttcaaagttggaaggcaggcagaggtggggntgattctgctgggacagncttccagaagcagctcccccactgctgtcccgtcccacaggctgccttggatgactttatctttct

SEQ ID NO: 545385 - DNA, 375 bp, Homo sapiens
  misc_feature (310)..(310): n is a, c, g, or t
tttcggcacagaactggaagaaccaaagtaaaatggaaggggggattttttgaaattaaaactagttagtaaccaaacagacagatatatgccagattttttagtgccattcccaccccctcaaatccctccatctcccttcaacaccccctcctatccccgcaatgcagtgcaaagactggtatagctaagggcctatctatcaaacagattcaagatttgcaagcgtaagacatgtagggttagagttacctgcagcttgtgataggtacgtaataacatatgaacaaacgatattaacacctgtggntaggtgagtggtccaatagctatttttattgccatgttgttaaactattaatggacaaaaattgt

SEQ ID NO: 545386 - DNA, 367 bp, Homo sapiens
gactctgaggctccccgtttgactgtggaagccgtactctaaggtggatagtgatgccccctgggactccaggcctgagcaatgatccctcctcccaggcgttgtggacctggtgagctgcttacccgcttcattccccactggggaccccaatagtttatctcgatccagtacgggatcccattgtcttctccatacccaacaggccagtactgcatggtttactttatctggagttttatggcaggaagtactggaaaacaaatattcaaacagtaggtgatcatatgggacggataaacgcaatgacagtcctcatccatcaacgcctctttgaccgctttatagcaatgtcccacatgtcata

SEQ ID NO: 545387 - DNA, 619 bp, Homo sapiens
acttggaaaaatgtatcttaggttgggataatgcaggcaaaaccactcttcttcacatgctcaaagatgacagatggggccaacatgttccaacactacatccgacatcagagaaatgcaaatcaaaaccacaatgagataccatctcacaccagttagaatggcgaacattaaaaagtcaggaaacaacaggagctggagaggatgtagagaaataggaatacttttacactgtgggtgggactgtaaactagttcaaccatggtggaagacagtgtggcgattcctcaaggatctagaacaagaaataccatttgacccagcaatcccattactgggtatatacccagaggattataaatcatgctgctgtaaagacacatgcatacatatgtttattgcagcactattcacaatagcaaagacttggaaccaacccaaatgtccatcaataatagactggattaagaaaatgtggcacatatacaccgtggaatactatgcagccatacaaaaggatgagttcatgtcttccgtagggacatggatgaagctggaaacatcatctcagcaaactgtcgcgggacaaaaaccaaacactcatgtctcactcataggg

SEQ ID NO: 545388 - DNA, 417 bp, Homo sapiens
  misc_feature (54)..(54): n is a, c, g, or t
aattcctctgtgaagacccagctctttctttggctccttttttgaagccatctntgctctgctctcctctgctgcccagaaagttccagagtgaagctcagctctagatgaacaaaaactggttgagtccagagatgcctgagttggagatgaaccttgcaaactttcctcattaccatactaaaaaccccacccaggaaggagcttatctgccatttcctacacatgtgacatatggagaagcatgatcagctacttcacagtctctgcctttactctgcctccgcatacaatggctcagccaactagcctaacgaaagctgttttcaccattgtttgggaggtactgctttgggaaactgccccagctgtcctccttacttgttgtaggtaataaaatccctttgttaaatctta

SEQ ID NO: 545389 - DNA, 134 bp, Homo sapiens
ctctcgcaggctcccctggctctcaccccatccctcccacatctgcagcacaggtcagggctgcccagcttctggctggccgcagccacttccaagtcactggcaggccagtgtgggggctgtgggcagcctgc

SEQ ID NO: 545390 - DNA, 1521 bp, Homo sapiens
tattattattatttatatattattatattatatatatttttatatgagaggcaaaggggcacagaacgcagacggggaggaggtaagaatcgagggcgccacacacaacacaacaacagaagagcaaggagaagaggagaggggagagtggagagcaaggagagaagggggtggccccagcaggacaacaaacacccgccagagggggcgcaaggagcgacgaggggatgtgcaacacacacaggaggaggcgagcacacagagagaacacaccaagtggagacaccgcgagaacaaaaagagagcgacaatactaatcacgaaggacacaggaggagagacagaaacacagagaagggagcagagaggaggagaggaggaggagcggcggccaaaaaggatagaacaacagagagggcgggcagcgaacaaaaacacagaagcgagaacaagaaaacaccacacgacgaggactgaccaaaaaaaaggagggggacagcaaaaagaaaaacatactcacaaagaaaacaacacgcgagaggcacggaggaaagacaaaaggagagggggaggggaaggaacgtgaaaagattgagagaaggagagagagacggaaaacaacaaaaaaaagaggatgagcgacacccacgaggagcacaacaagagagagaagagggatggaggaaaaagacaggaggagaccgccaccgccaaagagagagacgaaaaaaaagcaaaagaacacacaaacggagagaagaaaaaaggcggagggatggaggagaaaaagaaagaataagaaaaaagtaaaaagacaatgagagaaaagaggagcaataagaaaaaacagaagaaaaaagaagaacagagggggaagaaaaaaacggtcaggcccaaaaccgaacgcggaagaaaaacaaagaagaaaaaagaagaaaaaaaaaaaagacaaaacaaaaagaaacaaagaagaaaacaaaagaaaaaaaaaacaaccaacaagaaaaaaagaaaaataggtaagaaaaaaacgaaaagagaaagaagagcggagagacaagaaaggaaaacaaaagagaaaggagaacagaaaacaagaagggagagggacggaaacacaacaacaagatagagcgacgggcaaaaaacagaagataggaaggagagcgagggagagaagaacaccagagacaagaggtgaggagcgcaaaggaacagtacaacacacaaagaagaaggcattcagaagaaggaaaacaacagaggacaagagagacggggaggcagcccagcaggggaagggaaaacccacacccccagagcaaaaacaacaaaaagcgaagcggaccactacaaaaacgaaacacgaccggcaggagagaagaaacacggaaggctaggaaaaagatgacaggagagaacgagccaaacacagcgcagaagacaaacagaaaggaatgcaagataagatagagagacagccgaaacaggaggatgagcaaaacgacacaccgagcggaa

SEQ ID NO: 545391 - DNA, 578 bp, Homo sapiens
gcttgtaagatgccttgaatatgacaaaagctttaactgtagctcagatcttattgtacatcagagaattcacatggaagagaaaccacatcagtggtctgcgtgtgagagtggcttcctcctaggaatggagccttcgttgcccaacgagaaaatgagaactcaagacagaggagctacagcgtataatatacactgtatgtgataaagagcttcgcacctagagttcagcgcgcttcttctagactagtcagacagtactagcgattgtgtgaaaaaccggtttgtctgtgaatgtgagtgaaaaaggtcttgagcttagcccgtccccagtgcgtcagaagcctcagagatgtcttgaccaggcgagaagctgtaataccaagtattaaaacagttcatttatgtatcagagaactcattaagatgaggacgaaatctcagacttgctcagagctcagaattcagtggggaccagagagcctgcactgggaaatatgagaaattctttgcccagagagctgcctaaagaacagttcagacctcatccaacgagaaatctacagatgcccagaggt

SEQ ID NO: 545392 - DNA, 588 bp, Homo sapiens
atgggtttgttggttgggaatttgagaccagctgaccaacatggagaaaccccgtctctactaaaaatacaaaattagccgggggtggtggcacattcctgtagtcctatctactcagtaggctgaggcaggagagtggcttggactcgggaggtggaggttgcggtgagccaagacgtgccatcgcactccagtctgggcaacaagagtgaaactctgtctcaaaaaaaaaaaaaaaaaaaaaaaaaaaccaagcaaccccttaggggtttgctgtggtggggaattgggtttaatggagaaaagatttttttcaaagttggtgtcggagggggagggtgaggttggcccatggttctctgcgggagggcccgggcataatctaggaagtaaatccagttgcacgatgaggaacactttagcttgggggatcaaaccaggaatatgattctgtaattataaagctcattgccaacccaaaagatatgtttctgaaaacctgtagtttcttaatttaggtccatcccctttattaactctacagttgggactcacactgatcccaaatttttaagtggtaattattaa

SEQ ID NO: 545393 - DNA, 551 bp, Homo sapiens
agcgtggtgctgagggggcgcgggcggaagggcgcggagcggcgcggagccgggcggtcgggccagagagagccgcggccgggagctcgcgggctctgacaacctcctcccctcgggcggacgacgaccacgggactaggcgccggtcatggcggagcacaaacccggcgcggaccctagcaccaccgatggagcgggacgaaccgccgcctagcggagggggaggcgggggggtcggggggatgcggggcgtcccggggcggtgccgccggggcgcagcggtgtctgttcgcgatgaattgggagagcttggcccaggcgacgtaatgatcggacggtgagcaacgaacctgtctcagtgtggggaccgcgcgacgaggcttgcactatgggatcatctcctgtgagggctgccaggggttgcaagcggagcattgcaacagacgggtatatcgatgcatcgtgaccagaactgtgtcatgtctcggaagccgaggaacaggtgccagtactgcgtctgctcaaatgcctccaatggggatgaaccgaag

SEQ ID NO: 545394 - DNA, 348 bp, Homo sapiens
gacatcagaatcctcagtgaagcactgtacttacagaattcaagaccagttcttcaatttgacatttaagattctaatgccaggcacagtggctcatgcttgtaatcccaacacttaggtgggaggatcacttgagtctaagagtttgagaccagcctggacaacatagtgagacctcatctctacaaaaagaatcaaaaaacttatccaggtgtgttgattcatgcctgtgatcctagctactcagaaggctgaggtgggaggattattcgcaggagattgagtatgcggtgagccatgatcatgccactgcactccagcctagatgaaaaagcaagaccctgtaga

SEQ ID NO: 545395 - DNA, 167 bp, Homo sapiens
ggccggcggggacggggaagacggagaccaccaaggacttggctaaagctcttgctgtacagtgtgtggtgttcaactgttctgatgggctagattatctagcaatgggaaagttttttaaaggattggcttcttctggcgcctggggctgcttcgatgaattcaac

SEQ ID NO: 545396 - DNA, 335 bp, Homo sapiens
tcacagcgtcttcaccagctagagaacagcacatctcctcacagctctgaaaactggaagactgggcaggctgcggtggcctcacgcctgtgaatcccagcactttgggaggccgaggtgggtggatcacgaggtcaggagatcgagaccatcctggctacacacggtgaaagccccgattctactaaaacaatacaaaaaacttagccggatcgtggtgcgtgggcacctggtaatcccagactatttgagacacatgaggcaggggaaatcgcgttgagccataggcagtgccaagacccagtctggggccattcacagtcgcagacgcctgt

SEQ ID NO: 545397 - DNA, 231 bp, Homo sapiens
gtgagggagtgagatatgcctctgagaggacccagtacactggggagtgatccgctcagagagacatcacgattgtgcacgcgccgatacaggaagtgctccgtgaaagagcgtccttgagtcagcaacacacggagcagagcaagtgggaagatggtgagtggatggaagacggaaccctgcaagtgaggcggcatgggacaggatcttggtgccagcctgtatgagtgt

SEQ ID NO: 545398 - DNA, 597 bp, Homo sapiens
cccaagcgtactggctcgcgcagtctccgcctgcagtctcaggcatgcagctgcaggactgagcgcgtgcacccggaggagacccccggaggacggcgacaaacttcgcagtgcgcgcgaccaccccagccctggctgcagcatggcccagctgttcctgcccctgcgtggcagcaccatggtcctggcccatgagctcctgcagctttagcagatgttctggcaagcgagacacgctcacaggtgaccgcgcttttcgcgtgcgcatcgcgggcagacgcgccacctgcaagggcgtgctcggctggcgcccatcaccatcccttgccacgtccactacactgcggccaccgacgagccgcccggcctgtgctgggctctccgacgggtcaagtggactattcctgtcccgtgggccgggaggcagaggtgctggtggcgccggggagtgcgcgtcaaaggtgaactgaggcctaccggttaccgacgtggcaactgacttgcgtacccagcgtacgcatcaaccgaacgatctccctgtgctgctgagcggacgctgcagccacaagcgaactcaggtatactaatccgctgtga

SEQ ID NO: 545399 - DNA, 365 bp, Homo sapiens
actacatacttccgactgaaccatcattcttgccatggggttttccaagctctataccataccaatatcctggggcgaagttggtggccccaaagaacctaagggggcccagcctctgtcctaccactaacactctctttccgaggcggagttccccctcgcaacggctattatttgcgtgagatgttgctgaggaattcaaaccagcactggctctggatgaaagggaagggctttggctcattgccttctggttactgctgatggcattctgtttctgggggtagctctgtctgttccaaagaagatgtagaggagcagctgctgacagatccaagagtgccaccccggaggtatgtagtcgg

SEQ ID NO: 545400 - DNA, 257 bp, Homo sapiens
  misc_feature (55)..(55): n is a, c, g, or t
  misc_feature (74)..(74): n is a, c, g, or t
  misc_feature (158)..(158): n is a, c, g, or t
cccaggctgggttccccttccaagcttggaataaggcaaagggggaccttggggncgctctcaggcttttcccntgcaacatcccaagctgtggtccccatgaaaatactgaggaatgtgggctgtctctcccctttccaagaatgtggggcccccangcctggccagacaagaaagactgtcaagaagggtcggagtctgtaaaaccaggcaacagtttgcttttttcacattgatcatttttatatgaaataaaa

SEQ ID NO: 545401 - DNA, 941 bp, Homo sapiens
attaaaaaaacaggatgtaaggtccttctcatacagaagtctattcttaagagatgctcttagtgatcttgcattacactttctgaactaaagatgaacgatcatggtgattaacggatattgaaagagaagacattgaattcatcttgtagagacaattggaaccaaggcgcagtggctcatattgaccaattttactgctgacatgctgggttctgctgagttagctgaggaggtcgactttaaatggttctggcgaaactgctcaagattacaggcatgtgccagacccaaggagaaaacagttacaatagttgttcgtggattctaacaaatcgtggtgattgaagaagctgagcgctccattcatgatgccctatgtgtgattcgtgtgtagtgaagaagagggctcttattgcacggaggtggtgctccagaaatagagttgggcctacgattaactgaattattcagcgaacactgagtggtatggaatcctacggcgtcgtgcttttgcagatgctatggaggtcattccatctacactagctgaagaattgccggcctgaactcccatttctacagtaacagaaactgaagaaaccggaatgcgcaggggaaaaaactggaggcatcactgtccgaaagggtggtatgtccaacatcaggagggacctggtgaccagcccagtggtatcaggcaggcctgaacccagcaaggaaagtacggagaatacgacaaatcactaggtggtaacctcaaaaactgtatacggaaacacatttatgatcccagctgtgctggcaggcatagaacccgggtcctgatgaaaataaccacagaataaggagggccaaagaatggaccaagggtgaaactgcgagcaaaatggacacagaataaacaaaggagagaggaaacaaaacagaacaacaaaaac

SEQ ID NO: 545402 - DNA, 241 bp, Homo sapiens
ttaggccatgttgagccagttgaaacttggactcgtccggtggtgatacttgtggttcgtagagtaaagtggggtcggtgagatggagacaaaggcgcagagacggcttatgtatccatggacaggagcggactctctcatccccgggtaacggagagttgtagtgggttacatattgattaggcattgcaagatgaagaggagattgtgtcggtgatttgcagtgatgggtcatgcagca

SEQ ID NO: 545403 - DNA, 237 bp, Homo sapiens
cagatgtttcaaataacttcattcacaataggtaattaatgcactacgagttcaaattaatctttgtaaagtaagtgttccctttatttttttcaagcagccagatattcaaagtctcctgtattgcttagtaagtgcactaccaaataggcaaatggtgaatgactttaaagttttctgggcctgttagcacccatgggcatcttggctaagcatgggttattacctgtgttccct

SEQ ID NO: 545404 - DNA, 213 bp, Homo sapiens
  misc_feature (113)..(113): n is a, c, g, or t
  misc_feature (130)..(130): n is a, c, g, or t
aaaagatctcttacttggagattacctggtccttccttctatgctcttacgtttcaggtaggaaattccaaaaatgaaagaccctgtggcgttaggaggggaggagagcaagngctggcacagccagctnggtgtttcctttcccggccctccctcctcttccgttcctccctagctttccaattctctccccttccttctttctctttcttt

SEQ ID NO: 545405 - DNA, 699 bp, Homo sapiens
  misc_feature (643)..(643): n is a, c, g, or t
tagtttttatttcataatcataaaccttaactctgcaatccagctaggctggggagggaccaaggaaaactgggaccccaaggggaactggcagccgagaagcacaaagaattctaggattacgtggcgaagccaaatgtgggggtgggagggggtgctccctccgtggagcctacagaagaggaagtgactcgtgggtggtttaagattaaacacacaagttcaacatttatctcgagttgtgctccacgagctcagcaagtgggtgactcttctctgtgggagggctcttgtgccattctccggtgagaccccaaaaggcggctctcacatgtggcctctccaacaatatattctcatgtgccttctctatatctcacttgtggcgcaaaaaacacacaacatgtgctgtgtgccatctcacaaaccacacctctcaggctccgtggggcagtgtgacaagatgtgaaaaaagcgtgtggaaacccattgtgtggtggtgtggtgctccacgacattgtgtgccctatgggagcaaagatgcgccagggacccccggtgtatgcgctcttaacgagatggaaatgtcctcctattcttccaatattgtctcccccctataatatggggatctttggccacncatgtgggcccttttggggcgttgtggaatgtccccaaccctggacatttaaaacc

SEQ ID NO: 545406 - DNA, 231 bp, Homo sapiens
gaatcttaatgttccttttctgaatttacttatgctatgtaatgtcatgtacaagctatataaaaaacagcttttgtggacagaataagacatcaatgttatgttttccaagcatgtgtcaacgatgtgtagctgtccagcataaccctctttaaacaactgtaactattttgacttgtatatgagtagcgtgctcaaaacgaataaactgacataaagatgcttaacatc

SEQ ID NO: 545407 - DNA, 363 bp, Homo sapiens
gccccaggtcaaccgcacgcgcctttggcacaatgaagtgcgtaaccgatatgtcccttctttgtctctttagctcggcttatttcaggggtgtgtttcgtcgagatgcacactgcagtgaggttgctcatcggttgatagctttgccagaagaatctttcaaggccttggcgatgattgcctgtgctcagtatcttcagcagcgttcatttgaagatcatgatccatcagagactgaagtaactgaattggccctttatggagacaaattatgcacagttgcaactcttcgtgaaacctatgctgatatggctgactgctgcgcgtatcaagaacctgagagtgtgcttcttgcatcacagg

SEQ ID NO: 545408 - DNA, 296 bp, Homo sapiens
  misc_feature (89)..(89): n is a, c, g, or t
gcactcggttatggcttggacagcgctctctgcagctcggcttggattcctgctcctcctcatactgtcccgcagcaggtcacagtcgntgcgggaagactgcaggcatgcgccaggccgttctttggttttatctcctcctcaagttgcctctttaattcttcaatctgtatgagtaaacggcttgtattgcctccttggataactttgagaacaccaaggaggcttttccctttttttttttttccaaaaaattttcccccaaaaaatttccaaaccccttggaatggttcacg

SEQ ID NO: 545409 - DNA, 862 bp, Homo sapiens
  misc_feature (116)..(116): n is a, c, g, or t
  misc_feature (309)..(309): n is a, c, g, or t
  misc_feature (329)..(329): n is a, c, g, or t
  misc_feature (353)..(353): n is a, c, g, or t
  misc_feature (363)..(363): n is a, c, g, or t
  misc_feature (374)..(374): n is a, c, g, or t
  misc_feature (425)..(425): n is a, c, g, or t
  misc_feature (496)..(496): n is a, c, g, or t
  misc_feature (499)..(499): n is a, c, g, or t
  misc_feature (522)..(523): n is a, c, g, or t
  misc_feature (544)..(544): n is a, c, g, or t
  misc_feature (566)..(566): n is a, c, g, or t
  misc_feature (612)..(612): n is a, c, g, or t
  misc_feature (616)..(616): n is a, c, g, or t
  misc_feature (628)..(628): n is a, c, g, or t
  misc_feature (670)..(670): n is a, c, g, or t
  misc_feature (695)..(695): n is a, c, g, or t
  misc_feature (713)..(713): n is a, c, g, or t
  misc_feature (745)..(745): n is a, c, g, or t
  misc_feature (753)..(753): n is a, c, g, or t
  misc_feature (769)..(769): n is a, c, g, or t
  misc_feature (785)..(785): n is a, c, g, or t
aatcttttatttttttcctttcattttctttttcttaaaaaaacaaaatgaaaccaaaaaaaagcctgaatcaaaacctttttaggagtggttacagaaataatagggatgggggnggggggcactaaaacaaaagagaaaagcaccagtgagaagtctttcccattttcttctctccgccacggaacacgcacaccaacagagcccaggccactttttgccccctccccttggaaaaaggaggaacagaagaattaagaattttgaaaggatttttttcttgtgtgaatgtgtgttaaagtcaatgcnataaatctaaaacgagggcngtgtttttaaaaaagtactaaaanaacaggaggnaaacacaaggnaagaaaccccccgcggagacccgcctccctacagagggaggccctcttggnggagagtgtgaagggcagagggccccccgcgccggcagggcccgcccggccaccccccacccccctgccancanccctcccctctccttttaaaaannaaaaacccactcttgggactngggtcgtcctccgatccctgcnggaaagtgcggcggctacttggcgtcgagcttggccatctcctgcncgtngatgccgaagcnctcgctgtcgaagagcagggagtacacgttcttcagcgaggncgcgctcgagttaacaaagtgggcngagaaggctttgagggtnaccgggccgcagtttgtttgggaaagcagttnctgccgcnggggaaaggcgggacncgacggacttaagctnctcgtcctccgccgctgacaggcagtttttgatggtctcttcaagctgtgcttcacatttgtcggagcccactgagg

SEQ ID NO: 545410 - DNA, 302 bp, Homo sapiens
  misc_feature (117)..(118): n is a, c, g, or t
  misc_feature (162)..(162): n is a, c, g, or t
  misc_feature (282)..(282): n is a, c, g, or t
gctctgaggacagcctgtgatttctgccttgattgccttccgtaaatatgctacgtgcttcagtctcctggcagatgatagtcaaacatcaacctctatctttgccagtcccacctnnctccacctgtcctaggggagctctgtcctgcaaggataacagcntttgaccctgaataactggtacgtgcacgctgaacacggaagacaatggaaacgtcaactcttcagcacttcccacgcatcctctgacccacgccagctccgtgatcagctcatccactnattcagactacatccacgca

SEQ ID NO: 545411 - DNA, 916 bp, Homo sapiens
tttctcggcgtttggtggcccctactctgtgaggcggctccgtgtcgcctccgcctgtgtccaccgtatcgtcgtggagtgcacattcgccgttgggcctggcgagttttctcttggagctcgtgtcccacattggtctgcccctcccggctgttagcctgccctgttctctccgtgttcccctgtggtctcgcttttttccccgcttctacggcccgtgtggtaacgggcggtcccactgggcctgagcttgtgtaataggactccccgtaatgaggggaccaacctttgtgaacaagaaaggcttgggtaatcgccgtaagggttggggcccctgtgggggcaaactttgtggaggtcgtgccgccctttttttttttttttacatcgacaagcatcgtttatttatgtgcaattttttacaaatacaaacactcacatataacagcataatgtcaatatatgagatgacagctaaatgcagcatcggtgacttttttctcttcaagaggccatgattcccatttctagtaaaataaagagactgcatataggtagacacaggtttggtcattagcttcacaattttgcctagaaatgatctataaatgcatgttccccccctgctacttaccataatagtgtaaaaagggagttaaaggaaagtttccttgttggttcctaccatatgaaagatgcctatattctattttagcagtgcacaatatatggaaaatatttaaattaaatgttattacaaaaatgaagcagtaatgagattctggcaaatgagggcactaaatgagaataatatatattgaaagaatccagaacaaacaatacaaaaagacgttgttataaaaagcttaggtgcacagtaagatataggtacttttccaatgttactttacatact

SEQ ID NO: 545412 - DNA, 82 bp, Homo sapiens
aggcccccatgccctttccccaaaaaccaaatggttgttacctgccccctttttaacctttggccgattttttctgtgttta

SEQ ID NO: 545413 - DNA, 104 bp, Homo sapiens
agtgaactgctccggtgctgtctgcaggacaagagcagactctgttctcgtcagctctaaaaggctctcctcgccctggtgcagcgtccgaggtgatgtccacg

SEQ ID NO: 545414 - DNA, 99 bp, Homo sapiens
  misc_feature (53)..(53): n is a, c, g, or t
  misc_feature (97)..(97): n is a, c, g, or t
cctaatcctcctgtctccttcgggggaggctggatgagggattcaatagacangttgacctgtccaagtcatcagctaataaatgttaaatcctggnct

SEQ ID NO: 545415 - DNA, 179 bp, Homo sapiens
ggaaccagcgttaccctgcgcacatggtgaccccgatgtatacaaaaacacacaaaaattagcagggtatggtggtgcacaccttgtagtcccagctacttgggtggctagaggtgggaggatccttgaacctggaaaggtggaggctgcagtaagccatgattgcactactacattcc

SEQ ID NO: 545416 - DNA, 541 bp, Homo sapiens
cggacctatctgtgttcgggttgactcacaatgcccaggctctctcagctggggccaggggaaggcgctatgtgcaggcaggcgagcccccaaatggggcttagtctgggagggttctggcttcttcacccaggaaggaattccagggcaagccagtggttttagacagcaacttttattgacacagcagtgcacagcagcagcagaggttctgcttcttgtggagtggggctaccccataggcagtgtgcccagagtagtagctcagaggcagtgctgcagtcatatttatatgcacttttaattatatgcaaattaaggggtagtttatgcagaaatttctaggataagggtgttaacttttaggttgttgaatcattgccatgaaaagggatggtaacttctgggtgttgccatggcaatggtagattgacatggtatactggtgggtgtgtcttatggaaagctgcttccgcccaggacctgttttagctggtcctcaatttggtctgtttcccaaccccgaacacggatcggggat

SEQ ID NO: 545417 - DNA, 322 bp, Homo sapiens
ttgattttccccttccaacagtcacatccccgccccgcggcttttttgttttgttatgttttttttgagacagactctcactcactctgttgcccagattagagagcagtggtgctatctcggctcactgcaacatctacctcctgggttcaagcaactctcttgccccagcctcttaagtagctgaggtggcaggagcccaccaccataccccgctaatttttgcattttgtttttctttgagacagagtcttgctctgttgccaggctggaagtgcagtggtgtgatcttggctcactgcaacctctgcctcctgtgttc

SEQ ID NO: 545418 - DNA, 283 bp, Homo sapiens
agatatttgtgtaaaaaacgaatggggcagggtgcagtggctcatgcctttgaataatcccacactttgggaggccaaggcaggtggatcgcttgagccgaggagttcaagaccagcctgggcaacatagtgaaaccttgtctctacaaaaaaacacaaaaaaattagccgggcatggtggcttgcacctctggtcccagatactcaggaggctgaggtgggcaaatcatttgagcccagggaggtcaaggctgcagaggggaaaaaaaaaaaagaattgaaa

SEQ ID NO: 545419 - DNA, 156 bp, Homo sapiens
tagaggacccctttgcgggccctttccttttgcggccctttccttctgtaggtttacgatgcattgttatcattaaccaggcttttactactaaacttaaatggccaattgaaacaatgcatcgtaaaaccttcagagggaaagggcaccgcaaaa

SEQ ID NO: 545420 - DNA, 160 bp, Homo sapiens
tgtaatttacatattttacatgatgagatatgaaggtgcaacactaagagccgcattctgctgcgtaacaaacgatataaaacactagtttcacatatttctgtgctttagcaaatttactgacctattaattgtatgttctcaataatgccaagataca

SEQ ID NO: 545421 - DNA, 360 bp, Homo sapiens
  misc_feature (1)..(1): n is a, c, g, or t
  misc_feature (311)..(311): n is a, c, g, or t
  misc_feature (331)..(331): n is a, c, g, or t
ngtatattttttccaggagatgcttggagtgtaaagatcccatggtcacataaatccggaaagcactgaatactttgtttcccataagagaatcccattatatgttgatgtattaaaagacctgagaacctggtgtaagtaacttagttcaattcagtatttcccaaatttactagactatagcatcctttttttttttaagaaaaaaaaaatcttaatttttttcctttaacatgtggcacaaactgacttctttccacatttatttatcttactcaaaataaggagatatgggacaacttctggaaatnggggatgttatacccccatnaaaacctactttcccatattggctacggc

SEQ ID NO: 545422 - DNA, 648 bp, Homo sapiens
  misc_feature (568)..(568): n is a, c, g, or t
gcctgcccggaggactggctgctctacggaaggaagtgctacttcttttccgaggaacccagagactggaacacaggcaggcagtactgccacacccacgaggcggtgctggctgtgattcagagccagaaggagctggaatttatgttcaagttcacgcggagggagccctggattggactacgcagagttggggacgaattccactgcgtcaacggtgacccgcttgatccggacacgttcaccatcgcacgtccaggggagtgtgtcttcgtggagcccaccaggctggtgtcgacggagtgtctgatgacccagccctgcgtgtgcatcaagatggcctatacttgacgtgcgtggtgccagaggtgacctcatccctatgcctataggaggtatctagtatctgctcaagacctgcttccaacacaaccatctaccctctacaaggccatacattggctacattaccttcaccccatacccctctcccaaaccctaacactcttaatccgtatttctaacctactctatcttcatacacatcatagtacctcaacatgtacantctcatatactacatactttaaccatctagctactacacacacacacattcatacttacactcactcacatactctatct

SEQ ID NO: 545423 - DNA, 98 bp, Homo sapiens
  misc_feature (69)..(69): n is a, c, g, or t
tgtcctaatcaaagttagttttttgttttctggtttgttttttttttttttgtatattgatgaatgagntcttacctattaaatatattattggataa

SEQ ID NO: 545424 - DNA, 358 bp, Homo sapiens
cttttggggtctttgctgcacttaagcattaagacttctaaaaaaaaaaaaaaaaaaccccccttccccgcttttcatattgggggaaaaacggcttcacttacaggtttcaagacaacccactgggtcatcgaggggtccattttttttttcaacagggggttgaggagatttgcctctgaaagacaaaattgtctcctgatacagctttccgatcaacgaacgaataggggttgagtaaaactaggggagcttcctatcccggctatactggtgctcttaaagggcctcaaaatatccacggccatgatcttttcggggtctttaaacacccctttttttatctccgcctttctgt

SEQ ID NO: 545425 - DNA, 133 bp, Homo sapiens
gtagctgggagtacagctgcccaccacgacagatgggtgagttttgcagctgagtagaggtgggattccacgatgtagcgcagcctgctctagaactgctgacctgaggtactccacccgccttggcctgcca

SEQ ID NO: 545426 - DNA, 143 bp, Homo sapiens
gaggatacccccgagtaacagtagatggtattattccttctaggcatgatacaggaggatatgaggtgtgagcagatatattagtattcctagaagtgagatggtcaatgctagtataatatttatgctgccggtgaaactct

SEQ ID NO: 545427 - DNA, 295 bp, Homo sapiens
catgatgcataaataaatcacattgcttccctcagactcttcagcctcatccactgaattcattcagaatgtggaatggatattgagacaaggggcagggagaaagcaatggccaagtaatgcctggcacagcgtaggtattaaaaagcgtttgccacagacatgtattgaatgaatgcgtacactaatagctcaaactggagttgaacacctagctgatgcgaacgtataattgtccctccggctccagtgagagttatgaaggattttaagatccaaaggcgtctttcttttg

SEQ ID NO: 545428 - DNA, 1121 bp, Homo sapiens
tgtgggaaaggctttggccagagctcacaccttatggagcatcagagaatatcacactggagagagactctacgtctgtaatgtgtgtgggaacgacttcattcactattcaggtctcattcgagcatcagcgcgttcattcaggcagcacacaagcccttcaaatgtgcgcagtgtgggcaaggcgttttgtccacagtatcagcacctgcattaggcacccagagagtacacgaccagagcagcaagaccttttcgcaatgccacaagcagtgtgggcaaaggctattcagatcagagctccttcacttcatctcgccgatccagcaggcattcgaccaaggagagaaaaaggcgcctatgccagtgccaatgaaatgtgggcacatccttccatcaaggcagctcgagccgtccattcgcccattatccagcatccgacacagcaagtgcaaacagtatgcaaatgccaaagaaatgtagggacaggccattccgataaattcgccatcagaaccctatactttgaaaccaaccaggagaagtatcagcaccggtaggagaagaccccttatgaatgccagatgacgtagtgggacaacgaccgttcaatatcgagaaagattcaaacgcatccagttaccaaggactacaggacagagaatcccagtaccttggcagcggaagcagggaccttataccggtatcgacacactcggaccgtagttaggagacaaagccgggtatacacaagaccaaagaacagtaggagaaaacaatgttcgacccccacgacaagtcaactgcacgaccagtgtccacactactagcgacagacgacaaccattcctcaactgaaaacatggatcaaacagcataggaggattgcaaggcaaccaagccaatatccgcatattaccaacgcagaggtatagcacctcaaccgcttcaaaataactcggaacctacacaccagggcaaaaccacacgcacccaggaacctgagcggaccgacgacggaccgacgggtcaatggacaaggggtcacaggacactgggtcggggggaacacggagggacgaaacgccaccgagaaagagacccaaaacaatccaccttca

SEQ ID NO: 545429 - DNA, 392 bp, Homo sapiens
  misc_feature (110)..(110): n is a, c, g, or t
  misc_feature (142)..(142): n is a, c, g, or t
gctcgacctgggcgcattcgctgggctggtgaagatgatggtcatgcagatggagcgccgcctggatcaacgctttgccctcacagacaaggacagcgagcgcttgcgancgtaggaaatttccgttgagcggctaccggangacatgccagtgcactacgtacgccgggaggactacgtgcgcggccaaaccgtgatcgaggccaagcttgatgccttggcactcaagctagaaaccgtccaacttaaaggattgaagtaatgaacatcgatgccgccaagacgcgccgggagtccctgcgctggtacatcatcaagaccctggacgcctcgcggccggtagatccgcatgaagctgttgtgctgtccactatccagggcatctaccgtcg

SEQ ID NO: 545430 - DNA, 168 bp, Homo sapiens
ttaacttggtcgataggaccttgcacctcaagtagtgagacaggccatgcctaaacaagtgcatgcagcatcgactgatatcatcctacaagtttcctgcacagtgcccaccaaaagtaatgtcacagacaagcctgagcagaaagtgcagacatacaatactacatg

SEQ ID NO: 545431 - DNA, 225 bp, Homo sapiens
  misc_feature (5)..(5): n is a, c, g, or t
  misc_feature (67)..(67): n is a, c, g, or t
  misc_feature (81)..(83): n is a, c, g, or t
  misc_feature (109)..(109): n is a, c, g, or t
  misc_feature (120)..(120): n is a, c, g, or t
  misc_feature (158)..(158): n is a, c, g, or t
gtatnagaccaggctgagggcacgccgctactacagcgtcactgtcgatggctgcacgagtcacacnggagcctggggcannnagtgattgaatacaaaacaccaaganctcccggctgnccatcatcgatgtggcccccttggacgttggtgccccnagaccaggaattcggcttcgacgttggccctgtctgcttcctgtaaaactccctccatctcagcctg

SEQ ID NO: 545432 - DNA, 865 bp, Homo sapiens
acatttcccattctaggataccgaaatcggtaatctgtaaataaataagcatttgaaagctggatttcatataaagttcagtgtcacattgttcaatgacaataaatggatcaaccaatacatacatgtgcgcttggtcaccgatctgtattacctagatcacgaaaaggaatgtccacagataaattacagtgatcatttcttctggagtctaaagaagaataacgataatctcccaaataactagtgtcagtttctcctagttctcaggcattatctttgatgtcctccctccaaccagtggccaattttaaagtacaatatattctcttttagtgaaatcagcctggtctgctacagaaagtatggaaatatatgcgtaaagagatatgcattctagtgctaattctggctttatgtcattgaccttacatacttttctccacttccgcctttaaaatattgttccagctccaacattctaggattctacaatatctattttcatctccctttgcccccacagataactcctaattaatcttagaaatctattcactttcctcatttaattcttattttcagaagctttcagttgctcttaatttccagaaggtaaggttagctctatagcctggcattcaatattttagttacctagtccatgagataatactagttttacgaaataaattcctttttctggtcatttgggctgggagatggtttcagccatttctactgcttaagaactactgcgactggttattccacgacaagggttgccggcgctacactgggaggggggaggatatcctgaaccggggggtgtgtggccaaaggcgttcccccgcgaggaccttct

SEQ ID NO: 545433 - DNA, 880 bp, Homo sapiens
tggaaaaagtcttggaggccagggggttggtttgaaaccagcttgggggggttcgatccctccctttttggtctaaatttatgtatacgggtcctccgaatgtgtggtagggtggggggcatccatatagtcactccaggttatggagggtcctctctactattaggactttccgcttcaagcgaaggcttctcaaatcatgaacatttattaatattccggctgttagagaaatgaatgaccctacagatgataggatgttccatgtggtgtactgcatcggggtagcccgagtaacgtcggggcatcccggataggccgagaaagtgtcgtgggaacgaaccgttcaatcacgccgatgaactctgatacgtgaccattggcttcggccgtacgacaagggccacaagcggaagctcgaccaggaacaactcgggtaacaaaccctcgaattagaaaccccctccatcaaggacccgcaaacaacagcacacaaactccgacgcgacacctaagcagcgaagggtgacgcacacacaccacaacatcaagaacacgagaataccgcaccccacacacactagcagcccggccacccacaacggcccatcgagccccacaacgggtgacaaacaaagaccacacactggagcccaacgaccgcgacacacgcccatggcaacccacatagcgggactccaaagggcccaacacccaatccacagtcgcaaccacacaagaccgcgccacgtacaaacgctatgcagacacccacatcgctgtcgagacacagccaacgaccgcatctcaacgcacctcaaacagcggccgggatacgcacagcgatcagcagccaacacacagccaaccggacaccatc

SEQ ID NO: 545434 - DNA, 382 bp, Homo sapiens
actccagcctggacaaaagggcgagactccgtcaaaaaaaaaaaaaaaaaaaaaaaaaaaaaattttggggccccccggccccgaaaagttttataacaccctttccggtgggggcgccggggcgcaccagcttgggatacgcgtaaacctgtggggcccaacagccgtgtccccaaaggaaaacccgtggcgcacaagcactacggggctgggagttccccacccaataaaaaaaaaacgcgcggggggagcaaccgaggcgggttttgtggaaccaacccccagaggggagggtcgcagaaggccccagaaaggggagacctaacacaaggggggtcccagcagagacccacaaaataaattaacgccccgccgggggga

SEQ ID NO: 545435 - DNA, 171 bp, Homo sapiens
ggaggttgtagtgagctgagatggcaccattgcactccagcctgcgtggacagagcaggactccatctcagaaaacaacaaacaacaaacaacaacaaacatgtttggtaatacattgtgtgtcaagacacagagaggttgaaattgagggatggaaatagtggctcatgc

SEQ ID NO: 545436 - DNA, 536 bp, Homo sapiens
  misc_feature (369)..(369): n is a, c, g, or t
tggcaggctctctacctataagactatttaacttacccaaaaaatcaaaagaggtggctggaccagattgatacggggacataacggtttatattatcaaaggggttggcataaccaaaagtacaataataaagatgaaaaggcctcctatttctttaagaaaataatactaaataagctggcggcatcttggatgtttcaactcactcacgggcatgacaatgaatatctgatagaaaaaagaattgtatcacttgaataatgatagctccatccatcacagtttaatctaaaaatgcactctctacagaaacaggaactatttggacaaagaaaaaaaaatccctcatccaaatttctgggtcgggntaagggcggcaaatggcggggtaaagaaacctacactaatcaacaagctgggcttaagggccggagaggtacaaaatctagaaggcagatgaaagtgcattattccaaagtttaagtaacagttcggataatcagagttcaaagcaattatggcacataacaagtca

SEQ ID NO: 545437 - DNA, 455 bp, Homo sapiens
  misc_feature (33)..(33): n is a, c, g, or t
  misc_feature (101)..(101): n is a, c, g, or t
  misc_feature (113)..(113): n is a, c, g, or t
  misc_feature (115)..(116): n is a, c, g, or t
  misc_feature (135)..(135): n is a, c, g, or t
  misc_feature (139)..(139): n is a, c, g, or t
  misc_feature (173)..(173): n is a, c, g, or t
  misc_feature (178)..(178): n is a, c, g, or t
  misc_feature (180)..(180): n is a, c, g, or t
  misc_feature (216)..(216): n is a, c, g, or t
  misc_feature (225)..(225): n is a, c, g, or t
  misc_feature (235)..(235): n is a, c, g, or t
  misc_feature (238)..(238): n is a, c, g, or t
  misc_feature (248)..(248): n is a, c, g, or t
  misc_feature (283)..(283): n is a, c, g, or t
  misc_feature (304)..(305): n is a, c, g, or t
  misc_feature (309)..(309): n is a, c, g, or t
  misc_feature (354)..(354): n is a, c, g, or t
  misc_feature (365)..(365): n is a, c, g, or t
  misc_feature (368)..(368): n is a, c, g, or t
  misc_feature (373)..(373): n is a, c, g, or t
  misc_feature (386)..(386): n is a, c, g, or t
  misc_feature (447)..(447): n is a, c, g, or t
ttttcattattaaaaaaagcaaattataaaaanaaaaaaacatgcaaggtagcttgcccaaaccactcgtacatcatataaaataaatttaataaacaaantttttataaatnanntgaataaattgtatgtaanaaanaaagcagcaactattttaataaaacaaaaaatanaaaancnttctgcaaaaataattgtaattgcttctcatattcnaaaacaaanagttgtaaanggnacaaactttnttctggtatttgctgtaattctcctggaattaacnaaataacttcttaagattatnntgtnaatttaataggttatagaattttattaaataacctgcagaaaaantcataaaattnttncaaantttaaaagttgtntcttcaaaaatctcttcgaaatatttattaattctcatctttattttttatttttcataangagtaaat

SEQ ID NO: 545438 - DNA, 717 bp, Homo sapiens
  misc_feature (119)..(119): n is a, c, g, or t
  misc_feature (428)..(428): n is a, c, g, or t
ctcttcggttaaatcctcaagtgagggaggaagggatacccccgcgaaggaagtgctggatcgtgtttttgctgcgcgtgatcctgcgtgggtcgggaggtgtttctgtgaaaagcctnaagattagactgtaagaaaagaaaatagaagcccatgtttcgaagacctgtattacaggtacttcgtccagtttgtaagacatgagtccgaaaccaactacccagtttggttcttgaaagatccctgaatcgtgtgcacttacttgggcgagtgggtcacggaccctgtcttgagaccaggtggaaggaaaaaatcccagtccccaatattttctctagccaactaatgagatgtggcgatcacggggatagtgaagtttacccactgggtgatgtccagtccaaagaccacactggcaccgaatatcncgtattccggcccggcctcagagacgtggcatatccatatgtgaaaaaggggtctcgaatttatttggaagggaaaatagactatggtgaatacactggataaaaataatgtgaggcgaccagcacaccaccatcatagctgataatattatatttctgagtgacccgacgaaagagaaggagtagaaaggatgattcttctttggccatcatttggtacagtctcatttcccagtcatgtataatctttatggcttcccaggaccagaattaaaatactcttttacgt

SEQ ID NO: 545439 - DNA, 576 bp, Homo sapiens
  misc_feature (576)..(576): n is a, c, g, or t
agagacgtgtagaagtttaaagatagttgtaaatatcttctaatgcttgtataagtccttttatgatggagaagttcatggtatgtagtttaatgcaaaatgaaaccattttatttgcaatgttattaaaagaggtttgttattcattcagagcaatgttcaatagtattgttgcagatgttttagtgccgtgttataacaggcatttagtttcagcagcagtgcaatgtcaacagatacagtcaaaatgtatcaagcattgtcatcatactttttaaaacaaaaatatcgaacttggcacatggtttttatcaacaggctccaatccaaggcaagtgcaggtgtgccacatcacaggtcagccacagtcacacacacgccagttgccgtttcttcatagtccatagctctcagcagcaatccccatcacccacagattttatccccacataccaaccggggccaatatacatttatggtctcggcaatcggggcactcgcacaatttcatttatggtggaaatttcccatcacagcaggcatccaatgccccttcagcgcaagttactttcgtcn

SEQ ID NO: 545440 - DNA, 757 bp, Homo sapiens
  misc_feature (159)..(159): n is a, c, g, or t
  misc_feature (468)..(468): n is a, c, g, or t
tttcacattggtaaaccctttatataatatgggttagggaatctataggaccgccctccccaataaggggaatttgggtctctaagggccaaagaatttgggaacaaaggcctgggggggctggggttgctcgggttaagatcgccaggaaaaagcctnaagattagactgtaagaaaagaaaatagaagcccatgtttcgaagacctgtattacaggtacttcgtccagtttgtaagacatgagtccgaaaccaactacccagtttggttcttgaaagatccctgaatcgtgtgcacttacttgggcgagtgggtcacggaccctgtcttgagaccaggtggaaggaaaaaatcccagtccccaatattttctctagccaactaatgagatgtggcgatcacggggatagtgaagtttacccactgggtgatgtccagtccaaagaccacactggcaccgaatatcncgtattccggcccggcctcagagacgtggcatatccatatgtgaaaaaggggtctcgaatttatttggaagggaaaatagactatggtgaatacactggataaaaataatgtgaggcgaccagcacaccaccatcatagctgataatattatatttctgagtgacccgacgaaagagaaggagtagaaaggatgattcttctttggccatcatttggtacagtctcatttcccagtcatgtataatctttatggcttcccaggaccagaattaaaatactcttttacgt

SEQ ID NO: 545441 - DNA, 353 bp, Homo sapiens
ccacgcgtccgcggacgcgtgggcgacaagtcagagagttctttcaggttattgtcagggaaggcgggcacattttaccttatgaccaaccagagagatcattcgacttgaaagaaaagattcctctctacagatggatttacatctcactgatagactgagatcaaacatgaaatgtgaccagtgaatgaatccgtgttcactagcgtaatgtatatttcaatgcgatataccgtgctcttatgaaggcactgtaatggtttatattttttattaggctctgttaagtgtaagggctgttttattgtacatgatttgaagatgatttttgattaaagtatgatttgaattta

SEQ ID NO: 545442 - DNA, 789 bp, Homo sapiens
  misc_feature (159)..(159): n is a, c, g, or t
  misc_feature (468)..(468): n is a, c, g, or t
tttcacattggtaaaccctttatataatatgggttagggaatctataggaccgccctccccaataaggggaatttgggtctctaagggccaaagaatttgggaacaaaggcctgggggggctggggttgctcgggttaagatcgccaggaaaaagcctnaagattagactgtaagaaaagaaaatagaagcccatgtttcgaagacctgtattacaggtacttcgtccagtttgtaagacatgagtccgaaaccaactacccagtttggttcttgaaagatccctgaatcgtgtgcacttacttgggcgagtgggtcacggaccctgtcttgagaccaggtggaaggaaaaaatcccagtccccaatattttctctagccaactaatgagatgtggcgatcacggggatagtgaagtttacccactgggtgatgtccagtccaaagaccacactggcaccgaatatcncgtattccggcccggcctcagagacgtggcatatccatatgtgaaaaaggggtctcgaatttatttggaagggaaaatagactatggtgaatacactggataaaaataatgtgaggcgaccagcacaccaccatcatagctgataatattatatttctgagtgacccgacgaaagagaaggagtagaaaggatgattcttctttggccatcatttggtacagtctcatttcccagtcatgtataatctttatggcttcccaggaccagaattaaaatactcttttacgttaaaaaaaacaaaaggatcctctagacagcca

SEQ ID NO: 545443 - DNA, 1341 bp, Homo sapiens
gcccacgcggaaggcaactgcctgagaggcgcggcagtcgcaccgaccagaagctgaggaagcctggactgccagttctgcggtgtgctccgtggcacgaccactccagacgctatgcagctactggacctgtcccaccatccctgattgtgtgacggagtactgacacatccactacaaggatgggacaaacctgcacactatccggaaccttcgtccacgaccagctgcttgacgtgcggccaggtcattacgaggacaagttactgtgagcctagactgttcatgaggccgaaacgggtagatacaaattcaacgctaggatgagtggcatctggcgtaaccacacacgcaatgtgcaagttaccccagcatgtgcctaatccggaccttataccagttaatacccgagcagtatgatccccaaccggaaaagcaacaatggccacgacctgtgacactggcattgaaacgtagcaaccggccctaacttacgcgcacattggcccgaattgggtggtaaaccagtcgagtgagaccccacgagtaggaccattaggggacaacccgaggtggtggccacctgggcgagaaaatggtccatatgggccagggggagcggcataggcgaacaacaaactttgggaggcccggacatggcccatataaccgggggctccccggggagcgccacccaccctggtcgaaaaacgatacacaagccagacacccaccgcaaacgggaccacagtacgacgagggaggggagaccaccccgaggagaccaaaccaccccgcccggaagcaaaggagggcttaaaccgtggggagggcaggaccagtgcaggatatagggggccatgtcaccgagagcgaaaccacagcccccgtggtggaacgaggccacaggcaaatgcgcgcccgcgatataaggtaggaacgggggaaacgggatttcgggccagccgtgacgaagggaggcgacggtaaaaattgcccgccaggggacacagcacttaccggggagcagagacacccggggagtgtacccacaaacgaggggacaccgcaaacccgagcacaaagcgaccaccaggacgagttacacatcacgggctgaatacaaccaaaagggagcccaccggggacacacatccccgaccacagacgaggagccccaatcaccggaggagagcacgcacaccggggacacaacaagaatgcaggagcgatacccgctaccagggacaaaacaaccatcaaacggaggtgactacggagcaaaccccaatccccacacacagaggccttcccccccaaggacaacacttcccccaggga

SEQ ID NO: 545444 - DNA, 745 bp, Homo sapiens
accctcatcaatagagggagacatacagaaatagtcaaaccacatctacaaaaggccagtatcaggcgggggcttcgaagccaaagtgatgttgggatgtaaagtgaaatattagtgggcggatgaagcagatagtgaggaaagttgacccaataattgacgtgaagctccggtggaagccgtggtggctacaaaaaatgttgagccgtacatgccgtcggaaatggctgaagggagactcgaagtactctgaggcttgtacggagggtaaaactagagacccagttaacaactggtaaataacgcagctgctggaataattgggtattcggttgtctttctatatagcacctattggtgacgactacaggtgaatgcgatacctcctgactgcgacgtaatacggatgtgctaaagagacgtggcgacttctacggggcataaaaccggaggatgaatgcctgctagggggccatgttgcccttccctaaatgggggggtgtaaggggggactaaagcattccaaaacgatccctgtgatagacacaaacaacaccgtctcaactcagtcgaatcaatgctcgtcctaacaagcacatttaagacttgctgaaatagcctaccaagtattaccctcctatactagagaggacctcccagatacatttgaacctccccattaaaaggctcacaaagttccagaaacgccccccatgacggatgggtgtacaaaaaagataactgg

SEQ ID NO: 545445 - DNA, 134 bp, Homo sapiens
tctagaggttacctcatcaatagcgcctctggatatggtattatttcccctatgcacaaggcattctgtaagttcacacatagcagctttggtagaagcattgtgcataggggaaataaatccatatccagagg

SEQ ID NO: 545446 - DNA, 1009 bp, Homo sapiens
  misc_feature (1009)..(1009): n is a, c, g, or t
agcggaggttcgttcagtgggcccgcttctgcccagcgatcttccgctcctaacgtgggcaggccaagtgtgcggtctgaatgtaacgcccttcggctactttggcgggctcgagacgactcgaccgccgtgctagttcccgggacccacggcggtccagagcacccgtcgcacatgacctctgcgtacagcgagacggtgcgcttgcgcgtaccttgcgttgtggattgcgtgccggccgtttcgcttcgggattgcggcgagttccgcgcgtacagtacgcgttgtgtccagactgtgagtctcccacgtgaccaaggatgctacttctctctctaggaccaggtgacaactgcaaaattgattgaatttacgtcgagcgaattcgagcaaaagcttgatccaagattgtaacctgtccgttgagtagatcaactaggcgtacccagtactatataagtatgatactgactctagtaggtctcattatcgctagatgctgctggacaattacttggcgaaggaatgtgcatgagaaatgcattaaaaaacgcacgagatccaatttaccttagaagcggcatagttagtggccccctaagaaagtggctattacacatggtatgggtaactctggtatacaagaaaaagcgccgactatcctaggccaaccagcttatccgaacaactcgcagacgaggcgttacaaacgacacgtggggaggtaattatcaccttaacaccactaatgtctagaaaggtggcaagaaggggtaagtccgaagcgaatggggaacacacctggtctatatgttatccaaattggagtattttccccctacctgtaggaactaaggtaattataaccccctttaggcataggataggggaaagactgaaattggattttacggatcgtaataataacccggttccactgtaccaccaacggtaaagaaaagagcttcaatttgccctgaaattatttatattaggccatgtaaggttn

SEQ ID NO: 545447 - DNA, 480 bp, Homo sapiens
  misc_feature (459)..(459): n is a, c, g, or t
agctgtagtggggaggctgtgtgtggggaaagggacataggagaagtctgtattctctgttccgtttagctatgaacctgcacttctctaaaaaataaaattagttaaaattaaaagcaaaaaattagaaaaattaaaacattgcaatgtgtcatatagttttcaaatcacaagacagaaaaagacataatagaagaaactatagaaaacatcaaggataggaataaaacctcagtgatagaaggcagaagacagaagacaaaaacgtggagcccaacacattaatttattttaatcattagttgtactcatttatagtaatttatattgatttaacatattaattttgactaaatggcattaaaggaggtttgaaaaatttgcatgtcacattctggttgagagaactcaacaatattagctctttagtttgctgtaaatcatccaaacatatgctcnaattccgataaaggttacttg

SEQ ID NO: 545448 - DNA, 317 bp, Homo sapiens
aaaactgcttgagcccaggaattcgagaccaacctgggcaacatggggagaccccatctctacagaaaaaatgtagctgagtacagtggcacagatctgtaatcccagctattcaggaggctgaggttggaggatcgctggagcccaggaagttgaggctgcagtgagccatgatcgtgccactgtactccagcctgggtgacagagcgagaccttgtctcaaaaaagaaaaaaaaagttctgcaaatttgccagttacaagaccaacctacaaaagccaagaacatttttctacaccagcatctccgctttggaaa

SEQ ID NO: 545449 - DNA, 354 bp, Homo sapiens
acaggcagagctggagttccttctcagatgcagtttgtgctccgtctgcatttaaggcacaggcaagtgctgcaatataatctagagagattgtcgagtataaccctttaatcttatgtgacagtgctttactatttaatgatttattgtgtaatttaaaaaaaatcaaatcttggtctgacttccatgtggacaggcctagtttctttcagatcctgttgttaggaatatatgccaagtgtgtagatgatgggaaggctctacagcatcttaagtcacttcgccgtaggtgagttggccatttcatgtcatctttctgcccaaagaaaacttcaaaaatctaaacctccaagc

SEQ ID NO: 545450 - DNA, 257 bp, Homo sapiens
gcccagccgccagaagatgctggagcccacggtgggagatccacgcagtgggtgcagtttctcagtagggctggagccaattgtgtggtgggtggccacctggcacggcactgtgctcctacacatcccaggggtaggcttcgtgatttggggcttgggctccaggcactagccttctcttctctgtgtccttagcattgtgagagaagagtgccagggccttgttcatgggatcccgtggacgccaaggcgagatg

SEQ ID NO: 545451 - DNA, 995 bp, Homo sapiens
  misc_feature (11)..(11): n is a, c, g, or t
  misc_feature (44)..(44): n is a, c, g, or t
  misc_feature (722)..(722): n is a, c, g, or t
  misc_feature (749)..(749): n is a, c, g, or t
  misc_feature (752)..(752): n is a, c, g, or t
  misc_feature (757)..(757): n is a, c, g, or t
  misc_feature (763)..(763): n is a, c, g, or t
  misc_feature (765)..(765): n is a, c, g, or t
  misc_feature (767)..(767): n is a, c, g, or t
  misc_feature (785)..(785): n is a, c, g, or t
  misc_feature (790)..(791): n is a, c, g, or t
  misc_feature (797)..(797): n is a, c, g, or t
  misc_feature (803)..(803): n is a, c, g, or t
  misc_feature (813)..(814): n is a, c, g, or t
  misc_feature (817)..(818): n is a, c, g, or t
  misc_feature (826)..(826): n is a, c, g, or t
  misc_feature (845)..(846): n is a, c, g, or t
  misc_feature (849)..(849): n is a, c, g, or t
  misc_feature (852)..(852): n is a, c, g, or t
  misc_feature (855)..(855): n is a, c, g, or t
  misc_feature (857)..(857): n is a, c, g, or t
  misc_feature (859)..(859): n is a, c, g, or t
  misc_feature (864)..(865): n is a, c, g, or t
  misc_feature (868)..(868): n is a, c, g, or t
  misc_feature (892)..(892): n is a, c, g, or t
  misc_feature (894)..(895): n is a, c, g, or t
  misc_feature (903)..(903): n is a, c, g, or t
  misc_feature (912)..(913): n is a, c, g, or t
  misc_feature (917)..(917): n is a, c, g, or t
  misc_feature (921)..(921): n is a, c, g, or t
  misc_feature (928)..(928): n is a, c, g, or t
  misc_feature (941)..(941): n is a, c, g, or t
  misc_feature (948)..(948): n is a, c, g, or t
attctagttanatgtagaagagagaagaaagaggaagtgttcanttttttaatacactgatttagaaatttgatgtcttatatcagtagttctgaggtattgatagcttgctttatttctgcctttacgttgacagtgttgaagcagggtgaataactagggcatatatttttttttttttggtaagctggttccatgatgttttcttgggaattccgggataagttcaggaaaacattctggcatgtggtatctagtctggatgtacttatccatctcattacaaacaaaaacacacagactggcttttggtagctctgtaatcctggaatacggaagtaaattttcttctttcctggactttggacattggtagctatactggtttcccatttttggtttttacaaatccttggggtctaattctggtgagcctacctatagcactgggtttaacaatggtctggcatcatttcttaagttatccagttaactttaaacactggtggtcaacagtgtgtaaaccagcccatgacaggttttggtactatgtacaagaacttcagtggtccagtttccatgattatggtgtaggaagactgatgtagatgtcctgtgctgtcctggaccattgttaattacacttacgacgtatttagtccacatcacaatgatttgtccccagtgaaccctttttatccttttctaaggcacatttctgntggttttgtttgttgcagtcccccttngcntggtntggttngncnactgtattggatcagatntgaannggtccngaatanacttttttcnntcnnaaacacanacaaaaaaaaaaaaatttnnggngcncgngncngaaannttnaaaccatgtgggggggccaggtanannatgcaaangttccaganncggngcgnatggggnttcccaaaaaacnggggcgngtgcaaccagggtggtttggttacgctcgtcacgcgccgagggggct

SEQ ID NO: 545452 - DNA, 138 bp, Homo sapiens
tacaacgttctactactctagactatggatatcactttaaggttaatatagggcttatactatgccgagagaggttgcattgcactgcccattgccgcaccgccgtattgtggcaccgccggaatgctgcgccgcagg

SEQ ID NO: 545453 - DNA, 440 bp, Homo sapiens
ggctcagtaacatttaatggtaaagttattgctccagcttgtaccctggtagctgcgacgaaagattccgtggtgactttgccagatgttagtgccacgaagttgcaaaccaatggtcaggtttctggcgtgcaaattgatgtgccaattgaattaaaagattgtgatactaccgtaacaaaaaatgcaacgttcacctttaatggcactgcggatactactcagattacagcgtttgctaaccaggcctcatctgatgctgctacaaacgtggccctgcaaatgtatatgaatgatggtacaacggccatcacgccagacacagaaaccgggaacattttgttgcaggatggagatcagacgttgacttttaaagttgattatatcgctacggggaaagcgacttcaggtaatgtgaatgcggtaacaaatttccatat

SEQ ID NO: 545454 - DNA, 254 bp, Homo sapiens
ggaccttagctatcggtcatcgtggcaaccttcggacgtccgctatgatatcgagagatctgtgacacgcgaagctagcgagagggtgaacgataacgacgaaatggttggagtccactgaagaaagtagcagggattgtatgtggagcttgacagtcgaagaaaagaacctcctatctgttgcatataagaatgtgattggagctagaagacgctcctggagaataatcagcagcattgaaccggatagcttg

SEQ ID NO: 545455 - DNA, 100 bp, Homo sapiens
tgaaaccaggtgaaaaaggaagaagaggagctgaagaaagaatttattgagaaagaagctaagttgcattccgaaataaaagaaacaggaagtaggaatg

SEQ ID NO: 545456 - DNA, 366 bp, Homo sapiens
  misc_feature (361)..(361): n is a, c, g, or t
atcctttggttggttgtgggtagggtacaatgtcgttcgcgcatcgagggcatgattggacacaccgactcggtgaggctgccctggaaccataaggggtgacttcagctgtcacatcagcaggaatgtcaatccacgccagcgactctgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttactacccacaanccctg

SEQ ID NO: 545457 - DNA, 370 bp, Homo sapiens
cgctacagcaggataagggaatgacggcgatggcgccgcgggtgaaggcgtaatgaggtaatgcagtgggcatggaagcggctcatcgacagacagtcgacaagcatgccagcacgaacgaaatcttgtcttgaacgatcttgctcaggcgagctttaccgaaacctgctccaccgaatcccgggcttcgcgcaattcatacgcatcctggttcagccggtggatggtattgagcaggcgctggcgcagcacttcatcgccgagtttttccacggcgcgcatcaggtcgaaggccgcggtttcgttattttccgcgacggaatccagggtcttgcgcaggtttcggtaaagctcgcctgagcaagatcgt

SEQ ID NO: 545458 - DNA, 942 bp, Homo sapiens
  misc_feature (99)..(99): n is a, c, g, or t
cacctggggggagggaacgctgatgcaacaccgccgagtgccacctcgcgccgcccggaggcgtgtgctcgccccaaacgtgctaaaccaaagggacanccgaaggtgtcgcgaccagctcccacgggcaagaggcccttaggcttaccccgggaaaataacctcccgcccgaagggcgaattaaacaccctacagcacacgggcatctactcccaggggttcctcccaccctccataaaagcatgctggcgccacacaccacaaccagggtcccggccgcgcccaagacccacacgggggctttggcaacaccatattagcgcgtccctgggcacaaccagacgcccattcacggacagctgggcacactccaaccggcgcctcacccgcagaacgggttattcggatacgccgcctccccgcacactgctcgggatgtcagctgctggctccgccaagataggcgcaccgacagggggtgtcgaggacgccccacgcgcggacagattacgagaagtcgccgtggatctgcaccgccggcaccccatgagtgattgggtaatcaccacatgcgcccgcccggaggagctccccccacaaggcctcttatgaaaggatgaatgtaaaaggcggcgattgcgaacacgggcggcttcaaactagtgcgtatcttggcaccagatacgtgtttctcgaacctggggcttcccgaacatagctgccctgcaccccgtaaattaggtgcacctttttccgagataaggtggatcgactttctaccattctccggagaccatatagagagtgtattcttgagctaggaaaagccagcgccgagctgtctcacccacaagtaaagtgccacatggatcctgtgagaaaccacccatataaagaggcaaaccgggccctcccaaaaaaaaaatttgacaaccataaca

SEQ ID NO: 545459 - DNA, 386 bp, Homo sapiens
cccaattttttctccaaaaaaagggatatgtgtgtgaaagtttaacgcgtccataaagggtacccatcatcgtcacaataaagtatccatttgcacagaaatgccaaggacccattctcagtatgtaatgtcctattttcccattgcaccagttaaaaaaagtaaacccttcatagtgtggaagagtaggactgcttttacattgaaatggtgccccaaatgagtatataaaatctctgattctatttatccttctctttgtgctctttctctctcttctcacgctcagctgtggcttcctcctcctcgtgttttgtgatcatgtgctccacctctttgtgtttgagctctctgatcactgtctttcctcgtgccgtattcctaca

SEQ ID NO: 545460 - DNA, 457 bp, Homo sapiens
atcaggacactcccagggggaaaaagtattgttagaggagctctattttacaggactccaaggctgggttttgttggttatgtattgtggcattggagcaggcaatcacagggccatctgtgtgaatggggggggcggggggtgtggggagaggcatgtgaaagtgcccgccaatgcgggcgtcctcactggaagcccgttggtctttccgattcgtggggtgagatggttagaaaaaccgctcttcctttgtttagaactgaactaggtgcatggaatgaagggcaatgaccctgttaacatcttgtagaaccagataccagttgtaactgtgcaaatcagggcctgccccatctcctcagctggagcagccactggtgctattggtgccgtggtggcaagctgagctcctaaagggcactgttggggtcagggaaagcatatatatttataaagg

SEQ ID NO: 545461 - DNA, 556 bp, Homo sapiens
  misc_feature (33)..(33): n is a, c, g, or t
  misc_feature (36)..(36): n is a, c, g, or t
  misc_feature (40)..(40): n is a, c, g, or t
  misc_feature (46)..(47): n is a, c, g, or t
  misc_feature (50)..(50): n is a, c, g, or t
  misc_feature (61)..(61): n is a, c, g, or t
  misc_feature (66)..(66): n is a, c, g, or t
  misc_feature (140)..(140): n is a, c, g, or t
  misc_feature (336)..(336): n is a, c, g, or t
  misc_feature (404)..(404): n is a, c, g, or t
  misc_feature (549)..(549): n is a, c, g, or t
  misc_feature (552)..(552): n is a, c, g, or t
aaggaaaaatttgtttccgttttgtgaaaagcnggnagangggccnnaanttcttaagtcnggggnagccgcccctggtgatatgggtcctggccaggccctgtgggttgagagcttctccaaccaaccccccttggggngctttctgtgttgttatattaaacaaaccgttccggggggggtcctccaaaccgtgggccaaaagggtgctggggctggccagggcccccagtttgccccaaaaggcccaaagggttaatgaatattttccccaaaaccccccccccccctttttatccggggggggaggacgggttccaaaccgtttgtttccantggcccctttaggtttggaggaaaaagccgggttattataaccaagcctcggtaaaccctccaaaggnaaggggaaagttttgggggcccccttgggttttttttttggggggggccggttttaggtttttggtttttaaaaccgggcctttttatgggaaccccctggccccaaatttggccccgaatttttgggcccccttaaaaaggttnatnggga

SEQ ID NO: 545462 - DNA, 747 bp, Homo sapiens
tttttttttttaatatggctgtgaacaggggtgcccatggtagcatatgttggatttttttttattatttcataagaaaactagccgttaattttaccttactttcatggtaaataagcctgtcttcctatcgggatttttggggtgcatacatattctactgattaactactttgggagtttaaatccgtggtattatttcttctacttgggtttgggtgtaaagaggggaaaaaataaaaaaagcggtggaatcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaagaaaaaaaaagaaaaaaaaaaaaaaaaaaaaaaaaaaaaaaaaataaaaaagcacacaaaacaggcgagggcagccgagaacccagcaacaatctcgagagagggcgcggacaggaaatgatcgacgcccgctgcagatggtacagaacgcttagaagcaaagcgaggaaagcaagagtcctgatacgatagaaacaggcgggtgcagcgcggtcaccaacaaatactgagacgaacggaagcagagacagagcgagcattaggagtaagaggagagagccaaccccacgcccgggggcaggcacagaggagcacagaaaaaacaaagacacatgaacagggggacgcagaacaagaaaacgacgcacgaggccacacaaccaacaaacagag

SEQ ID NO: 545463 - DNA, 996 bp, Homo sapiens
agcggtgttggcggtcgggctagagaagagaggcgcctgctgcttgcgagcctgggcttgtgaggtggggctgccgagagggcagtgcgtggggcgaggtccaaaggactgaaccacgtcaggagcgtcacgggtcgccgtgggcggctgtcgctgacaggcgtggacgtggggtattactatcacgatgttccaccgtaataatggctggagttaagaacgtttccattatgtttgctccataaccagaagactctgttcccatgtatatacgaaataggatgtacatatttgaataactacatcgtggctgattgtttgaaagcctgatggatttgagtatgagtttgtctgatccatatatctccaattgctgaagtagaggatttgtcttggaaagtactaaggttgggggaaccaagatcagaagcatcttggattacggcatttagtgatgactgaggtatgccagaataacattaaatagtgtagcatgacactattcacaccaagagggtaatccaaatcgtatttgctaggaaccatgaaaattttgctagttgttgactttgacaatacaatcatagatgacaatgggtgacacgttggattgtacaatgtggtcccaatgaaataaagttgcgtattgaagctacgtgattcttatcgaagaggattttggagcgaatttatgggcagagtcttgaacgtatttgggagataaggtgttagagaacctgactgtgatgagccagtgacatcaatgtgcctttcacttccagggatgggggggagctccttcgacgttacttgggaaaagaataaggtgaaatttgacgtggttaatattttcaggaattcagattcggccttcatagaatgggggtgttaaaagctggcgggtttatgagatatttggacaaagtgtttcagatcccgggggtttatagcgaggggattccgggtgaaaattatttcatttgggaaatgcccaga

SEQ ID NO: 545464 - DNA, 971 bp, Homo sapiens
  misc_feature (46)..(46): n is a, c, g, or t
acagctgtggcttggctagatgtcaagtggaaggggacgtgagaangcacctgcactgttggggcaaacgcgagtggtggcgccccccggcggggtgccgcacgcgcgagtttgtgcgaatgcaccgctggttgccagcccggtgctcctgtgtcttcagagggtcacacccctgtggtgaaacgctcgtggggaggcctttgttctcccgaaaggtgtgttgtgttggccaaggcatagaacgtttgaaggtctcccgacagaatgttccgtgcggggagccgcgagcagttagtctgcttgggtcagcagagaccccgaaaagcggtgacaactcacgatacgttgtgttttaaacggggcgcaccataaatggaccacgcccatacacaagcggctacaagtctggcccccataatgcctccgtcaaagcatcttctgagcccttttcccgcaccccgcgccccattcaagcaacaatgctacatacttcgacgaaacccttgtatcaaatacccacatcgggtcgctacaacaccccggtctccaaaaggtatatctatgatctctcgctctagtggagcaccaaaacttttcttataacccagacccagtctattatcctccgctttcgagacttcttaagtcatcaataacaaacaacttttttttcctggaaaaaacaactggatagcacatgtttatttcttgttgccaatttcaaccccaaacctccctttgcaataacaaagacgtcctcccatagttaattgctattactcccgaacccctccccaaagtactcatcacctccacgctgcccacatggaagagaaacaatgataatccctgaatttctctcgccctatacctcccggtgtctttatttctattctttctgcgggagcttaaacaagacccaaatccaaggggccgctcaaccaaacccactttcccttccacataacaaa

SEQ ID NO: 545465 - DNA, 152 bp, Homo sapiens
  misc_feature (117)..(117): n is a, c, g, or t
ctcctgcagctcctgcgccccgccgagctgactggagctgcgcacgggagcgtgggcacgcaggcggtggcgcggaggatggatggggacagccgagatggcgcggcggcaaggacnccgggtcggaggactacagaacctgccgactagcg

SEQ ID NO: 545466 - DNA, 496 bp, Homo sapiens
  misc_feature (36)..(36): n is a, c, g, or t
gtatatatatatatatatatatatattatctgaatntgctttgatggtacctttgcaattgtattatccattattccctagtattagtcttattctcttctcaatctgtccatcatcctggaaacatatctgaaacattttggtctcactgccagacaggttgtttcctttttctgccttttgacttaaaagaaaaaatctttttaatcttcttcatgaaatgttaatatagccaccatgtaaaacagtaatttcctttctcctgtaatgttgaaaatgtaagccttagccaaaggaccttatcctctggggtaaatcattagtttcagaaaagccctatcatgcccccagaaagtgaccaacttatctagatggaaaacatccaggacttttcaaatactgaggaagatttaactaggagatgttcaagtagaattaagttgaatttcaatagatactgagatggcaggctttctaaatctacctgagccttaaa

SEQ ID NO: 545467 - DNA, 172 bp, Homo sapiens
gctgcttgttgactctagagtgatcccccgctacaaggccccgcagaattctgtgcttcttgtgtgaagaaagagagtgagtccttgaatggcgggggagacacaaaatgggaccccccaaaatccacatgtgggtgctggtgaacccctaaacatccatgtggaatgtgca

SEQ ID NO: 545468 - DNA, 281 bp, Homo sapiens
gagggcaggcagagtatacttgtcctctcacacatatttacacaggtcttttttctagatacagttgagtttgagtatggttccttattttttacgtcaagtgtgttactcaattgtgaaaactgttagtcctagccagatcctaagaggcaagcaattagagtaatggaacaaagtaacagatggctactttggggcctccattatcagcctttaaaaagaaaaaaagatctatttcaagaaaaacaaggcagggcacagtggctcacgcctgtaatccc

SEQ ID NO: 545469 - DNA, 892 bp, Homo sapiens
gccagcttcggcgagatgagcctcaaggcgagcgagggcgagagtgggggcagcatgcagcagcggggctctccgagcctctaccggtggagcgattgctgcaggaagcgtagtcggcccagaggctgtatcgcatccatttgaatactgtgaccgatggacatgtatcaccaactgggtctccgtgccccaggtagcccgttgccagggtcacagggacaggaggtgtggaaagtgcgactcatacagttctgagaaggtcacagaagaggccatgggaatcactctgaagctgaatgaaaaatagtcctgtacggtggacatgaattcttcagtggtggcgatgatccatagacaaggctcccttcaggtgggggatgatgtatcctatggaaatcaagtggcacaacatgtgacaaatcattcgagtggagtcagctgcgagacagggatgaaagaaaccaaaggaatgatctcattagagaagtaattcccaactcagtggaagccgtcttcctgcacatacagatgttcagtgagagcgcagttgagtatgatcccgaaatggacaatctgatgcctgcaaggaggcgggactgaagttagtagtggggacattgatccacgtattagtcaacagggatgacagtaatcggtggcgggcacgggtgggagggcccctccccatgaagtcagcagtgagggatccctaagcactgagtgcccgcatgggaggggcacgttgggtcagaaggaccaaagaatcgcgaagagcacaccttggggcgacagaaaccaagagcaaatgtgcctaaaagccgctatgacaggcaactggccaaagaaacgacgggcccattcagagagacacggccggacgggggggcaccaa

SEQ ID NO: 545470 - DNA, 341 bp, Homo sapiens
cacagtcagtagcactaggacagcgtactcgtggccaactctcccctcagaatcattgtcaaagaaaacctatatgtaacagaggtttttacatttgcaaacttttggaggaaaaatggtggtatggtctggggaacactttatttagaataacggaatttttctaaaaatcaggttagttactaactgggattctttttggagcaatacctacaaaggcaggcaccagaatgtgccttaaagctgtgacatttcaacatgatggatttggcttggattggttttgagcccttttaatatgcaggttttcctgttgcaacagaagtggctttgggtttgtg

SEQ ID NO: 545471 - DNA, 287 bp, Homo sapiens
agaggtctctatctaacttcagcactatgacatagcggtcaccaggtggcagcgcggtcgtgtaagacgggaaggggtgagctattcattcacagttagccaagagcagctccgcgcctgctggatcgtggatagcagcgtaaacatactatcctatacagacgaggcattaaccccatggttaattaggacttggtcaccagtttttattatatttctatgaatctaccttgggattgattgattgaagtccaggccactttactgtcttttattaaggttactgt

SEQ ID NO: 545472 - DNA, 369 bp, Homo sapiens
  misc_feature (38)..(38): n is a, c, g, or t
  misc_feature (71)..(71): n is a, c, g, or t
  misc_feature (81)..(81): n is a, c, g, or t
  misc_feature (132)..(132): n is a, c, g, or t
  misc_feature (181)..(181): n is a, c, g, or t
  misc_feature (185)..(185): n is a, c, g, or t
  misc_feature (191)..(191): n is a, c, g, or t
  misc_feature (242)..(242): n is a, c, g, or t
  misc_feature (245)..(245): n is a, c, g, or t
  misc_feature (264)..(264): n is a, c, g, or t
  misc_feature (267)..(267): n is a, c, g, or t
  misc_feature (276)..(277): n is a, c, g, or t
  misc_feature (303)..(303): n is a, c, g, or t
  misc_feature (328)..(328): n is a, c, g, or t
agagagcagcgccgatgtgaagatgaatgaatgtaacncctggtgtgaagatgaatgtaaaccctggcganagttgagacntttttcttttagactctgctaaaacagtgctctggcttggcttacctcaanagggaagatagttgagttttatttcctgtatatcaggtgacctggtagngatntaaagnaatttaccatagtttgggctttagtattgtaaaataaacatgagaaaaaanaanaaaaaatatacttaatgtnaangtgctctanntttggatgtacagtagttttatttcnacagccacattaccatagcaataanaaaggaggcatagtacatagttggaaaagctttgtgggggg

SEQ ID NO: 545473 - DNA, 139 bp, Homo sapiens
taaacgctttattatctcaacgctttatacttctcaacgcttatacttcctcaaggctcattgggtccgatgtgctcattgcatttgccggtatgaagtataaagcggtgagagcgttgaggaagtataaagcgttgag

SEQ ID NO: 545474 - DNA, 144 bp, Homo sapiens
tctgagcatgctgggaacgagacgctcacggcgtgaccccgaatgacacatgtaccaccacccatctctgaccataggtcaccctttatggtgctgggccctggggtactaccctgcggagaatcacactgacctggcagtggg

SEQ ID NO: 545475 - DNA, 108 bp, Homo sapiens
aaaatgtgaagcatgataagcgtagagggaaggttcaatggttgatattgctagggtggtgcttccagttaggtgcatgagctaggtggcctgcaatcaagcctggaa

SEQ ID NO: 545476 - DNA, 106 bp, Homo sapiens
catcttcttgattcgcttgcctcagtcttagcgaataccagaagatttatggtctgggcgtattccgataccgacgaaccgtccgatgatccgaaaagaccagaag

SEQ ID NO: 545477 - DNA, 245 bp, Homo sapiens
catcaggttgctatataatattataaactatatcacatatgattgttctctactctacaagttatcatgacctgcattagaaatggaaagctgtttcacatgtttacagtgatcagtaggtataaatgcactaatgaaatatacctttcaccttcatagctaaactacagccatttactagtttctattatttttgataaggtcttcaagatttactcccaattgccaggcggtggttcccgatg

SEQ ID NO: 545478 - DNA, 251 bp, Homo sapiens
gcagtgtcttcaagaaggatgggtacaacaagcccgaactgcatatactacaataaattactaagctcttcaagtgcgccaggacacacactaacatccaccagaatcaagatcatccaggctgaacataaccatcaccaagacaaaactaacaggcctcacgaaatcagatgatatgtagacctcttcacagacgagaattcaaatataactacctttgagggaaacgtcaacataaattcatagatgac

SEQ ID NO: 545479 - DNA, 713 bp, Homo sapiens
  misc_feature (38)..(38): n is a, c, g, or t
  misc_feature (64)..(64): n is a, c, g, or t
  misc_feature (78)..(78): n is a, c, g, or t
  misc_feature (87)..(87): n is a, c, g, or t
  misc_feature (117)..(117): n is a, c, g, or t
  misc_feature (131)..(131): n is a, c, g, or t
  misc_feature (145)..(145): n is a, c, g, or t
  misc_feature (188)..(188): n is a, c, g, or t
  misc_feature (207)..(210): n is a, c, g, or t
  misc_feature (221)..(221): n is a, c, g, or t
  misc_feature (223)..(224): n is a, c, g, or t
  misc_feature (227)..(227): n is a, c, g, or t
  misc_feature (230)..(230): n is a, c, g, or t
  misc_feature (234)..(234): n is a, c, g, or t
  misc_feature (236)..(237): n is a, c, g, or t
  misc_feature (266)..(266): n is a, c, g, or t
  misc_feature (280)..(280): n is a, c, g, or t
  misc_feature (372)..(373): n is a, c, g, or t
  misc_feature (684)..(684): n is a, c, g, or t
ctggtgtccgcttacgtcggcaggacctgccttacacnggcggaagaacacgaccacctctgantgaccctccgcagngtctctttnattttgtttgtatgtgtgttttaatgcaancattccagctcacngtttcttatgtggngaaatattcagtagtcatcttgtacttgtactataggtaagancttaaaatgatcatcatcnnnngtggggtcttngnnggngcnaccngnnacattaattaattcattccatcagaagancttaaactagaganttaagcccactttatgaagagcgatttcacggctgcttgagccattcgaatttgggtttgtgttcagcactttaaaagggtcaactttttgnntctacccagattgggctcaggtctgtcttctcatccatccctttctaaagccaaagcgcatttgtagcacataatccaggagaagcagaagtaaatgctatgactggtggtatttcttagcctggttttgtagtttttaggcagtaagtagattatgagcgaacaaatgtgaaggttcatgtggagtcataatacctgtgatctaggtatggtcttagtcaagctcagagacaacaaagccttctaggtcattaggcaatggtgggtttctagcaccatagactgtctactgacctcatttttcttttggnatggagttagacatggggagcttcaaaaa

SEQ ID NO: 545480 - DNA, 203 bp, Homo sapiens
  misc_feature (31)..(31): n is a, c, g, or t
  misc_feature (61)..(61): n is a, c, g, or t
  misc_feature (64)..(64): n is a, c, g, or t
actatgagtgccatttgttctttttcgagtnccttgagaagtaatgtttgtttaaggtctntcncctttcttaatgtaggtgtttattgctataaacttccctcttagaactgcttttcctgcgtttctcaagatttggtatgttgtttccttttgcatttatttcaaaatatttttaaattaaacttttaacttcttccttg

SEQ ID NO: 545481 - DNA, 256 bp, Homo sapiens
caggtagaatgcagtgagttaaattgtgtccctaaaaaatatatgtccgtggccaggtacagtggctcatgcctgtaatcccagcactttgggaggctgaggtgaaatgatgacttgagcccaggagttcgagaccagtctgggcaacacagggagacctcatcgctataaacaaattcgaaaagttagcagacatggtggtccagctactcggaggcgaggtgggagaactgcttgaacccaggaggcggaggtc

SEQ ID NO: 545482 - DNA, 1439 bp, Homo sapiens
gttggtcgcttccctgcgccaaagtgagcaggtagccaacagtgtcacgggctgggagctcattattacaaaaccgagggcgatgaagaagcagatggaagaacaagaagagaaccttgcaacgcaacgtggagactactaaactattcacggaagacgactagtttgagtttctttctggttgactgcctccaaggctactgtcttgaactctcagagctgaacgatgagcttgacaccctttctgaccatgacgcatccagctgtatcccaaacgtgttgtcacactccacgtacagcactccataatgcaagttgatcgcagactctccttgtgctgctgcgtgttcctactggtaacccgacgaaagcacaaaacaacttccagctgacattcttaaaacatactttacggctccttaccacgcgacgctggcactaactccaagtgtgcaaaaaaaccgcaagttcctaagaacgcttctgacccacgctctctaaacggcggccacgccaccgggcaaccaaccacacacagctctctcccacacgaaccacttgcacttgtgggccccacggggactccttgagcataacctccacctccacgcctgaaaccgctcgccttgctgcgcgctcctgctgcccaaaacccttcctctctaagcctgaattggtcccacactttcaaacgactgcacgtccactacacgaacgcgactccacttgcccttgctctcaacccacaatcgaacggcacaaaagccccgccaactgtgccaacttgcaccacggctggcccacaaaggccaagccctggcgccccaagcggaagcccaacacacggccgcgggctgaacttctccccggacgcaataccacgcggcaatcatttccctctgcacctctgcgatcgccacccctgtgaacagcaaaaccctgggcggcggccctctcggaccccactaactccctcttggcttccctacccagcacgcacctctctccctccacggccctcttcgcgccgcaagcggctcttctgctgcggagccctctcgcgcggcgcctccacccctctgcgccggaacatcccccggcccacgcctatcaaacacacctggtttccccgcacgcctccgccgccgccgcggcgcaccccgcgtacccgcgcgcctccagcgcggtccacagcggacgcgcccccaccagcgcaactccgacccgcggcaggccccacaaacccggcccccaacgagggcgctccaagccctccccccaacagccctactccgcaaaacccccccgcgcacaccaccccccgccccccacacaacacaccgcccagccacccagcaaccccaccccaccaccgcccccgcgccctccccccaccaccacaacacgcccacccacccaccccacacccactgaccaca

SEQ ID NO: 545483 - DNA, 229 bp, Homo sapiens
tctcataaggagcgaggttacgagcagttcactgatgcagttgtgtcctggctacatcagcaactcgatatggccttgatttcttgctctgcgggctcttcatgctcagaacggacggcagtgccattcgagtaggacgcggcaccatgtactcacagacggcacatccctacccctttgtcagatgtatagacgggttcttagagatgatagacacattatacaaaga

SEQ ID NO: 545484 - DNA, 241 bp, Homo sapiens
gtgaatggttgcttacagaatctgaactgaaattaacacctagacatctgaagtatcccaggcttctcccccagtagagtagggatgtgtggaagccatgtaagaaatagattcctggccacatttggcattcagtcaaactgggtctactggacccacttcatgtcatttctccagcctcaaaataaataattgagatcaatatatttggcagttgacatcttattctgtgtgctgggag

SEQ ID NO: 545485 - DNA, 109 bp, Homo sapiens
cttctctccacatccctctctgtacttacagcccccaattggcccccaaaaagccagatgccaagaaggatgatgcaaggcaagccccaaagcagcttcagctcccgca

SEQ ID NO: 545486 - DNA, 215 bp, Homo sapiens
tagatatagcggatgaaatcctaaatgctggtgtgcggcaggtctaaaacatggggagagtctctgggatctggagttgagagccatgggtttggacatgtctgtgcacaaacagctgtcatatgttcatggacagatgtcatacatactcagatgtcttgatccacccagtatataccaggaaaacaacgcaatgtgttaaggtgatgctcccc

SEQ ID NO: 545487 - DNA, 1632 bp, Homo sapiens
gcgccatgaaccaggccaaagcggagcggagcgggggtgaggagagtcgagggaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggta

SEQ ID NO: 545488 - DNA, 206 bp, Homo sapiens
tgacagtgactccagctataactgatattatggaggtcagcacggtgctcactgtgtcgacggaacttgtacagggaggcatgcaccgaatgggtgaatacacgtctgaccaggctccagtgatcacgatactttggaggtcagcatggtgctcacgtgtcgacggaacttgtccagggaggcatgcaccgcagttgtgaatacac

SEQ ID NO: 545489 - DNA, 1784 bp, Homo sapiens
  misc_feature (7)..(7): n is a, c, g, or t
acttctngctaggtacgaggctgggtgttagcggacgcgaggcgacgcggagagggcggcctgggccgaagtgaggcgacgcggggcggcggagtctgagggccggagcggagcggaggcgacgcggggaggggcgagggatcgcggccggtggctgggggccacctgctccccgagcaccggcccccgctccggggagcagagtccggagcgggatccgcggcccacaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggta

SEQ ID NO: 545490 - DNA, 348 bp, Homo sapiens
agcacgcggttccgagatggtatagtaagaatctatgaggcaccagagtgttatgaatctcagcgagtggtctttgcagcatgagatctcatgtaagctaagcggtagttgtatttctgggaacccttacaagctctcggtgcagccgagtgaatgtggacgtgtgatatcttgagatgtgtacagacaggaatccacggccctctggctggtggtggccaacgacgcgaacgtcgacttgtctcgtctcgctttctgcatgcactttgcgctaggccaagaacccaaacacctttcatatttacgcccaataccagactcatagattacggtatacacaggataaca

SEQ ID NO: 545491 - DNA, 1344 bp, Homo sapiens
ttgctgttgctgctctttgttctcgtgtgttctatctctctttcgttgtgtgtgttgttcgttcttgtttctttctgttttcattttgtgtctttttgctcctgtatatttcctttttttgttgtatttgattttctgtgttattacttgtgtgctttttgtcgttgcgcttcttttttctctgtgctgtgtccttgtgtgcgtttcacagtcctgctgtgcctgctccccctattttgtggttgtgtccgcggtgttctcatattttcccactctttcttcttgttgggggctgttatgtaatttggctgtttttttttttctagtgtgggtgtcctatggtggtacttggtgtacggtatctctgtgttctagtatctgtggtaatggttttactactttttggcactcccgtatgttggatgtcaacattgtgtggctttatagtcgaaagtccctattatctgtaaaaaggatcacggttagtgaacttcctagcttgtctatgtccctgtaaggtccctatcccttctctgtttcagtgtgagtcagttatttgtttgtgaatacgtctgataacgatttgttatcgctattttagggatgtctgcctgcctttgtatatcgctgtgtgtttgcggtcgttccctgcgaagtgaggactatcgatctttgccgagatgtacccgtatctgccttttgatattctgtgtaggtaaatatggcagaaaacttgaattgatgctcgtagaatcttatgtgctcctggttacgcgccgacagttttcatgtttgcacgccacttctgtgccatggatacctctatcgtgtccaacctggaactggagacgttgtgtagtctacttctctcgtctcgcgtgaagatgtccatagtcgtgcctcttagaatcaaattatatcgtcatgcttactctatatgtcaggaggttattctgtgcacgtgtggcgctggcactcatgttattctaggggcaagtaataatggaatgctcactaagatactccatattttttcctccgtatcaccacagacagtcttctgacaggcgcaactcctccattttccatcaccgcaggtgagaaccctgtggagatgagtcagtgccatgactgagatggaaccgacccctaggttgtagagctaccttgcagttaccgcgagaactttctgacttcacagtctcattttgacagcatgaaatgtcctcatgaagcagtagcattttaaatatcatgttccattgctactcctccctcatgactctaagaagttctctcttctggaatcgcgtgaacccaggaaacggacggtggcagtaagca

SEQ ID NO: 545492 - DNA, 2688 bp, Homo sapiens
  misc_feature (2536)..(2536): n is a, c, g, or t
  misc_feature (2688)..(2688): n is a, c, g, or t
gcgccatgaaccaggccaaagcggagcggagcgggggtgaggagagtcgagggaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaacttctgcctacattttggaaagtgatgctggtggggaaagttctagatcttacttggtttcttctagaatcagtcttcaggaatggattttgtcacaaatggggcatgggggctttctgaggaaataactacaagtcttggtggtgggctccttattatgtttctttttctttcattcttgatacttggaagtcgtctgaatcctttagcttcaaaccagcctgagtttgagtgcttgccgtagcagaaactatccttaccacaggtgggaaggaaaggaccagtttctagcagtgtcgggccactcctctttcgaacatccctaagggaggcattcacaaaagctgtcccaagcagctggaagaaaacagcttccgagatgaccaggaggactgggcggcgccgagcccagaacgctcctggcgcagcaccgttggcgttggccgattgctgctggtggggggcgggggtgcaggccccagtctctatgcaaatcagggatcagaagatcggaatttccaccaatcagcgggaagcctcggccctgtaactgctaatgggagacagcagcgccacgccacaggcttttcccctggtttcgggaggggtggggagccaggtggggctcccgcccagaccctttcccgaggtccgccctctccgccttttctctaaattcctcttttgagtgccctcccttccggttgagaggcgggggttggcccgtagttgtacactcagtcaccctgcactgtggaggcgggggcctcccttgtggactgatttgcgtgggatttggttgttttattaagagatttaaaaaattcagatgacttactagtatgactgttttgtcatatttgcttccaggttaataaatgacaaaaatgaaaaaaaaaaanggggcgtctaatatcccgagggccatttagctcccgtttgtcaagggccatgggcgataaaaagacggcggtaacgcggtggaaagtccggtttggacccctggggtggaccacgagcggaaatgttgtacatgtgtgtatttaaaaaagtn

SEQ ID NO: 545493 - DNA, 108 bp, Homo sapiens
tcaggaaacgactgaattccatttcaaacttcagttgaaaagccactgaggactctgaagccaaggaggtagacatggacctcactttatcatgttgaagacacacgt

SEQ ID NO: 545494 - DNA, 1626 bp, Homo sapiens
  misc_feature (7)..(7): n is a, c, g, or t
acttctngctaggtacgaggctgggtgttagcggacgcgaggcgacgcggagagggcggcctgggccgaaaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggta

SEQ ID NO: 545495 - DNA, 701 bp, Homo sapiens
  misc_feature (126)..(126): n is a, c, g, or t
ctacgacaaacaacattctgttcctcccccaaaatgaacccccgttggaattggaaaggttttaagaaccctgttggttaaatttctttgggaaaactcccacttggaacccccccacgaggcccncttgtgcccccaggacccactttcttggctaacccctctgtctaaataggacaatgtgcctctctcgtgagactttctctacaacttttatacaaatttatgtaaagcttatggagaggaaggattaataagcgccattcgtgccccccctttgcgcctcttgaggaaattgggcctgcctggtttctctaaataatcaattacttttcctaaagatatgccccaggactatgttaatggaaaaaagagttttctcccttgatgaccatatctttaaacatttcttgcatccagtatttcgtaaattgagccaactgacaagattttcatccaggaaaggagcccctgtgggaagagccccagtattcaccattttttcccccattttgtccagaagcgacccatttcaataataataggtgcccaaaaatgaatccggggtcccggagaatgggaaccttttgaattatgattgtcacagagatggtagaattatgatctgactggaaacaatcctgtatcccctccccaagaatcatgggctttttttttgaattaaaaagcagaccaataga

SEQ ID NO: 545496 - DNA, 1775 bp, Homo sapiens
cacgagggggattctgcaccccggccccgggccgtccagtggccgccctcgaggtgaccggttgctggccggcgtgggtcgctgaccccagcggggactggggggaaggacggggagttgggggcaccaagtcacccggaggaggcgaccccagctagctgcgcttgccctgcttcgctggactgtgaagccccctccgctgcggctcttcctgcgctcaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggta

SEQ ID NO: 545497 - DNA, 1746 bp, Homo sapiens
ccgcgggcgagcgcgcccgacattagcttgaatacagaccgtgcgtttaaatggccgcgagcagccggcacggtacggaggcgacgcggggaggggcgagggatcgcggccggtggctgggggccacctgctccccgagcaccggcccccgctccggggagcagagtccggagcgggatccgcggcccacaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggta

SEQ ID NO: 545498 - DNA, 2849 bp, Homo sapiens
gcgccatgaaccaggccaaagcggagcggagcgggggtgaggagagtcgagggaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaacttctgcctacattttggaaagtgatgctggtggggaaagttctagatcttacttggtttcttctagaatcagtcttcaggaatggattttgtcacaaatggggcatgggggctttctgaggaaataactacaagtcttggtggtgggctccttattatgtttctttttctttcattcttgatacttggaagtcgtctgaatcctttagcttcaaaccagcctgagtttgagtgcttgccgtagcagaaactatccttaccacaggtgggaaggaaaggaccagtttctagcagtgtcgggccactcctctttcgaacatccctaagggaggcattcacaaaagctgtcccaagcagctggaagaaaacagcttccgagatgaccaggaggactgggcggcgccgagcccagaacgctcctggcgcagcaccgttggcgttggccgattgctgctggtggggggcgggggtgcaggccccagtctctatgcaaatcagggatcagaagatcggaatttccaccaatcagcgggaagcctcggccctgtaactgctaatgggagacagcagcgccacgccacaggcttttcccctggtttcgggaggggtggggagccaggtggggctcccgcccagaccctttcccgaggtccgccctctccgccttttctctaaattcctcttttgagtgccctcccttccggttgagaggcgggggttggcccgtagttgtacactcagtcaccctgcactgtggaggcgggggcctcccttgtggactgatttgcgtgggatttggttgttttattaagagatttaaaaaattcagatgacttactagtatgactgttttgtcatatttgcttccaggttaataaatgaccaaaaatgaccacaaacacaaaaacaacaaacaaaaaacaacaaacacacaagaaaagaaaagcgaaaatagaatgagaagaacaagagacgacaacaagcagcatgaccaacaaataagagcgaggaggcagaagtaagcacaggaggcagaaataagcagcaaccaccttgtgtcgaaaaggaggagccgccaggagagacgaaagtacgacacgacagccagagcgcggaacacacgagtagaggagaagagagcggagaaaacgaaccaaccaccagtgggggtgagcagagaggagacaactaggagagtaagccggcgagacaaat

SEQ ID NO: 545499 - DNA, 2250 bp, Homo sapiens
  misc_feature (2098)..(2098): n is a, c, g, or t
  misc_feature (2250)..(2250): n is a, c, g, or t
gcgccatgaaccaggccaaagcggagcggagcgggggtgaggagagtcgagggaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaacttctgcctacattttggaaagtgatgctggtggggaaagttctagatcttacttggtttcttctagaatcagtcttcaggaatggattttgtcacaaatggggcatgggggctttctgaggaaataactacaagtcttggtggtgggctccttattatgtttctttttctttcattcttgatacttggaagtcgtctgaatcctttagcttcaaaccagcctgagtttgagtgcttgccgtagcagaaactatccttaccacaggtgggaaggaaaggaccagtttctagcagtgtcgggccactcctctttcgaacatccctaagggatcccttgtggactgatttgcgtgggatttggttgttttattaagagatttaaaaaattcagatgacttactagtatgactgttttgtcatatttgcttccaggttaataaatgacaaaaatgaaaaaaaaaaanggggcgtctaatatcccgagggccatttagctcccgtttgtcaagggccatgggcgataaaaagacggcggtaacgcggtggaaagtccggtttggacccctggggtggaccacgagcggaaatgttgtacatgtgtgtatttaaaaaagtn

SEQ ID NO: 545500 - DNA, 2203 bp, Homo sapiens
  misc_feature (2051)..(2051): n is a, c, g, or t
  misc_feature (2203)..(2203): n is a, c, g, or t
gcgccatgaaccaggccaaagcggagcggagcgggggtgaggagagtcgagggaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaacttctgcctacattttggaaagtgatgctggtggggaaagttctagatcttacttggtttcttctagaatcagtcttcaggaatggattttgtcacaaatggggcatgggggctttctgaggaaataactacaagtcttggtggtgggctccttattatgtttctttttctttcattcttgatacttggaagtcgtctgaatcctttagcttcaaaccagcctgagtttgagtgcttgccgtagttgtacactcagtcaccctgcactgtggaggcgggggcctcccttgtggactgatttgcgtgggatttggttgttttattaagagatttaaaaaattcagatgacttactagtatgactgttttgtcatatttgcttccaggttaataaatgacaaaaatgaaaaaaaaaaanggggcgtctaatatcccgagggccatttagctcccgtttgtcaagggccatgggcgataaaaagacggcggtaacgcggtggaaagtccggtttggacccctggggtggaccacgagcggaaatgttgtacatgtgtgtatttaaaaaagtn

SEQ ID NO: 545501 - DNA, 709 bp, Homo sapiens
tctctctctctctctctctctctcgctctctctctatccggctcttactctgtatgagggtcgctcctgcctactgatacacagttcgccagcatgtgcttgcaggggaccaaaccgatgggactgttcagtgctatccgggagcctgaacttcatgactggggcacacacatacacctaccctctggcacagctgagggcgctagtcacagtcgttgtttgccactttctataaattcatcctcctatccactaaccatcataaactctttctcacgtcctgatatatcctcgcggattcatttcacttgcattgaaaatacactgagatctatgccttaatcacttcacgccagaaatctgcgccttcctacaaaactataggggggcgcctggcaccaatatcccttatgacgtgccttactacaagtcactgtacctctaacgacaccgccttgactgcgtaaacgccggcagcatacctacggcatgagacctgacaaacatgcccccttttcccagctggagccctgctaactagccctacaccgatcgaccttccgaacagtttacccacactgaatgaccacaggctctatcgcaaactgccacattcgcttaacacgctcgtctaactgtagtcgaacaacctatatctttgacattcgttccactactgtcccaacttcgagcaacattcaatcttccc

SEQ ID NO: 545502 - DNA, 2545 bp, Homo sapiens
  misc_feature (2393)..(2393): n is a, c, g, or t
  misc_feature (2545)..(2545): n is a, c, g, or t
gcgccatgaaccaggccaaagcggagcggagcgggggtgaggagagtcgagggaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaacttctgcctacattttggaaagtgatgctggtggggaaagttctagatcttacttggtttcttctagaatcagtcttcaggaatggattttgtcacaaatggggcatgggggctttctgaggaaataactacaagtcttggtggtgggctccttattatgtttctttttctttcattcttgatacttggaagtcgtctgaatcctttagcttcaaaccagcctgagtttgagtgcttgccgtagcagaaactatccttaccacaggtgggaaggaaaggaccagtttctagcagtgtcgggccactcctctttcgaacatccctaagggaggcattcacaaaagctgtcccaagcagctggaagaaaacagcttccgagatgaccaggaggactgggcggcgccgagcccagaacgctcctggcgcagcaccgttggcgttggccgattgctgctggtggggggcgggggtgcaggccccagtctctatgcaaatcagggatcagaagatcggaatttccaccaatcagcgggaagcctcggccctgtaactgctaatgggagacagcagcgccacgccacaggcttttcccctggtttcgggaggggtggggagccaggtggggctcccgcccagaccctttcccgaggtccgccctctccgccttttctctaaattcctcttttgagtgccctcccttccggttgagaggcgggggttggcccgtagttgtacactcagtcaccctgcactgtggaggcgggggcctcccttgtggactgatttgcgtgggatttggttgttttattaagagatttaaaaaattcagatgacttactagtatgactgttttgtcatatttgcttccaggttaataaatgacaaaaatgaaaaaaaaaaanggggcgtctaatatcccgagggccatttagctcccgtttgtcaagggccatgggcgataaaaagacggcggtaacgcggtggaaagtccggtttggacccctggggtggaccacgagcggaaatgttgtacatgtgtgtatttaaaaaagtn

SEQ ID NO: 545503 - DNA, 948 bp, Homo sapiens
cgcctttgcccggggaggaagagaaatctctggccttatctcctcctgttccccggggccgccgaggcgtcgtcctgggggagccatctcctcaaatcaggacactcaaggcctccctccctcgcaagcggggccgtccccccaagtcagggccaggagcccccactggtgcaggtgcatgggggtgacctagctcccagctaggtcatggcagtgggcgggagcgacctcctcctgcatcgatgatcacgggtggtgccctatacggtctctgcaaggttcagcggctgtggcgcctgagggctctggccccagtgaatggccccacacttctgcccggtgtgcctgcgggccttcccctaccgtctccgacctggagcgccaacagtcatctctgcaactcagagctgaagccgaaccagtgcaaggttagcggcaagaccttgcaaggcgctccagccacctgcggcggcgctgcagcatcctatgccggcctgcgggccttcgcgtgcgccgctgtgcccccgggcgtcttgcctgcgaggtgggcgagctggtgcacgcatgcacgcgtgcgctcgggggagcgcccgtaccagtgccccatctgccggctgcgcttcacagaggccactgcgctccggcgccatgcgaagcgcaagcatccggaggccatgggggtacccctgtgtgcaccagatcccagcgttccgcatcgtcgtgggacgaggagggcatcccggccaaacagggggcgaaggagagacgagacacagaggggaaaggggagccggctgaaccgagaccccggacaaagctcccgggcaggttaaagccaggagtttggtgtgttgggctgatccaggggcgggacaccttgtttccggggctccgcgtgggacagtgcgggggcgactcacactggggtctcctggtcaccccctccaa

SEQ ID NO: 545504 - DNA, 1369 bp, Homo sapiens
acacaaagaaaagataagcgaggtgaaggaaatcccagttaccctcattcagtccattacacattcgatacaggtatcaaaatatccatcaggcacctcaaagcacatgtacaactcttaatttcaaccattattgcacacagcaacaaacaaaaccggccagcagcattaaaaccaaatcacacacataagcaacacacagcaggcccactgttcaggtgacagaactccgcatgcttccagcaacagcagcaatcagcagcgctcgcttcaccgtgggcaacacggccagtataacaaaatgggtttagggtttttctgttattgtttatagtatttcacccattggtcacatccagcatagttcacaccatcaagtaggtcagaactatcgctagcacatttgtcaatcaaagccattatgtctcaagcagtgtcacaacagtcccaacattcacaaacagtcatctgcacagcaacacaaccagcagtcatggccacaatgaagcgcgtaaagcaccattgtattccacacacaacagaagacaggctaaagcgcgtaccatcacccaagccacatctcatcctataactccctaaaagcaatgggtccattagcccatatccatcaacaagagacgcagtgccattgcacacagggcaaaattacaggcatacattaagggatgccatatatatatattaaaaacaggcaattcttaataacaccggaaagaggatccagacaatatcaaggttaggcatatcacaagaaagtaaggagacccgaaattagtggataagacaaacataaatatcattaaagaacaagaggcgccaagaaatatttcatggcgccccttgcggaactattcacactgggctaattgtcacaacaattggtgaccctagggtgtaaaccaaggatcaatgggaaacattcgatcggccaatgatgtgacagcggataaatgcaccacaggaaatatcactgatgcagagaaatagatttatcgagagagacaccattatcacattgaccaaaggcacacgaccacatgaacacacaccgcgatgacgcgcactgtggtacaccccacaaacaccagacgaaagacgggctacacacacagaataagtgacatcggcgccacgagcacaacaagaacaagaactacgcaaatgaaagaacacaaacaagccaacaacaatacacccacatagcaggacaccaaccgaaccgaacgcacaaaaacacgaactcaccagcgccacgagcacaccaaaacaccaacaaacacgcaccacgcacaaactgaacacacacacacaaccaacaacacaacacggcaaaacaacaagaacacaa

SEQ ID NO: 545505 - DNA, 322 bp, Homo sapiens
  misc_feature (123)..(123): n is a, c, g, or t
aatgaggacacattttccaggaggggtaggaagactgggattcctgaggaaagacaggaaagggagggacaaagagtaaaaaaggccctcagaggaaaggggccaggggacaagctgcttctntgcaattttacaggcccaagtccaaaaggcggacagccacccaggggactgatattgctctttgatacccacatatctgctttattgtttcagaaatctgtccattatgaggatgaaaattctcttttaaaacttctctttcatagaaaaatacctctattttcttaggctgtagcaggtctgacagggttctgtatgc

SEQ ID NO: 545506 - DNA, 404 bp, Homo sapiens
gacttacactttgaaagacgtgatggatttatataagcagagagaaactggaaggacagggttattagaggagagtggggatgagtatttggagaatcactggaagatagctctaattgagctggatgaagtatgttgaatagtgagtgacaagtagatgatcagggtggatctggattagtggatcttaactaaaggttcacctcaataacctaagactcttccaagtacaagaggggcccatttccaaatctgctgactcaatagtgagaatgggagtggaatggggcccaggtacaagtatttgaaagaggtccccaggtgattgtgatgtgcattctttgccgagaggcatcggcctggatgacagagggcaaagacataaacagtatattagggagact

SEQ ID NO: 545507 - DNA, 112 bp, Homo sapiens
gagaggcagtgcagagggcacggagcacagatgtgaggaagcggcgccaatgtcaccacgtgagaagcgggatgtgtgctggcggaccaggacgcagaggctgcgtgtagcg

SEQ ID NO: 545508 - DNA, 850 bp, Homo sapiens
  misc_feature (217)..(217): n is a, c, g, or t
ggtgtggtccaggctctgggcacagcggcctgtcccttgcgagccataacgtgcccccagagtgtaggggggcttgcggaagccatagggggctgctcgggatgcgtggaaggcgagaaacctagttctcagggagggaaggggatggaggccagagtctcgcagtgggtgatgcttttgttgcatgcattcaatcgctaccccgcgtctctccagnagtcacgcagggtggaccatggggtagaggcgaaacgggcgccgatgcccacgcattcgcatcctcctcgtcatcatttgcatatgtggcattgagttgtcaccccctcttgaagcaataacgtccaaggagactcccaggccccatggtacccctgtgggtgggctagggatgccccaatgagctcgcaagcgagcctcctccagggggtaggaagaagtcatcgtgcactctagtgccacgtgcaagagcaaagtacatcagtataattatatcttgggggagttttgggccagggaagggcgcagggaaattgggggcaaagttcagggtggccaggagacctctatggattgtaacagaagaactctcatttataatgtaattattcgcgtgggaaaggaagatacccgttctaggtggtgattgaaacgtttgtgagatgagaggaaagggatgatataatagccgagctcaaggattaacaaggcgaataaaggatgcgggggtgtatcccagggtgggggcagaagggttcttcgaagagggccatgggggcttgcagggttttggtggaccaccgttttggggggggcatggggttggtctggcggggcggccataagggggggg

SEQ ID NO: 545509 - DNA, 671 bp, Homo sapiens
gagagaactcgtctcgagttttttgagggttttggtttggagggggaatgctggaaattgtacatgggtatggaaacttttcatataagtaatgctagggtgagtggtaggaagtttttccataggaggtgtatgagtgggccgtaccggaatcgggggtatgctgtccgaattcataaaaacagggaggttaaaagtagggtctgggtgacaacaatatgttgtgtaaagtttcaggggagcagtgcgtcatatgttgtccctaggaaaatggtcgcgggtgagggtgttaataataataactgtcggtgtatccggctatgaacaatagggcgaaggggcctgcggggtatccgatgttagaacgcctgagcactagtccggagtcccacttcggcaaggctcgaaaggggagcttccggatgggctctctggccaaatgtggataataacatcatatatatggggcccaaagggggcccactagcagtggacaagagcaccgtacctccaagacgccgtgtaccatagcgagagctaaggtagacatcacggcgcgagtgcaaacagcggtgtaaaacagcgacgcccgccttcatacctagaggaaagtgctggaacagcacacgcaaacggatcgcgcacaggagagactccaccccaatgcaaac

SEQ ID NO: 545510 - DNA, 100 bp, Homo sapiens
tgtagaggacccggtatattggatagcttgaggatttcgtgggaacgggaaaaccttcatataaatctagacagaagcattctcagaaacttcttggtaa

SEQ ID NO: 545511 - DNA, 260 bp, Homo sapiens
tgacatggtcaacatcatcttctttattagtcttgctagcggtctgtgttgttgatcttttcaaaaaaccagctcctggattcattgatttttttgaagtgtatatagtgtctcttatctcctttagttctgctctgaacttattttttgacttctgctagcttttgagtttctttgctctggcttctctagtccttgttcttttttttttcttcttctttttttttttttggaaatgttttggaaatttttaaaattgg

SEQ ID NO: 545512 - DNA, 1013 bp, Homo sapiens
gtctattctactgatcatgacccacgatggtctagcaactcactgcacctcaatgattataggccacttgagcttgcacctgggtgccagagatatagtctcgcaagggaaggacttaatcaatattaccatcttttaaatagccccgtgaattaactctcactttttacacgtgctgtcgtaatgtatatttaaacctagataaattataacttgggtgataggagaagaccaaatcataacgagcactccagatagctcccacgtgatctaccataaagcaacaagtgtggatatgcagctaaaccctggtgcatagtaatagcagcaattatgtaggaggataaccttattatagggtagacctgagttaggagctttactcagtaccattgtcttgagtactctcgcgtatgtcgcaaaaaaaaaaaaacactcttcacgatcccaatctacttgaagtctattgcctaataatcgcacacctctacgtatacattacacgcttagtaaaatctttaatcttcgtgaggatcactagagctatggaatcaccgatacatgacgcgattaattaaggcccatatgatcatttgacaaggatgatcatgttaagaaataaatgaatacccatcctattcacgatgatcgaccgtcactggcggaaaactagttaacttgatagacacaggacggtttacggcggtgcaagcatgcgcgaactgacccgtgactcgggcttcgacgactatacccttaatttctacattgacaacgtctacatcaacactcgcaaagttttgtgacgcggaattcttattctactcgcttattatgacaggagagcgtgaatagctggaaagtataaaggttacgcccatggaaagatcatttacctcacctcccggcaatataatgcacgtggtccatgcggaccttggcgaaccggactggaatcctgatccttttaatagccccgccaacatgggaggaaggccacaacacagtggagt

SEQ ID NO: 545513 - DNA, 414 bp, Homo sapiens
gctgacttagaggatcccaagctccaacaagaacagaaccacaaataggagcaatgaatcagtttctagcatctctgctatacacagggcactatatcttatagaaacatagctagtacaagaacaactgtactaattacattaccccttgcttcccagtcaaaaaaggctatagagaaaaacactttaaattgtactctaatacaaatttgttcgccaacttaagcttcaacttactcaaagagttatcgtattgtaaactgcagaaaatagaataggcattcaataaatctgctcacaattaacaattaagcaatagacacttgaataaatatagcatgtattacttatttgttaagccttacacttacgatgagcagatggtttatcactatatagtcttgttgggagctt

SEQ ID NO: 545514 - DNA, 411 bp, Homo sapiens
gcgctccctagctctcgctggctttgtcacccggaccgctccacgggtggctgccatatcccacagttaaaaggaggctgcagggacggaggagctgcctctgctgcatgttgggcctcagggggaggcggtctggtggacggggtcttctgaagtgggaggaggaaaggcagaggaacagggtccagggtccacagaggaagagcaggaggcccacggggaacctcgaccaaagttctctgccaaggcagggcagggccacctgccaggacgtccaggccaaactcttgcctcttcaggagctgcactcaaacccggaagccaagagtcaagctgagtctgggggaaataaagtttataataatagacttgaatgtggaaaaataaagcaaatttaataagtttaaaaaa

SEQ ID NO: 545515 - DNA, 757 bp, Homo sapiens
  misc_feature (298)..(298): n is a, c, g, or t
ctttggagccggcagcccagggtccctgctggatcagagaaatagaagcacccgaagacggttagtggcaattccttgacccggttagcttccaaatgaaggccatttgtccaccaggcattgaaaagacatgacttacccagtccggcatcggacttgaaaaatcgaaattgacatcactcagctgttacatttcacatccgattcagcccccttttatttccatgtgcttttcgcagccttcctgtgttggatgaaagagaataagaattcagctagacaggaggcactctatccntgtcccgtccgaactccaccactccactctcaatccacctcccgatctgtgccgcagacctacctcgactactaggacctgaggcagctccttagcagagacccctggggtttagctgactctgggggtcaggggttccatgtcccacaaacttcgcaagacagccctgaagtcacaagtgctttcttttaagtggcattggcaataggacgtgtaatgatggcagtagaatctgaatctcggatcccaggcagggttcacatttccaaacctttttgatttcccctgaactcataatggctggatcctattagatctacaaacttatacagtgacatcgtacaggtaacttgactaggccatttacaaaaacaaataagatttactcacttgtaagtcacccgcagttacctaagttaggctaacggagacttggacaggactggatatttctggcca

SEQ ID NO: 545516 - DNA, 141 bp, Homo sapiens
tttttttttccctgtggcgatccactcaattgagataaatatagtgcttacattttcagtcagtacgtggtccttatcattcctttaataatacacccagaggctgggcacagtggctcatgcctgtaatcccagcacttt

SEQ ID NO: 545517 - DNA, 645 bp, Homo sapiens
  misc_feature (30)..(30): n is a, c, g, or t
  misc_feature (64)..(64): n is a, c, g, or t
  misc_feature (78)..(78): n is a, c, g, or t
  misc_feature (189)..(189): n is a, c, g, or t
  misc_feature (375)..(375): n is a, c, g, or t
  misc_feature (378)..(378): n is a, c, g, or t
  misc_feature (479)..(479): n is a, c, g, or t
  misc_feature (581)..(581): n is a, c, g, or t
  misc_feature (583)..(583): n is a, c, g, or t
  misc_feature (595)..(595): n is a, c, g, or t
aggttacagggctcacccgtagattcagtntggtctctccccatcatgcctcttacttccagtntgggcttctttttngtgggccccgacttcttccctcccagttattctctcgaatggtgattctttcctcattccagggccaccaaggctcaggtgggggcctgtccatcaccagttgagccaganaagccctcccatcggacgtcctgtggctgggcccagacatgggtgccgccgcctgtggggctgccctgccgggggggccagggtgtcttcagtgccctgggcctgcgcgtgggggggggtgggcggaggtctggggctctttgagcccaaaggcatcacggccctctcggaagccgcgggccccgnagnggtccccctcgcagccagcgcgggaggggtggcatcctccttgccgacgccgcccccggggagcccctctccctcagcctccggcctggggtccacacccngggcctcaggctctgcccgcggggttgcgtcccgggtcgcgaagcctgcgctgcagggctgtcaaagccacttgccttaaccagggcagcttcttcagttancngctgcaggactntttggatggctgtttcctcaacctcgtcgtcatcactgtttgggaggcga

SEQ ID NO: 545518 - DNA, 1180 bp, Homo sapiens
gacgggagttcctccttgctctcgcccctactctttctggtgttagatcgagctaccctctaaaagcagtttagagtggtaaaaaaaaaaaaaaaaccacaccaaacggctcggagccacaaaggggatgaaatttcttcgggacatcctcctggttctcccgttactggatcgtctggctcccctaaagtccttcgtggaacgcttttatatccctaagagggaggaaaatcagtcacccggcgaaatcgtgctgattacagggagctggcgcttggaacttggggagactgactgcctattgaatttgtgctaaacttaaaagcaagcgtggtcctcgggcggatataaataagcatgtggacctggaggaacaccgtctgccaaagtgcacagggacctggcgtgccccaagggcttccaatacccctttgttggtccacaccttgggacgaaaaccgcgacgacacgcatttttcaacaagcttcttgccacaaacacaccggtcgaacggcgccggcacaatcttggggcaacactcggtgcacgacacttctccacggtgacaactaaatcgcctgggttggtaagtcttattaccccttccagcaaatttcgggcttggggcctaacgccgaaagagaaatgccccttccggggatttttgcacacaacaagagcgacttttttggagaaaagcgtttaaacaggtggtcacacctttgtaggcccccacatttttgccctggcgaaagtctcaatcccaaagccggggccattatcaccatagtcgccgtggtcacacagtgcacgcgcagcagcacaatttgatgccccctgtgtggtgcccataatgtgggttcacccccttggtggagggaaccttacccggacgagaagtgcatgtgagcacaaccacatgtctgttgtccacgaggcatcccccccattgtactataaaaagcggtgggacattacacaccgtggtgtcccaccagacgaccaacagagatttgtgcgccactgaacgacgatgatcggagaaattctcgccgtgaaagaacactttctgtgcgaaaacgcagatgttgaacacacgtgggatcttgtcgccttttacgaaccaacataacagcgcggcgacggtctcgtaacaagctcccaaccattgtgtgtccc

SEQ ID NO: 545519 - DNA, 295 bp, Homo sapiens
tgcagcacacttggttgtccccagtttgcggccattatgggtcaagctgacatccaacacctgggtgcaggtttatgtgtacacctcaagttaacaatcatggtgtgtccatactaagtggtatatattgtaccagtcatgttcagaaatgcaacaatgacccactgccttctccaagtggctgtagtcatttacatctcacacagccatcaatcacaagttcctgttcacattgatacacatcttccacaccattgggtgttgtccagtgttcctgcattctggccatgacaac

SEQ ID NO: 545520 - DNA, 119 bp, Homo sapiens
aaaaaaagccttttttgttttcccccccggcccccaagggggggtgaaatgaaaaaaagcattttttgttttccccccaggcccccaaggggggtttttttttttcctcctaatgttga

SEQ ID NO: 545521 - DNA, 412 bp, Homo sapiens
tgcactgattctgcaggtgatctagaggacccctgccagctgaggttgtcaggtacaatgaaaccaaacatggcggtatggaagcagattattctgccatttatccaggatctatatgacgttgcacgtcaaatctggggctgatcacactccacacttgctgtagcctgcctgtgaggttcacaacaattttcccagctctgtggtcatctatgatatcaaattcgccatatgtaaccatgtctttctcatcacatgtgagaaagcggacgatgacttcggagcacggtctaatatgcaccttgcgtttgcctctctttgcggcattgttgatactcttgagagcatctgccaagacatgcatgcgcaccattgtggcggcgcggaaagatggcggaaagaggagagtggg

SEQ ID NO: 545522 - DNA, 130 bp, Homo sapiens
cctttttccccggggggccccccccttttgggggcccccgggttttttttcccccccccccccccccccccctggggttttttttggggttgggggggggggggggaataaaaaagggggttttttgcca

SEQ ID NO: 545523 - DNA, 997 bp, Homo sapiens
tagtctcgcgcagtctcagctgtagctgcaggactgagccgtgcacacggaggagaccccggaggaggcgacaaacttcgcagtgccgcgacccaaccccagcccgtgggtagcctgcagcatggtccatttgttccatgcacaactgtggcggcacctggtcctggccaggctcctgcagtttagcagatgttcttggaaggagacagtcagaggaccgcgcttttcgcgtgcgcatcgcgggcgacgcgccactgcatgggcgtgctcgggctggcgccctcaccatcccttgccacgtccactacctgcggccaccggcgagccgcgggctgtgcttgggctctccgcgggtcaagtggactttccgtgtcccggggcctgggaggcagaggtgctggtggcgcggggagtgccgcgtcacggtgaaccgagggcctaccggttccgccgtggcactgcctgcgtacccaggcgttcgctcaccgacgtctccctgggccgcctgagccgagctgcgcccaacgactcaggtatctattcgctgtgaggtccagcacggcatcgattgacagcagtcgacgctgtggatggtcaggtccaaggggtcgtctttctctaccgagaggctcttgcccgtatgctttctcctcttctggggcccaggaggcctgttgcccgattggagcccctcaatcgctaccccggagcaactctattgcggctaccttggggggctatagcatgtgattgctgtggcatgacggctccagacgggacgggttccattccaacgcaagaaaaggctgtcacggcgcatgatgttcccgggtccgacatatgggtgggcaccggatgacctatgatgtgtcgcatgcggacccataggaaacggccgctacaccacagaggactggagacagcacgcgaacgaagagacgcacgccctcaatacgcgacgcaaccagctataagtgtacccacagtggcgggaata

SEQ ID NO: 545524 - DNA, 178 bp, Homo sapiens
tcccatcacgtaggcttgaggttgagtgagtggcatgatctcagcttactgcagcctcaacctcctggactcaggtgagaggaactacatggtacatgccaccatgcctggctagttttcatattttctgtagagacagggtttcactatgttgcccagcctgatcttcaactccgtg

SEQ ID NO: 545525 - DNA, 300 bp, Homo sapiens
tgtctacaggatccgttcgattggcgggcacttatgcacgcttacgtcttaacaagctttgagtgtaagagattgaagagtacaaatctgaccaagatgttgatgttggataagagaattctctgctccccagcgtctaagttgcccgccaatcgaatggattggcgggcaacttatgcgtgctgatctatgctgtctactgtccattgtcagacattgaagagctcaaatctgaccaggatgttgatgttggataagagaattctctgctccccacctctaagttgcccgccaatcgaa

SEQ ID NO: 545526 - DNA, 935 bp, Homo sapiens
cagggaacaaccacgtgtgtgttgatagcgcagaagctgttcgcagagaatatatttttgcgaaaagtgtgtctggggaatataatatctaaaaggttagaccgcgcgaggtcaacaacactctggtgagtataatacgggcctgccccccccccgctttgtatgtaacatccgccccgtgtctctgtgatggcatgtaatactactctggcgtgctggccgtattccacggtgttcacaatgtgcttgtagaagacaagccccccactggcctatcagcgctgttcatgaatgtggtcccactccctgcactaaggttgcgccccttggcgagaatataccagtgccacacagggggaaatatcttctcctatgatgtccgcggaggctatatacccttgcgccacaaatcttggccgcacggggagtcgcgacatttggtaccagaaattcctccttctcctggcttcacgccacgataagatgccgccccgctctctcgcaatggtgtgaagcaaaaataagttgcgaggcacaatgtgttaataagtatacggacagacaagcttgtcaagagggcataaacaaaaaattaaaacaatgttctggtaatccactgaggagcagagggacacccctctcgagagtggacgttctgcgagaacaaccacgaaactccctcataaaggcaccacctttgccccccagaaatggttgcaccaaaattccccccctatgtaactggcagttgtcacatccccccataggtgataccgatacgtctctgataaaaaaacagctgagaccaccacaaacatgttacccaatacagtgaagtatacgtagacaacataccccccacgttgatatttcaactcgaaaaacattctgtctgaaaaaaaatttttcttaaaaaaaagaaaaccaacaaaaca

SEQ ID NO: 545527 - DNA, 193 bp, Homo sapiens
tggaacggttttttctttttccccccaggggggggggcaatgccttttttttagtttaaaaaaaccttcgccttccgggttaaagggtttttttggcctaaacctcccaagggggtggaacttaaggggtcccccggttttccccccctaattttagtttttttgggagggccggggtttccccattttggcc

SEQ ID NO: 545528 - DNA, 672 bp, Homo sapiens
atcggactgagaaagctctcaggcgcgcgacgccgagaactttggttatcgaagttacttgtgtgtcatctgcttattgttattcattaatctttatatatttcttatataatcaattacattaaaataatatataatctttttatatttcttataccttatcatatttacttcttctttttttttcactatctatattttttttattatcttattacataatctatttatatacttttactcttaccttactaatatatttttctcttttatatatataaaatattataccttcatttattatatttcttcaaatatactactcatcttcttttttatctaactcttatctttcattatactttatatatacattcttcttttattatattatatctttaatatcttttttatcctattactacttttctcttctacaatatacttcctatttttatcactcttacttacatctaacataatcattcttataaactttcttttatcttcattttctttacttactctcctttatattctcattcataactttttaatatcaatattctatcatttcatcttcatctaattcattccttaccactttctatcttatttacattctactctatctttctatattatcttcacttattctcaattatctctcca

SEQ ID NO: 545529 - DNA, 156 bp, Homo sapiens
agaagaaagaaaggcccgtccacaggcccggctctgggcaacggtggcccgcgcagcaggtgtgtccagagtcagctgagggctcttcccacaacacccagcaggcgctggtgccttcttctgcctcatgggagcagttcagctttcagccgctct

SEQ ID NO: 545530 - DNA, 362 bp, Homo sapiens
cgtacaaggccccgcacgggaaaagctgcgtcgacacccctcctgcctggaagacgaagctgctggtcacgtgacccaatgctcgcatggtcagtaaaagcaaagacgggactggaagcgatgacaaaaaagccaagggggctgatggtaaaacgaagatcaccacaccgcgggcggggccttgtacgcgtacaaggccccgcgcgggggtgctgcgagttggctgaagatgctgcggtggcaggggaggccaggccccgcacttggtctggcttggggccaccccggagatagagaggacccgagagggtatcccttcggggaatggtcattcaagcaattcaggaagttacccaattttc

SEQ ID NO: 545531 - DNA, 519 bp, Homo sapiens
ggggggagggtggaagagaaagagtgaagaaaagttgcgaggcgtctcctctcttcctaaggcctcctgacccagacccacccctcagagaaggagaacgatacatatacggagaagaagaggaggaggagagcgagtgcacgggacacgagcgggagcgcacacgaccgtctcaagaaccgcagggggacgcctcagcaagtgccgcggcaggacgaagggaagagccccagaagaggggagacgcccgtggacaacctacaggacatccctactagcaccgcgacactagcgccagcgtccgagaggccccaaacagctaaccacgcaccacgtgtaaaagcacagactggagccgcagcgcacccaaaagcgcacacgaactgcaacggacccgcgcccggctgcgtccacaacccatctgcagcaacgcccgagccagcgtcactaccaagcccaccacaccccatcaacccacaacgctgcgcgcgccgacacgacggccgccacccgcgccac

SEQ ID NO: 545532 - DNA, 364 bp, Homo sapiens
gggcgaacttctggtgctattgtgacgggaatacttggataggactggagggcggacatggtttgccagccatggggcctgagacagcttctttctggagctgaggtcctttgtttctgtcattagaagtgacccccagattccaggcaggatcccctgggagagatgctgtccagatggtctgctgcttgtacagaatgggacaggaggttagactgttgcacaaaaccagctgtggaatactgagcttggacagaggtgtacacagctctctcacggcccgcgggcagggggacatcacctgtctgactgaggagaccggtctgtgcaggcagctcctgggaggtgcattggataactgtta

SEQ ID NO: 545533 - DNA, 739 bp, Homo sapiens
  misc_feature (739)..(739): n is a, c, g, or t
aggttgcagtgagccaagatcgtgccactgcactccagcctgggtgacaagagcaagactctgtctctaagaaaaaaaaaaagtctccgaaccctgcccaaagcatggaaacccctttgtggccatgcccccaaatatggtccaacatgtggttgggcagcccgttgtagcaaagccccttgcgccctgaaccggggcacagaatccgcgagcccctctcctttccgtcgtggtcagtgcccagcgcacccgtgatcgacctgtgtgagtccctggtggcgagataactgtgtgaccctggtgtggcgcatgcgcggatgaggacaagaagatgtgaccgctacgtgctggagtaccggcgggaccaagcttcgagggcccgccccgccgtcatgggggaccagcctgggatggtcactcgagggcatccggcagaccagaggtacaccctggacaggtctcaaggtttgacattgaaatacattgaacttccgtgtgaaggcgcctgtagtacaagcgggcacgttttgtggcaaccgcgaaagaaacggtttcccttccttgggaacgccccgcgcgttgtactctccgtggcgagggcacccagcccaacagacgcgctttccgatgggttttctccggccctgttgagaatttggcggggtcccacaattttcgcgcaacccgaggaaaacccttggcgggggggttggggcatggcatcttcttcccgggtgan

SEQ ID NO: 545534 - DNA, 805 bp, Homo sapiens
  misc_feature (81)..(81): n is a, c, g, or t
  misc_feature (138)..(138): n is a, c, g, or t
  misc_feature (173)..(173): n is a, c, g, or t
  misc_feature (196)..(196): n is a, c, g, or t
  misc_feature (202)..(202): n is a, c, g, or t
  misc_feature (206)..(206): n is a, c, g, or t
  misc_feature (210)..(210): n is a, c, g, or t
  misc_feature (213)..(213): n is a, c, g, or t
  misc_feature (217)..(217): n is a, c, g, or t
  misc_feature (226)..(226): n is a, c, g, or t
  misc_feature (231)..(231): n is a, c, g, or t
tcaggtacttgtttatatatatttaatcttattcaaatggaaaccatgctttgtcgtttatacttgctaggtagactttantacccccccactatgccctcatttttttaaaaaaggaaaaaaaaaagaaactgggtnccagtcttaattcattttccgtgccaggtttattncgtgtgtgtgtgagtgtgtctgnttggtnttgntttngtngtgntttcagtgnttggntttcttttctttccccctccggtcccatacttcacagcactctggtgcgggaagaagcagaagcaaaaaaaataaacttaccaataatctaccattacaaacacacataaccaaaggaacacgaaacaacaggaaggaaccaggactggccaccttttcccctcgaagggtggctttcccggagggtaatactacgggtcacgtagctgtgtccaacggaagaggtgaacttaccttccgggcaaaaatatcgtgaggtgactccccacaaaacgaaaaacaaacaaaaaaaaaacggtttcgggggccgccgggccgaaaaattttcaaccacacggtgggcgggggcccacgggtatctagaacggtccaaggggtttcccaaggcaactgcgcagcaaggggtgggtcccccaaaaaaacgcggggcccgcgttgaacacccggggctctggcctcggctacagacccaggcaaccgccgccgccgaggaccctcacacgcgactacaagcaccaagggcaccacaatactacgactgcgacagccctacacacgacgaacaaaatgacag

SEQ ID NO: 545535 - DNA, 415 bp, Homo sapiens
  misc_feature (9)..(9): n is a, c, g, or t
  misc_feature (18)..(18): n is a, c, g, or t
  misc_feature (35)..(35): n is a, c, g, or t
  misc_feature (132)..(132): n is a, c, g, or t
  misc_feature (268)..(268): n is a, c, g, or t
  misc_feature (327)..(327): n is a, c, g, or t
  misc_feature (342)..(342): n is a, c, g, or t
  misc_feature (376)..(376): n is a, c, g, or t
  misc_feature (408)..(408): n is a, c, g, or t
aaaaattcncaatttgtnggcgaaatgcaataaanctccacattggaacaacaaaaatccccctatcacccctttagaatggctacctataaattttttaaaaaatccaaaatctgttgatgatgcaataanaataaaaccatccccaggtaggtacagtggctcacatctttaaacccagtgctttgggaggctgagacaggtgaatcaccataggtcagaagttcgagatcagcccggccaacatggcaaaaccccatctctactnaaaacacaaaaattagccgggcatagtggtgggcgcctgcaatctcggctaccctgagnccgaggcaggagaantgtttgaacctgggacatgagaacaaatcactgnacttcaagtctgggtgacagagtgtgactccnctttcaa

SEQ ID NO: 545536 - DNA, 387 bp, Homo sapiens
attttcatgtgtagcttcagtctctcttctgacaataaaatgtatggatatatatctatatatctcatctgtggatatgcaaaagtagccaaagggagtccttcagagcttagcgttgcctgtgcatgaagctgaagtattttgtaactctcatagacgagacccagtgttgccacgtgatttacaagtttgtccgttgaaaagaagtgccgagctgacggattcatctttaccaggtcattaaatgccatggaaagtctgagctcagccagttgtgcattgtgcacgtcggcgcttacttatcgtgagcttgaggaagcagctgtatcctttgctcgattctatcactatcctagcctaccctaggtgcgccatctattaccgccc

SEQ ID NO: 545537 - DNA, 313 bp, Homo sapiens
  misc_feature (18)..(18): n is a, c, g, or t
  misc_feature (23)..(24): n is a, c, g, or t
  misc_feature (27)..(27): n is a, c, g, or t
  misc_feature (35)..(35): n is a, c, g, or t
  misc_feature (38)..(38): n is a, c, g, or t
  misc_feature (60)..(60): n is a, c, g, or t
  misc_feature (64)..(64): n is a, c, g, or t
  misc_feature (75)..(76): n is a, c, g, or t
  misc_feature (104)..(104): n is a, c, g, or t
  misc_feature (120)..(121): n is a, c, g, or t
  misc_feature (149)..(149): n is a, c, g, or t
  misc_feature (193)..(193): n is a, c, g, or t
cacgagggccaaactggnactgnnaanacttttanaanggaaagtgaaaggtcacctaangaanagtatacctgnnaagaggatcccttggatggtacaattcnacgataccttcatcanntttttgagaaacttactgataatggtantgaattttcagtcacagtgtctctgttggagatctataacgaanagctttttgatcttcctaacccatcatctgacgtttctgagagactacagatgtttgatgatccccgttacaatagaggagtgataattaaaggtttagaagaaattacagtacacaaca

SEQ ID NO: 545538 - DNA, 915 bp, Homo sapiens
ggttctggagactcaacgatgaagctaccggaccgagggttttcttataccctggggtcccggctgcccgtgttggcctcggctactcatcgtgacggttatcctgcagtatatgggacaaacagatattatatcagaaacactgaagtctttgcaatctaaattcttttcacctcttcaaagaagcgatgctaccaggctaatagttttcaaggaaacgtggcattcattactgggggaggtactggccttggtaaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatgattcaaaacactgtgtcagaactgatcaaagttgcaggacatcctaatatcgtgcataaacacatgcagcagggcaattttatttctcctactgaaagactttctcctaatgcttggaaaaccataactgacatagttctaaatggcacagccttcgtgacactagaacatgggaaaacactaattcaaagcacagaaaggaagcagcatatctttctattaactactatctatgctgagacttggttcaggttcgaggaagtaccaagtgcttctgccaaaaccaaggtgtggacgccatgaagccagtctcattgcagctgacatggcggtaaatcatggcaatgcgacacacctgctgactcaaacccagggcctatacaaaaccaaggtggcattaacgaccgcccgggacccactggaacacaagacaacgaaatgatcggcaacatcccacgtgacccaggagagcagacagaagaaccgcaaacaggcgaccccaggaa

SEQ ID NO: 545539 - DNA, 173 bp, Homo sapiens
ctaattggttcttcgatgacgccgctggtgaggtcagggatggaacctgcatcctcatgtatactagttgggctccttacccctgagccacatcgggaacttccagtagtgcatttctttttagagctggaccgtccattgtctggatggaccgtcatcgaagaaccaattag

SEQ ID NO: 545540 - DNA, 281 bp, Homo sapiens
acgggagacggtggcaccgtgtctgtgcctcagcccccttgctcagcctcacgcagccacgcagttcggcgtctgcaagcaggtgcaaccacacgctggtcatccagcaggctccgaagccatggagccctatacggcccccgcaggtaacgttgacgcagacacccatagtcgccctgcgacagcctcacaagcggatcatgctcaccacgcctcagcagatccagctgaacccactgcagccagtcccctgtgttgaaacccgccgtcgcaaaggacag

SEQ ID NO: 545541 - DNA, 215 bp, Homo sapiens
gaaacccactgcctatgtgcggcccatggacggacaggagttcattgaaccaaagctttcctcttagcactacagcagccaattccatggcaacagcatgacttagcttaagcccagcagcaaagcacatcttaccaagctgaaaataccttcccaaccacttgatgtaagtcacacatttagagcttttaacattgttactacgtgaagggatt

SEQ ID NO: 545542 - DNA, 476 bp, Homo sapiens
gtccggacgcttgaataatctttgcattgacagttgcttctagccaagcattgccgtgatcttcccagccagatttgaatgcattgtttggatgtgtgagaacaagcgttctccctagcatctgcttctgttcctgaggcggtgcatgtagccagcatggaagcagtcaatgtctcctgccccttgcacatggtatcgcaagctggagttgcctgtcgagatgcttgtattgcagtgataagggctgctggacactggagtccgtatttgtagggggcaacagtccggggagcagcagcagcaacagaaggcgcgtggtgccttaatgtctgtacagcgtgtgggaacgcttccagactgggaggtgtcagtcaagccttgctggggggaatgagggcgaccaaaggtccatagccaagcggtccgggcactcagacccagttggagccagatggcgaagagttggacaaggccca

SEQ ID NO: 545543 - DNA, 217 bp, Homo sapiens
ctggaggagctgaggagggagctgaggtgaccccagtgggagcctgcaaagctggggggtgggcctgcagaatctgctgctgggctgacgagtccgaatcactctcattgtcctggggggtggggatgctcggggacgtgctgcgattgtcctggtcgatatctttggagtcactgttaccctcatcgccgaagctgtgactttcttaactctctcc

SEQ ID NO: 545544 - DNA, 482 bp, Homo sapiens
ttgtggacgatctctagcaggatcccccccctggcagagctgttaaaataatttgtatgtgacctagataaagcagattgtatcagcttggatatcaaacatcaacttgtgtcattaggaaatgtacgtccttctattgaatattagctacgctgtcattaagccataacaaacagtaaagctaatattctcttctcaagaaacagaatttgtctttgtcttttaatagcctatgtgaaagatgttataggatacacattttccccctaccagatccatgatggctacctttgaaagaggactgatataattgtatatgatacttggctttgaactatttcacaggttaaccaatggaaaactgccagttacacttaaagcaaagaaaacatgtcagaattctcccacagaaatttaccgttcctacgtcaagcagttccctaaataactactgatttatccgacaacctataacagttggg

SEQ ID NO: 545545 - DNA, 196 bp, Homo sapiens
tgatactcgtccattaggtagtatgatgtaatctggtccttaagtattctctgtctttggtatttcctttctggtctttcctccaactttggtcattgggtgtgtggggactttttttttttttttttttttttttttttttttttttttttttttttttttttggatggggtgtagtttgtttgtgtgttgtata

SEQ ID NO: 545546 - DNA, 659 bp, Homo sapiens
agcggagagctttacgaggtatcagcacttttctttcattagggggaaggcgtgaggaaagtaccaaacagcagcggagtattaaacttataaatagacaggtctgagtgcctgaacttgccttttcattttacttcatcctccaaggagttcaatcacttggcgtgacttcactactttgaagcaaacagagtggtgcccaggcaacatgggctgactggagcgccttaggcaaactccttgacaaggttcaagcctactcaaactgctggagggaaggtgtggctgtacagtacttatacatattatccgaatcctgactgctggggacacgcggttgagtcagacctggggagatgagcagatctggcctttcgttgtaacactcagcaacctggtagtgaaaatgtctgctatgacaaagtctttcccaactctctcatgtgcgctatctgggtacctgccagatcatattagtgtctgtaagccaacacatcttggtacctgggctcatgatgtactatgtgatgcgaaaggaagaagaaactgaagaagaaagaggaagaactcaaggttggccaacattgatggtgtcaatgtggaaaatgcacttgaaagcagattgagataaagaagttcaagataggatagaagagcat

SEQ ID NO: 545547 - DNA, 311 bp, Homo sapiens
  misc_feature (107)..(107): n is a, c, g, or t
ccccattatgcgtgatggtgtgtgtctggtgtacagcacgtgtctactatgtgtcttctgggaatgtgtaccatctgtgtgcctgcagctgtgtagtgctggacagntggaacaacaaccctttcgtctccagttctccactccaatgataatagttcacttacacctaaaccaaaggaaaaacagctctaggtccaattgttctgctctaactgatacctcaaccgttggggccagcatctccccactgcctccaaattattagtaactatggactggacgtccccgcgaagtttcttgggtctaccaca

SEQ ID NO: 545548 - DNA, 270 bp, Homo sapiens
  misc_feature (55)..(55): n is a, c, g, or t
  misc_feature (172)..(172): n is a, c, g, or t
  misc_feature (193)..(193): n is a, c, g, or t
  misc_feature (205)..(205): n is a, c, g, or t
  misc_feature (235)..(235): n is a, c, g, or t
  misc_feature (242)..(242): n is a, c, g, or t
attaggtaccagctcggccacagtggggaaggggtctttggaaaggggagggaanagtgggaagggctgcatctcatggcttgagtgccagctcagccacagtacactagaacaccaagtagacttctaaggtttttgactgcagtccctggctcccagacagcacctctanacctgcccacggcctgggggnacttgctacagnggttacactgagccgagatcatgccactgnactccancctgggcgatacagcgagactgcatctc

SEQ ID NO: 545549 - DNA, 103 bp, Homo sapiens
aggctgggaggaagagatagtcgctctggatcacccatggctagacgctgaaaacccacctggctccggaatcctgtcgggctagtcgggggggtacggagct

SEQ ID NO: 545550 - DNA, 974 bp, Homo sapiens
ggccggtggggccggcgggactcgccgctcgcacgccttggcccgcggcgggcgcacgtcttccttccgcttgcgctgtgactgaggcggtgtatgtgcggcaataacattgtcaaccccgtgttggccctgccatctgtggcccggtcggccgggaaggggccaccggtgggcggcgattctcccgtggcttgggatcgggcgcaggactctcgtggggcacgggcgttggcgagcagacacgcctttttgcgcggcggttcatccagacagcgtcccactttcttcccaattattttttctgggcccggcttttggcgccctggggtcaacggcgcctctggtagtaagacttttaacactcattacttcggacccgccggtgggacttaatgacgccttatcgaacggggttgcgcacgaatcattcaagtctcgcgggcgttttccacacgactaaggaaatccccaacagcgcgcgcgacgagcattggaacatcactgcgcgcgaaacttacaaaccaccaccaggggcgcatgccacaaacacgatgtcttatttaacagcacacggctctttgcgagcttctgcgcacacaaaccgacatcgtctgacaccgatatggcaattttccccttttgcgtaagccgacgacaatcttacatttctgcgcggacaagcgggaattcaccctacaacggggcacgcagaacgcctctaagctgtttacatatatttacccgggccctttataaccaactagtagggacaaggaacaccttcgacgaagggttgctacccgctgggacgacctcccaagctgagggctggggacacgtccacccacgcttagtccggcgggaccatacccatctttttgcacaacacgaggtcggctctcataaatctcggcgtggaggccgccacaactcaacgcaagcaaattaacttaccgaataattttatctcccag

SEQ ID NO: 545551 - DNA, 133 bp, Homo sapiens
ggacaaccggctggggtccttgcgcgccgggctcagggaggagcaccgacttgcgccgaaccctgagagatggttggtgccatttggaaggtgattttttcgctgggccccttaatgcctgcccccttaatgg

SEQ ID NO: 545552 - DNA, 180 bp, Homo sapiens
cgcctctcgacggactcccccacgactcacttacttttccacgacacaacacgtgacccactgacacgttggctggggcgggtgtggacgtgttactgtcactgggaccggacccttgggactgacgggcgttgactcccgcggacccccacggttacccgacgtctcgacacttcgtac

SEQ ID NO: 545553 - DNA, 967 bp, Homo sapiens
  misc_feature (902)..(902): n is a, c, g, or t
cggggagaactacgcggacacgtcagggagatgcgcagccggtgttgagcgagcccgtgctgttccgaagccgtccaacaggcctacgcgcccgaggctcgcccatcctcatgcccgcgaacactcgcaaccctgcaccaccgagctggagctgggcgtggtgatgggcaagcgctgccgcgcagtccccgaggctgcggccatggactacgtgggcggctatgccactgtgcctggatatgaccgcccgggacgtgcaggacgagtgcaagaagaaggggctgcctggactctggcgaagagcttcacggcgtcctgcccggtcagcgcgttcgtgcccaaggagaagatccctgaccctcacaagctgaagctctggctcaaggtcaacggcgaactgagacaggagggtgagacatccatccatgatgttgatcacatcccctacatcatcagctatgtttctaagactcataaccttggaagaaggagatattatcatggactgggacgcctaaagggagttggaccggttaaagaaaacgatgagatcgaggctggcaatacacgggctggtcagtatgacatgctaaagtggaaaagccagaatacttgagttactttgttaacaactttcgagacaagaacgggacgcaagacaagaagcaagctacggcataattaaagtgtcacaatcctttaagtatagaaaccatttacttggcctggacgcggtggcttcacgccgtgtaatcggcaagcaatttgggagaccgaggcgggcggctcacgacgtacaggagatccagaaccatgcttggcgaacaggatgaaaccccgtctctactaaaaatacagcacatacgccgggcgtggcgccgggcgcaggtagtcccagatancatgcatggaggactgaggacaggagaatcaatggaacaacagcgacggcggagcttaccgtgag

SEQ ID NO: 545554 - DNA, 212 bp, Homo sapiens
cccggattaaatttatctgtttaaaaaaaggacaaaagttatcccccaaacccccctttccctttttgccctgtttgttttggattgggtttgggggaaaaaaatgttttttttagttgtttactttgtttgaacccttttgttgtggttcaagtgctgttttgtgtgttgggcccaaccagttgtcaataaactttccaagcgggctttta

SEQ ID NO: 545555 - DNA, 1459 bp, Homo sapiens
  misc_feature (185)..(185): n is a, c, g, or t
  misc_feature (326)..(326): n is a, c, g, or t
gataatggcgtccatgcgcacttctatgatgcgaggcgacctgtaccatcgactggcggacgtgggtcccgagtggaattatcaacagacctcctgaggggaggctcatgttctaggtggacgcgcgtctcgtccatacataaacacacgcacatgcctgaagcgacgcacgtagatgttgagancacacactggtagttgccaagtagagagagaaagtcgtgaaggtcgcggccgcagtacgcccgaggccaatatggcatcgaaaagcctatcgattccttcatgaaaatcaccttaggtggatgctgagaatgtagtcaganagagctaacattttcttggtcctacctagccattcttacttaataggcaaccacaatgcctcattcgtgcagatctgagtaaactaaagccggttcattgtgacttgatgtcgtcacccgaaaagatggtaagaaaccaaaaggggtgcccctcgaaaggtccacccattattggaatccgcaaaaagcatctttttacgtatgcgttcgctacggctttgtaattgccggaaccgttgaacgtgagccagccaggacgatgagaattgctgtcacatctggattcaagctagatgtggatggagatgcatggccattgccgagacccatggaacggtacttgatgggtcaactctagggtaagcccaatttattcccgttgcgcaggcccacacgttgactatcaaaagaggtgttacagatggggactactgggccagcgtaacccttgggccagaaggaaccccgacaaggtttaccgccctgaaccactctattgtttgcgcccgcgctctactaacttctggagacccaggattacgcaggagggcctgcattcgactagacgcttgtgtcagacaaaaagaggacgggtcccggcgtgccacccatgaaaggaatcatgaacgttactgaaccggaacatttttcaaggcacacgtggttctggaagcacaggttccggtgttacagggcaaaagaagaagctaattttgaaggccttggggaataaatctggccctaacactatctattatattaactttcactatccatgctggggggcagattcttctagacccactcggatggatcccgaggccaaacatttccacttttcccaacttttaaccaattgaaccttggggtccagaggagccgggcattggagaacgttaaccctgtgttaatgacacggttgtgaagggcgcaatttccccaattgacacacctggggttccctggcagaaacaccagcggcaaaggggggctttcatatggcaaccaggggctccacactataaaccccgggtttccttgaaggggccggcagtacgaagattgggcttcctgggacgggattcccctttggaacctggactggaccggactacgggttcctggttcctcat

SEQ ID NO: 545556 - DNA, 323 bp, Homo sapiens
gtcaggcactgaaagtctgaatgtctgggttgtacactgaagataccattgttgttacagaaaaagcaatgaaaaccatcaggcttgaaacaaattcctgctggagaagactgtccagatgtgcatgacttcaaaggatttttattaaaaattattttattattttttaattatactttaagttctagggtacatgtgcacagcatgcaggtttgttacatatgtatacatgtgccatgttggtttgctgcacccatcaacttgtcatttacattaggtatttctcctaatgctatccctctcccagccccccaccccacgac

SEQ ID NO: 545557 - DNA, 118 bp, Homo sapiens
atcttttgcattgttcctcatccgcctccttgctcgccgcagccgcctccgccgcgcgcctcctccgccgccgcggacctccggcagctttatcgccagagtcccttgaactctcgct

SEQ ID NO: 545558 - DNA, 85 bp, Homo sapiens
tgtgccacctgggacaggccggttattataagaaactctttggcagtggaacaacacttgttgtcacagataaacaacttgatgc

SEQ ID NO: 545559 - DNA, 541 bp, Homo sapiens
agacatgcagataaccaggatgacagagaaccaaggttaatatgttatgtgtgaatttgatcctgtcattatgatgcttgctggttattttggcggtgaattgatgcgagtttcttcctagcatcgatggtctttccatctggcatgtttttggagtggcttgtactggttgttcctttccatgtttagtgcttccttcaggagctcttgttagggagggctggtggtgataaaatctctcagcatttgcttgtcagtaaaggattttatttctccttcacttatgaagcttagtttggctggatatgtaattctgggttgaagaattcttttctttacgaatggggaatatatgggccccactctcttctggcttgtatggtttctgccgtgaggtctgctgttagtctgatgggcttcccttctgtgggtaatccgacctttctctctggctgcggtgaatatattttccttcatttcaaccttggtgaatttgacaattatgtgtcttgaggttgctcttttcgaggagtatctctgt

SEQ ID NO: 545560 - DNA, 645 bp, Homo sapiens
cgatcatccctagtcctcatctcccctccccatcccttacgccatccctttaccataacaccagacgaggtccaacagatcccctcccctttacccatccaaatccaattggcgccacccacatggtgacatggaacacttacgagtcaccaccggacttacgcgcgggacattaatctttcgcaacatccgtacacataacattctcccgccagtttattctccttgagacacccgggcgcgacactgtcgcgacatcccgtgtgacgcgttgtcacacacatctggagatgtaggttacatcccccggattgtaagcccccccattctgttataaataaattcaccatctcaccagaacactctattgccacatccataggagctgtctccccaccattagagcctttaaacaccagaatagccaattctcccggacagtcttaaacccaaacccacatttcacccgcgtaccacagacccgggggtataacataccggtccaatagcgtctgaaatctgtggagaccaaacccaccagtttctatgccccatccgtcctagaaattaattctccccttaaaatcttttgaaatagggcccgtatttaccctatagcaccccctttaccccctttagagccca

SEQ ID NO: 545561 - DNA, 220 bp, Homo sapiens
gcccggtgtgtgaacgcattcctacttctccgtgtgtgtagagtaccgaattcttactcactcctgtgtgtgagtaccggcatacttccgttgtgcgtaagtactgcattctaacttcccttgtgtgtgattaccgcattcttacctctcccgtgtgtgaatagcgaatacctagttgtcccgtgtgtgagtactgcattcttacttcccttgtgtgtga

SEQ ID NO: 545562 - DNA, 667 bp, Homo sapiens
  misc_feature (43)..(43): n is a, c, g, or t
tcgggggggcgcccccccccaggcagagtgtttctagaacccnctccgcgggtgccactcaccccccagtggtggacgccccttggactctcgaacagcaacatgtgtggcgcccaattcctcccggttcacgtagtggacttctctcccctgttactcccccggcgagatattattactccgtgcgcaaccacccttcggaagaatgtccagccatctatcttgttcttggcctcaccaaagattctcacaacaagagttttgacctgtctcacttctgtagcggttgtgagaagccctttggtggtgtggcagctccaacaacaaaggataagaagaacaccgttgtactccccccctcccccgcaaggatgatccccccaaggtcaaaacaaggttacatcgcggtcttttcctgaaaaatttatcaaacggggagtcaaggacagcgcccacatttctggtggcgcccttccgtgacaaggagccctcttttgcaatgagaaatttgagcagtcgtgggagttttattgtcgacacagttccttgctgcgagacaattattgttcggccaaaagtaatgtgttagactatcgttttttttacacaccccgagaaaccacagcacccgcagagggttaataaaaaccccacagcccacaaaaca

SEQ ID NO: 545563 - DNA, 170 bp, Homo sapiens
tcataggttcgcaggaggctacactgaacaacattttttttttttgggcgggggacagagtcgggctggtaaccaggcggtagtacaggtggcgcgatctcagctcacggcaacctctgactccggggtttaaacaatgagcaaaaatattcgggccggcgaacctatga

SEQ ID NO: 545564 - DNA, 419 bp, Homo sapiens
  misc_feature (20)..(20): n is a, c, g, or t
  misc_feature (46)..(46): n is a, c, g, or t
  misc_feature (73)..(73): n is a, c, g, or t
  misc_feature (81)..(81): n is a, c, g, or t
  misc_feature (109)..(109): n is a, c, g, or t
  misc_feature (139)..(139): n is a, c, g, or t
  misc_feature (162)..(162): n is a, c, g, or t
  misc_feature (182)..(182): n is a, c, g, or t
  misc_feature (186)..(186): n is a, c, g, or t
  misc_feature (197)..(198): n is a, c, g, or t
  misc_feature (201)..(201): n is a, c, g, or t
  misc_feature (220)..(220): n is a, c, g, or t
  misc_feature (247)..(247): n is a, c, g, or t
  misc_feature (257)..(257): n is a, c, g, or t
  misc_feature (277)..(279): n is a, c, g, or t
  misc_feature (281)..(281): n is a, c, g, or t
  misc_feature (295)..(297): n is a, c, g, or t
  misc_feature (300)..(301): n is a, c, g, or t
  misc_feature (304)..(305): n is a, c, g, or t
  misc_feature (310)..(310): n is a, c, g, or t
  misc_feature (313)..(313): n is a, c, g, or t
  misc_feature (315)..(315): n is a, c, g, or t
gagactccgtctcaaaaaanaaaaaaaaaaccccacaaccatgttntaggaaaagttagtataaatgacatancataattnatatattcaaaataacttttaaaaagtngtcttgtagcttgaagggatcctaaatatnaaaagcccatcacaaacttacangccttactgctacgtaaatntccntttgaactagnntcnggttctatttaaaaagtcnaaaacagttgaaattaatttacgaatnagaacagatncacactttgtggggaggctnnngnggtaggatctcctnnnccnnagnnttttnagncnagcctgggcaattttccaaaaaaaccccttaaggaaataaaaaaagaaatggcctgtgcaaattcctttattaaacaaaggaaaacaaattacgccccgggctt

SEQ ID NO: 545565 - DNA, 381 bp, Homo sapiens
  misc_feature (20)..(20): n is a, c, g, or t
  misc_feature (46)..(46): n is a, c, g, or t
  misc_feature (73)..(73): n is a, c, g, or t
  misc_feature (81)..(81): n is a, c, g, or t
  misc_feature (109)..(109): n is a, c, g, or t
  misc_feature (139)..(139): n is a, c, g, or t
  misc_feature (162)..(162): n is a, c, g, or t
  misc_feature (182)..(182): n is a, c, g, or t
  misc_feature (186)..(186): n is a, c, g, or t
  misc_feature (197)..(198): n is a, c, g, or t
  misc_feature (201)..(201): n is a, c, g, or t
  misc_feature (220)..(220): n is a, c, g, or t
  misc_feature (247)..(247): n is a, c, g, or t
  misc_feature (257)..(257): n is a, c, g, or t
  misc_feature (277)..(279): n is a, c, g, or t
  misc_feature (281)..(281): n is a, c, g, or t
  misc_feature (295)..(297): n is a, c, g, or t
  misc_feature (300)..(301): n is a, c, g, or t
  misc_feature (304)..(305): n is a, c, g, or t
  misc_feature (310)..(310): n is a, c, g, or t
  misc_feature (313)..(313): n is a, c, g, or t
  misc_feature (315)..(315): n is a, c, g, or t
gagactccgtctcaaaaaanaaaaaaaaaaccccacaaccatgttntaggaaaagttagtataaatgacatancataattnatatattcaaaataacttttaaaaagtngtcttgtagcttgaagggatcctaaatatnaaaagcccatcacaaacttacangccttactgctacgtaaatntccntttgaactagnntcnggttctatttaaaaagtcnaaaacagttgaaattaatttacgaatnagaacagatncacactttgtggggaggctnnngnggtaggatctcctnnnccnnagnnttttnagncnagcctgggcatcttatcagtaagaccttttttcaaaaaaaaaaaagcgtatatttttgttttgtgt

SEQ ID NO: 545566 - DNA, 1058 bp, Homo sapiens
  misc_feature (365)..(365): n is a, c, g, or t
  misc_feature (526)..(526): n is a, c, g, or t
  misc_feature (531)..(531): n is a, c, g, or t
ggttcccctggcacaaaaatggcccggcgaaagccacaggaaaaccggcccctgtgtacaagaacacagaattaggccggaggcccccggcgtgaagaaccggggtctcggagacacgacatcttgagcacggtgattgacatctaggttacccaggagaccttggacagcaaccagaggatatcccaaccccagagcgcaaaccacaaccaaaccaaggccccagacgtgtggcgggcgcagccagacgtggacaatccggatgcacagcaacaccagagtccaggttaaagacgcaaaaccagcagatctggcaggtggacacacagcaagaggcaccgggacagagcgttatgctctccaanacgttgggggtccctttcgtggcaagtggttatcacgggagaggttaacctatagaaggtctacctaatctccggagaacatcctatacgacactattctcctccttttggtctacttcaccccaacaaccaagacatggtcttataccaagaaggccccntgtgntatcacggaatatccttaacactatgggttttcttgggggggagaagcgcaaagtcatctgcacagccatattaatctccccagacccaagactcccatacgttagacccgacgtgggcctggaggcaacatttcccaaagggtatccacaggggtgtgaagacctggtcgttccaaaaccaatttccaagcaaaaaaccaccaaccagtacgttcccaaacgtgggttcccaggcaagcagcagatggacagcaaggaaagaaaggtcggatgtacaacaccggtggtatgacaagttacaggtacactatgaacttgggttccatggtctaccagtccacattgtggtctcaggcgggcgttccgaagcccctttatgaaccaccagttaatgagttttggtacatgcggattatttggatttaccattgttacccttttggaagcaactttctttggtggtctcaagggattactgcagcttggttggaacttgtactggggctacctaactggtttggtcctt

SEQ ID NO: 545567 - DNA, 226 bp, Homo sapiens
actctagctctggtacccatcgatgagggcctagcgtatgggcgtactctaattaccaggaagggtcgtactctatggtgtgttcgagatatgtccgagccacgtagctggattgtcatgggtgttatgtggcgtgtgtacaattcatgtgagatattagctttattggggagggggtgatctaaaacaccctttacgccggcttctattgacttggcttatcgag

SEQ ID NO: 545568 - DNA, 379 bp, Homo sapiens
  misc_feature (11)..(11): n is a, c, g, or t
  misc_feature (54)..(54): n is a, c, g, or t
  misc_feature (69)..(69): n is a, c, g, or t
  misc_feature (139)..(139): n is a, c, g, or t
  misc_feature (235)..(235): n is a, c, g, or t
cgcgcccaggncgggcggaaagtttttcctgacggagttttggctgcggcacgnaagcaggcggccgangcgggccatggacgcgctcaagtcggcggggcgggcgctgatccggagccccagcttggccaagcagagntgggggggcggtggcggcacccaagcatgcctgagaactggacagacacgcgggagacgctgcttggaggggatgctgttcagcctcaagtacctnggcatgacgctagtggagcagcccaagggtgaaggagcttgtcggccgccgccatcaagaggatcgtggctacagcttaaggccagttgggaagaagcttgcagaaagttgactcttgaaaggttgtcgccacgggggaaattt

SEQ ID NO: 545569 - DNA, 830 bp, Homo sapiens
ccatgtatacagtccaggatcccatgacagattctgatgtcaccgtctaccttacagagtcatgagccggtgcttgaacttgtccagcaccatctgtacctggtcccagcatgccttctgagaccccccagtgcagaatgtgtgtgtgcccacatgtgctgcccccacctgctcatgtggccaacactctgtgcgaatgtgtgtgatgccatggatgaatgtggtgtccccatgatgtgataatgtgaatgccaattgatgcccctgctgtgaattcctgtgccctgaatgctcactgatgcatgtgttgcagccttggcacatgcttggtgcctgtgcacttgccttccgagatcccacagcatcacacgacactgacccctgtgccaaaactctccagaaaaatctattgcccagggactattcttgaatgacagacatctggtgtgacaccgcctatgtgtcatggaatacaacaatgatttggtgaaatgacatgttacgtgcctgaatgctgttggacgcctctttgtggctccacgtctgttgctgttcctttccactagctgtgtgctgttggattgcctgtcgatcgtgtggctcctgctactcatggccttgctggtgactgcgttttgctgctgcattgctttgacgccgcgactgggtgaccgccttgacatcctccttgggggccccatctgattttctccgcttgcctcgcccttcccggtgacgtcagcctggggattcgttgcttgtgcccttggcttgttggctttcttgtttggcctacttctcttgtcttccttcgctgcttgccctgtgat

SEQ ID NO: 545570 - DNA, 509 bp, Homo sapiens
  misc_feature (489)..(489): n is a, c, g, or t
ctgtcttaggtcacaaaaaggtcctcagcctgtagtgggtcacattgttagaaatgctgttacttggtgctgtaaaggaaatagcacttgaacataaatttaattttctcagcaaggtcatttttactttctgcagaaagggtacactcaccagcagtttagccaggagagtacaccgaacaaaggagacagggtcatttataacctgacgcgttcaccttactgctgtatctggtttccactggccagaacaggacctcgctttctgtatttgtcctgattggctagcaacttagaactttttaaaagagcaaaggtagaggagaacaaagggaggaggaagtaactggtggaatgctgagaaaggtgaaaacacctccaaataaggaagaggaataggctatgacctaacgcccgctgggactagtataagcatgccagggcaaatatttaggcgaaatcgcgggacctaagaacataaagtacgtngatttttcttttcttttttt

SEQ ID NO: 545571 - DNA, 142 bp, Homo sapiens
gctgtgtgtgtgctggggcgagtgaacacctgtgtgttctctgatagaagattgcgccgcgttgagatactccgtgtagatctctatgtgtataggtatctgtatatctttcctttcgtttaccacgtggttaaaaaaacct

SEQ ID NO: 545572 - DNA, 231 bp, Homo sapiens
gcacgagcagggttccagtcaggccgatccggttcgttcacggatggaaaacatacataacttgctggcttgtctggagtcacatgtacttaggtgacaatttacaaaaagtcatgtctgcatcttgatgggcaacaacccttttcaaccaaaaagtaattcaaaaatggcagaactgtttatggaatgcgaagatgaggagctgtaaccatggctgatgaaagtaaaaga

SEQ ID NO: 545573 - DNA, 407 bp, Homo sapiens
gcacctactaagagcatcggtcctgtccgagtttccccgcccctccccacgctttagctgcaggccctttttgtcatatgtctctatcctataccagatgatcttagtccttggccctgctggtgctataggtctgttgtatatcttgagtaatgtttcaggcctggggtgggaggggagctcccgttgcctctgcaataatgtgtccagggggagctgctgtcactcccccatccccgaggcagcccagtccctatgtcccaagtcagggaccctgggcctgggccatctattcctttttgttccacatttcctttctactctttctgctcatgagtcctgtccctgcatttgtcttgggaaacacggtattaatgagagtactattttggttttaaaaaaaaaaa

SEQ ID NO: 545574 - DNA, 467 bp, Homo sapiens
  misc_feature (124)..(124): n is a, c, g, or t
  misc_feature (128)..(128): n is a, c, g, or t
  misc_feature (139)..(139): n is a, c, g, or t
  misc_feature (147)..(147): n is a, c, g, or t
  misc_feature (155)..(155): n is a, c, g, or t
  misc_feature (167)..(167): n is a, c, g, or t
  misc_feature (169)..(169): n is a, c, g, or t
  misc_feature (171)..(171): n is a, c, g, or t
  misc_feature (173)..(174): n is a, c, g, or t
  misc_feature (176)..(176): n is a, c, g, or t
  misc_feature (179)..(179): n is a, c, g, or t
gccagttgtcgacggatgacttctcgcgtggcgtagcccatgtcgagagtcccgacaattagcatcagcgctaaaagggtaggggctccgaacgggcagtgtggcttagagctaaaagctcttnttanctgctgtgacnggtcattnctgtaatnggttgtgattgnanananncnggnggagaattaaatgagggaagctgtgtatacttcctagtaagagctattatatgaccgattacattaacatcatatggaaaaaaattgtcaaaagtactccgggaaagcccttaaatagttggtaaagtacagaacacatgattgtcaatatatgtaaatacaggatgagctaggacagaggggcccttcgttcacaccactgacaattagttcccacttttacctccggtctcagagatttgacttacgtgcgagagctttaatgcagagtagacctatctcacgtaa

SEQ ID NO: 545575 - DNA, 307 bp, Homo sapiens
tacatccaaccgaaaaatctcagccgaggagacctctagttagaacaggggagaactattcagaggaggagacgtggacgagggatgagcaccaataacaataaagatcctgacctgaaggcgaaggttctaaacacggagtagtgagtcaccggtgtggggtctccttcacaaggcgggcttcgaactcagaagagattccttccctgcgtatgccaggagacactaagaatcagaccacagacagtggatttggcaaagtgaccttacaggacgcttgccttgtgcctctaacatctcccgaaga

SEQ ID NO: 545576 - DNA, 325 bp, Homo sapiens
ctccagagggctgttgaaatagaggtacaggtatgacgtggggatctattcttggcagttcactcaacaaaatgtgtgaatcgattagaaacaatggatattacgagatgggcgaggaaagataaaggagggatcaagtttgtatgcggcattttggtgtgagcaacaacgtgaaaggtggtgtcctttattgagcacaggagtaggcatcattaacaaggtttgagtaaacacaaaatgatcattatatgtttgtgtgggcactttctatcagatcactcatacctataagtcaggcaactctgggtcagcatgttgccgggac

SEQ ID NO: 545577 - DNA, 184 bp, Homo sapiens
  misc_feature (9)..(10): n is a, c, g, or t
  misc_feature (15)..(15): n is a, c, g, or t
  misc_feature (19)..(19): n is a, c, g, or t
  misc_feature (23)..(23): n is a, c, g, or t
  misc_feature (32)..(32): n is a, c, g, or t
  misc_feature (39)..(39): n is a, c, g, or t
  misc_feature (45)..(45): n is a, c, g, or t
  misc_feature (48)..(48): n is a, c, g, or t
  misc_feature (54)..(54): n is a, c, g, or t
  misc_feature (57)..(57): n is a, c, g, or t
  misc_feature (66)..(66): n is a, c, g, or t
  misc_feature (72)..(72): n is a, c, g, or t
  misc_feature (82)..(82): n is a, c, g, or t
  misc_feature (87)..(87): n is a, c, g, or t
  misc_feature (125)..(125): n is a, c, g, or t
  misc_feature (128)..(128): n is a, c, g, or t
  misc_feature (131)..(132): n is a, c, g, or t
  misc_feature (135)..(135): n is a, c, g, or t
  misc_feature (138)..(139): n is a, c, g, or t
  misc_feature (152)..(152): n is a, c, g, or t
ctatgaggnncctgnggcnggtngggatgtcngggtggngctgtngcntccgcngcngctgctgcnggtgcnggttgtgagngggtntccagtgggctcctctgggcgtctcatggcctctaggngcnccnnggngcnngaggggctgggcntgggggtctgcttcctgggtgtctttgtctgc

SEQ ID NO: 545578 - DNA, 496 bp, Homo sapiens
acaaatacttggaattccaatgtgtttttgcttccgtgaggattaattggaaaggtttttaatgacattccactgatttcagatttgctgagatgacttcaataaatgtcctgtatgtttcaaaaaaaaaaaaaaaaaaaaaaaaaaaaaatgtgtgtggggcgcgcgcgccgcgggcccccggaaaaggtttttaaaaccttcggtgtggggggcgcggggcgccccgggtgacgtggagacactggtggcccataaccgcttggtccctaagggagaatccgggcgcacagggaacttagcgcggcgttgggggtttccctcaccaatataataaaagcgcgcgcggggggagcaccccgagagcgtcgttcgctggagaaaacctccacgaggagggagggctccgggagggcgcacatacggggaggtgtctatctacaacaagggggggtcccagacggagcgccgaattatcaaaaattaaaccgcccgg

SEQ ID NO: 545579 - DNA, 962 bp, Homo sapiens
  misc_feature (613)..(613): n is a, c, g, or t
  misc_feature (656)..(656): n is a, c, g, or t
  misc_feature (695)..(695): n is a, c, g, or t
  misc_feature (802)..(803): n is a, c, g, or t
  misc_feature (819)..(819): n is a, c, g, or t
  misc_feature (840)..(840): n is a, c, g, or t
  misc_feature (879)..(879): n is a, c, g, or t
  misc_feature (906)..(906): n is a, c, g, or t
  misc_feature (910)..(910): n is a, c, g, or t
  misc_feature (912)..(913): n is a, c, g, or t
  misc_feature (927)..(927): n is a, c, g, or t
agaggttaaaagatgtcaagaagctcagaatggcccagaatctgatgtgtggactcatcagtcaaaaatcaggtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaacgttgaactgcagaatggtaatactcagctggccttacagatcatcaaaaggaatcagctgctcccctgcangtgaaaacacactctgaagtgagaaagaagccagtgttctacngcctcgtccacccgatccagcccatccaaatgccggctnttcaccactgtgcagagaaagtgatacttcacttttggaaaactgttacctgagacccaggggagaatttactggccattttagttgtatcacagcagaatgaatannagatggtgaaggctgntaattttgagtcaattctacncctgacttttggccaaaagcttacttaaaattaaggatntactaagtcatcatcagctgtttttcntaantnnagccagctattaantttgagccattatgtaatatatgccataggcaatt

SEQ ID NO: 545580 - DNA, 1043 bp, Homo sapiens
gctccttctgcttctgctttctttgacctgttgcccctcgctcactgttcggccgttgttggctggccctgtgggctttgctttggctctctgtggcaacttgttccttttctgtcttttggtgcggattcccgtgatctgtctatcctatggtcacgtcacctactgtgttcgatatagcccccgtccgggcctcttcgctgatcccctgctcttctgtgtcgttccgagtcacgcgctcatcttcttcctatgtctccctgtcgtatgctggtggtcagcttcaatacttcgttacccgtcctggcttcccctcgaacagcctaccttcttcggagcacccggtccagagtatgtagtgcgtaccccctatcctgtataccctcactacctgttcattgatttggtcgggtctcacctcaagttttcactatttgcgtatccttatccaaggactctcggggaatcaagtacctcccacattgttactcactttgcttctcgtttttattccagagaccactttgagaatacatatggtatggtctgaggcctatgagcatcaatggcttcctagggtttccatcgtgtgagcacaccatatatttacagtagggtgatagacgtagacacacgagcatatgtcacgcgtgccgctaccatatatctttcgctatccccaccggcgtcataagtatttagctgactcgccacactctacggaagccaatatgaaatgatctgctgtcagtgctgtgagccctaggagtcatcatttcttttcgagccgtaggtggcccatgacgtggcacttgtattagcataactcatcactagacatcggactacacgacacgtactacgttgtagctctacttccactacgtcctatcaagaggagctgtattcgccatcataggaggcttcatccacatgatttcccctattctcaggctacaccctagaccaaacctacgccaaaatccagttcactatcatattgcatcggcgtaaatcttatattatccttgccgcacaacaca

SEQ ID NO: 545581 - DNA, 959 bp, Homo sapiens
  misc_feature (18)..(18): n is a, c, g, or t
  misc_feature (298)..(299): n is a, c, g, or t
  misc_feature (343)..(343): n is a, c, g, or t
  misc_feature (347)..(347): n is a, c, g, or t
  misc_feature (610)..(610): n is a, c, g, or t
  misc_feature (653)..(653): n is a, c, g, or t
  misc_feature (692)..(692): n is a, c, g, or t
  misc_feature (799)..(800): n is a, c, g, or t
  misc_feature (816)..(816): n is a, c, g, or t
  misc_feature (837)..(837): n is a, c, g, or t
  misc_feature (876)..(876): n is a, c, g, or t
  misc_feature (903)..(903): n is a, c, g, or t
  misc_feature (907)..(907): n is a, c, g, or t
  misc_feature (909)..(910): n is a, c, g, or t
  misc_feature (924)..(924): n is a, c, g, or t
ccatctcaaaaatttttnggggaaaagaaaagaaaatatgccctctaccttctgagcccgaggagaaaagaaagaaaatatgctctgttgttctccccctcagatttattttcgtgtttttgtaggatcagacaaaggtgaaaatgaagcaatggaatcctgtaagtaagaagttttgtgatacttaagtagcctgcctgcatccctaaaatttagattctaaatcttctgtgttcgtttttgtgcctgaggaatactgctgtgccaagtggctcctcaaggcgatagttgggttgcnnccttgctgttggcacggcctcttcaccagtgtctacactctttntccncagctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaacgttgaactgcagaatggtaatactcagctggccttacagatcatcaaaaggaatcagctgctcccctgcangtgaaaacacactctgaagtgagaaagaagccagtgttctacngcctcgtccacccgatccagcccatccaaatgccggctnttcaccactgtgcagagaaagtgatacttcacttttggaaaactgttacctgagacccaggggagaatttactggccattttagttgtatcacagcagaatgaatannagatggtgaaggctgntaattttgagtcaattctacncctgacttttggccaaaagcttacttaaaattaaggatntactaagtcatcatcagctgtttttcntaantnnagccagctattaantttgagccattatgtaatatatgccataggcaatt

SEQ ID NO: 545582 - DNA, 384 bp, Homo sapiens
atccttgaacaatgttaaacactttttgaaaatctgtcctgcaaatcagtactatcaagagaataatccaccgtactggaaaaaattatttgcaaaacatatatcttataaaagattgttatctaataatatacaacacaactcttaatactcaacaagagaataaacaacccagttttaaaatgggcaaatagctagaggccattattctaagcgaattaacgctggaatagaaaacctattaccacatgttctcacttattagtaggagctaaacattgtactcacagacctaacaatggtaacacagacgctgtggactactagacaggggagggaaagaggagcaagggctgaagaattgttgggtactacgctttggca

SEQ ID NO: 545583 - DNA, 137 bp, Homo sapiens
tcatcatgcagcaaacacaaagtctccgcctgcgcacgtcaccccatccaggacctgcagctcgccctgtccaccacagcagcttccacaccaggtggcgcagtgttcagcagggcgcacgtgccccctcacctgct

SEQ ID NO: 545584 - DNA, 2759 bp, Homo sapiens
  misc_feature (2410)..(2410): n is a, c, g, or t
  misc_feature (2453)..(2453): n is a, c, g, or t
  misc_feature (2492)..(2492): n is a, c, g, or t
  misc_feature (2599)..(2600): n is a, c, g, or t
  misc_feature (2616)..(2616): n is a, c, g, or t
  misc_feature (2637)..(2637): n is a, c, g, or t
  misc_feature (2676)..(2676): n is a, c, g, or t
  misc_feature (2703)..(2703): n is a, c, g, or t
  misc_feature (2707)..(2707): n is a, c, g, or t
  misc_feature (2709)..(2710): n is a, c, g, or t
  misc_feature (2724)..(2724): n is a, c, g, or t
agtgggtaccgggacgccgtgaggcggaagctgtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagattaaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaacgttgaactgcagaatggtaatactcagctggccttacagatcatcaaaaggaatcagctgctcccctgcangtgaaaacacactctgaagtgagaaagaagccagtgttctacngcctcgtccacccgatccagcccatccaaatgccggctnttcaccactgtgcagagaaagtgatacttcacttttggaaaactgttacctgagacccaggggagaatttactggccattttagttgtatcacagcagaatgaatannagatggtgaaggctgntaattttgagtcaattctacncctgacttttggccaaaagcttacttaaaattaaggatntactaagtcatcatcagctgtttttcntaantnnagccagctattaantttgagccattatgtaatatatgccataggcaatt

SEQ ID NO: 545585 - DNA, 853 bp, Homo sapiens
atcttaccacgcccatagcatcaaggctgcgaaagtagtgtccacaacagctcaggttccctacatccgtgagtcaccgggaaaactccttccaggcccgatcaccatgtagctgcacatggattgtgctcaggcttccccaactagtcaactccaagcccatcaccattgcctcgaaccccggacttccactaccagtccacgtagacgcaaggcgacgtggcaggctctgttgattattaatgccttatgttatcatggacaagcagacggggcaggtgatgtggagccaccactcccagttacaggaggtcctacaaacaagatctccacggcttctcaggtctcccaaggaacaggttccccatgttcctaaaattcatggaagtagtctatgtaccatctactgtcaagcgaggaggattcgttgtattgcatctatgccacctctttgctccaattggcgagtcatcgcctgagaaggttcggaaagccctcatagatcctagtagagcaggacggactcggagctttcacaacaagtgatcatcaaatcaggaacctggtgaagcccctcacgtgcccgcaagcaggagctgccagccagtcaccactcccgcagtatgtgactgtgaaagggggtcacatgatagctgtgtcccctcataaacaggtcagtaactcctggacgaagggcatggcccagtcaagcacaggttcagcccgtccaaggattgctcggggtaccagtagggtctgctttaccttcaactagtgaaggcaggctgtggcgatccagtggttggccgagatcctgcgtagcccaggccagccgtcttctgtctccaaagca

SEQ ID NO: 545586 - DNA, 133 bp, Homo sapiens
acctttattgacgctgcgtgtagtttattagggacgagtgctccctgcctacccctcccacaccctccttctgggaggtctgtcagccccaactgtagaagtagattttcttgccagtgtgggcaagtaatcc

SEQ ID NO: 545587 - DNA, 762 bp, Homo sapiens
  misc_feature (368)..(368): n is a, c, g, or t
gatcatgtataaagggagcaggaggaacaggcttcctgtgccgggggtgatatcgagagtgatctcggattagctgaaaaggacaaaacagaagagttagctccaggttttgcttcagagaaggaactatagtgctgaaagtaatgctgttggttcttgcacgagaaacccttatgttgtccacttattccatggtaattacacatggggtgggggagtgggtctctcagtccatgggcaatttcgagtggcctacagaagacagtgtcttttagtcgtatgcctagaaacgtgcaatatggactgttcccgtgagtgttgtggtggagggttagtttctttgccaacagatttcctaatgggaaaanttggttacttccgttgcattaacaggattcctaagactaaaatggaagagatgtgtatccagagcaggaattgctactcacttgtgtagattctgaaaaagttggtcatgtaagaggaagatttgtaggcttgaagatcatccttcaggagagaagaatagccgcatctgtctatagagaaatgaccaatacagagtctgacgattggatccgaggacaaagtcttggtataactagaagggaacctcgttggacccatgattaaacagttcgtctttcaagcaaatactgtgggaagaaattatttgcccactttcccggaagatggttccgcttgtgccctagacagttgagaggctttttgtaacgttccagaactctaagaccaagaagg

SEQ ID NO: 545588 - DNA, 3264 bp, Homo sapiens
agtgggtaccgggacgccgtgaggcggaagctgtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagattaaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggttaatgaggacatctttgatcagaactggtcactgtttccatttccctcctgtcataattcaggatgtgtggaaatttaggcatggtggtaatgagaagaaagttttaggttggctttccacatttttgtctgtacttactttgtagcagttgtttgctaagtagacctgagagttaatgatcacatcatctaaattctcacttttgaaaggctggtactgttagaatggttaattttggttctgatactatttatttgttttcctttggagtgattctaaaatccataggggagtaaaaatattgcattcaagagtcagttttagtccaggcgtggtggctcacgcctgtaatcccagcactttgggaggctgtagcaggagggtcacttgagcccaagagttcaagaccagcctgggcaacctggtgagaccctgtctctattttaaaaataagggacaaacaaaaaacacaacaaaaaaaaaacacatggaggacagcacaggccacgaagaaccaccaaaaacacaaggaggggacgggggccccaaaggaaacagaaaacatgggcacaaaaccgtgttccaaagaaaaaccaggagagagaaaaaaggacgggagattcacaccacaaaaaaaacacgcccggggggaaacagcgcggtttcgaaacaaaacacaaaagaggacaacacagagaaaaaaaagagagacataaacaaagggagagacaaaagagaagacaaatcataaaaataccccgacgagtgcggaaaaagaaaaacaaaagaaaaaagaaaaagagaagaaagacacaaaaaaaagaaaacaaagaagaggagcaagacaaaagaaggaagagaggagaggaggagaagaggagaggtaggcaggaagcaaggagaaagaggacgagaagcgccgaaagagaaagaggaagatacagaaaaggcaagggaaggagaagagaggacaagagaaaaaagagagaaccgaagaaaagaaaagaaaaacagggggagacgaagagagagaggcagaaaaggaaagagggaaggaaagcggaaagcagagagaaggaacagaagaggagagacaacgaagaagaacgaacgacgagaggacgcacgacactaagcgagaggagct

SEQ ID NO: 545589 - DNA, 2677 bp, Homo sapiens
  misc_feature (2328)..(2328): n is a, c, g, or t
  misc_feature (2371)..(2371): n is a, c, g, or t
  misc_feature (2410)..(2410): n is a, c, g, or t
  misc_feature (2517)..(2518): n is a, c, g, or t
  misc_feature (2534)..(2534): n is a, c, g, or t
  misc_feature (2555)..(2555): n is a, c, g, or t
  misc_feature (2594)..(2594): n is a, c, g, or t
  misc_feature (2621)..(2621): n is a, c, g, or t
  misc_feature (2625)..(2625): n is a, c, g, or t
  misc_feature (2627)..(2628): n is a, c, g, or t
  misc_feature (2642)..(2642): n is a, c, g, or t
agtgggtaccgggacgccgtgaggcggaagctgtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcaggtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaacgttgaactgcagaatggtaatactcagctggccttacagatcatcaaaaggaatcagctgctcccctgcangtgaaaacacactctgaagtgagaaagaagccagtgttctacngcctcgtccacccgatccagcccatccaaatgccggctnttcaccactgtgcagagaaagtgatacttcacttttggaaaactgttacctgagacccaggggagaatttactggccattttagttgtatcacagcagaatgaatannagatggtgaaggctgntaattttgagtcaattctacncctgacttttggccaaaagcttacttaaaattaaggatntactaagtcatcatcagctgtttttcntaantnnagccagctattaantttgagccattatgtaatatatgccataggcaatt

SEQ ID NO: 545590 - DNA, 2627 bp, Homo sapiens
  misc_feature (2287)..(2288): n is a, c, g, or t
  misc_feature (2332)..(2332): n is a, c, g, or t
  misc_feature (2336)..(2336): n is a, c, g, or t
agtgggtaccgggacgccgtgaggcggaagctgtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagattaaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctgtaagtaagaagttttgtgatacttaagtagcctgcctgcatccctaaaatttagattctaaatcttctgtgttcgtttttgtgcctgaggaatactgctgtgccaagtggctcctcaaggcgatagttgggttgcnnccttgctgttggcacggcctcttcaccagtgtctacactctttntccncagctggtaagcgggcccctcagtgctaccccagttccgtcaactctgccaggactgtgatgctgttcaaccttggcagcgcttactgcctgaggagcgaatatgacaaagcccgaaagtgtctccaccaggtgagtccagagtgggaggaactgaaccttgtaaagcagcctacacaagttcgaggtttatattttttgttactttgtttgaagcatctgatcagtttgttaaatattggaatatcactttcccagatataaaatattcttacaagtaacacacgcgcgg

SEQ ID NO: 545591 - DNA, 224 bp, Homo sapiens
  misc_feature (37)..(37): n is a, c, g, or t
  misc_feature (165)..(165): n is a, c, g, or t
agaaaacgaaaagtattaactaaagagaatacttcanttgtggtactaaagtattcttgagctgtgggatttttttttttcctcttttttttgagacagagtctcgctctgtcgcccaggctggagtggcaccatctcggctcactgcaagctccgcctcccggnttcataccattctacctcagcctcccgagtagctgggactacagacgcctgccaccacg

SEQ ID NO: 545592 - DNA, 1994 bp, Homo sapiens
agtgggtaccgggacgccgtgaggcggaagctgtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaagccatggatgggataaattcctcccgctcccaccttctgctcctgggaaaccggatttgacaacttatgggccccacatggtgggaggccaagggccgggttgggggaaaccccgggttgagaatgggaaaatttcggagccaggtcgggtcttgttgggattatttggaagcccctttcgagaatgggtcacgaacgga

SEQ ID NO: 545593 - DNA, 346 bp, Homo sapiens
tggggctccatagggaagtcttatggacaacaaaacgtgtccaattaagttctgggatggaatcgcaacaagggttcagttaccccctttccctccctattttggaagacttaaaaagggaagaaccaacccaaaaggttcatccccacaaggccaaacacgatgcttttggaccagagtcggcccaaaagcccctcgggggagctctttctcaacccgcctcacgggggccaggtccatccggggggtgccgggccccaggggctgcagccacaagtttaatagtcgggaataggtgggaatagagtgggggaggcagcagaggtgtgaaagggtcaaaagaggg

SEQ ID NO: 545594 - DNA, 2720 bp, Homo sapiens
  misc_feature (2371)..(2371): n is a, c, g, or t
  misc_feature (2414)..(2414): n is a, c, g, or t
  misc_feature (2453)..(2453): n is a, c, g, or t
  misc_feature (2560)..(2561): n is a, c, g, or t
  misc_feature (2577)..(2577): n is a, c, g, or t
  misc_feature (2598)..(2598): n is a, c, g, or t
  misc_feature (2637)..(2637): n is a, c, g, or t
  misc_feature (2664)..(2664): n is a, c, g, or t
  misc_feature (2668)..(2668): n is a, c, g, or t
  misc_feature (2670)..(2671): n is a, c, g, or t
  misc_feature (2685)..(2685): n is a, c, g, or t
agcggggtgtatttcttttctgcttagttcaaacctaaaggcaatgtttatttagaaatgaagtctatggtgtaaagactgtcaaggttgtgggtcaaagagctctgtacgcatagaaggtcagccatgttcattaggccagagtagaaggaaagtcaagcttatgggtgaacggtcgtatactctttcaattggcaacggagactactttgggcaaataaagaaatgctgtgggattatgtgcagactctgtctgatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagattaaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaacgttgaactgcagaatggtaatactcagctggccttacagatcatcaaaaggaatcagctgctcccctgcangtgaaaacacactctgaagtgagaaagaagccagtgttctacngcctcgtccacccgatccagcccatccaaatgccggctnttcaccactgtgcagagaaagtgatacttcacttttggaaaactgttacctgagacccaggggagaatttactggccattttagttgtatcacagcagaatgaatannagatggtgaaggctgntaattttgagtcaattctacncctgacttttggccaaaagcttacttaaaattaaggatntactaagtcatcatcagctgtttttcntaantnnagccagctattaantttgagccattatgtaatatatgccataggcaatt

SEQ ID NO: 545595 - DNA, 342 bp, Homo sapiens
  misc_feature (162)..(162): n is a, c, g, or t
  misc_feature (313)..(313): n is a, c, g, or t
  misc_feature (331)..(331): n is a, c, g, or t
ggtaatttacaaagaaaagaggtttgattggctcacggtcctgcaggctgtacacaaagcatggtgttggcatctcttagcttctggggaggcctcaggaagtttccaatcatagcggaagacagagagcaggcatcacatggtgagggaaggggtgaggtnccaggctccttaaacaaccagatctcatgggaactatcagggcaagaactgactcattaccatggggatggcaccaacccattcatgaggggtctgtgcccattgacccaatatctcccagtaagccccatctccagcatgggaggtcacntttcagttttgaggtttnggagaggacac

SEQ ID NO: 545596 - DNA, 1375 bp, Homo sapiens
  misc_feature (338)..(338): n is a, c, g, or t
  misc_feature (552)..(552): n is a, c, g, or t
  misc_feature (557)..(557): n is a, c, g, or t
  misc_feature (746)..(746): n is a, c, g, or t
ttttcaatcatttatttaacttctttaattgaaacacagttttcttcctaggttgttctcactccaggtcttcagggccagaagggaatagggtatttttaaactattatcaaagaatctcaaaatatttaaagaaatattattattattatgttattattattatatctttctaactatttttatgggaatatttaaaatatttctagagaggcttttgtggtctctctctctccatttatactctctataggtctcaagcctctcatttatatcaccccgagagaggacacaagaaagaggggctgtgcctctcttctctatagacaccctctccncttctctctcctttattgtctcctctctttgtctcccacccccgagacacgaggggaacaacacaagctctctcgagaaagagatatctcctataagacgagcgatatatagaaagtctctcacgacgtatatatgtgttgtgcgcaagagagagcgcgagagagacggggacaaaaaagaaaaaaaagctcctcgaggtttttctctctctcnccacnacctctctcgtcgagacccacatttgtgccgccgacgtgtgttgtgctcgttgtcccgagggggccccgtggttttctcatgtgcgcacgccttttgtgtaccccacgagtctcgccgtgggaatctcctatgagggggggcgtgggggcgtataagatctccaagagaagctctctgtgtagcgccanagaacccagggtggcctccacgtgatattatttcccctctttttcccccaaatcttcagtgtggcgcaggtgtgtgcaagcggtttaaacccccaaagacaagacattctctctcccagtgtgggcccccaacgaggggccacgaggggaacacactcttattgtgcattgtggaatataagtctacccacagggggagcaaacgaaacacgttacatgtggccctaagtgtgggaaaaaaccaacccctttggtgaaacaagggggccccagaaaggaaaacccgtgtgtctttttcacacccatatttccccccttttttttgttccccccaactccctgtgtgatagcagagggggacgaggaaaaaggcgtctcttggttcaaccccctcatccctcccttttgggtggtgtgaaacacgacttatcaaaaacgccaagagcgttccctctgtggtccaagaactctcaaaagggccccaacggttccccctttggttcaaggcgaaacacgagcggcttctcaagaaaaacaaaacgctgtgaggctcctggtgcgtggtcgcagcccccgcctggtttgttgtcgcccccacgggtggcatctgtgcgcgaacccaccttttc

SEQ ID NO: 545597 - DNA, 283 bp, Homo sapiens
ggtcaatgaaggtgaatacgaggctgaaggaaatagcaagattcacctacacagttctggaggatggttgcacgaaacacactggggaatgtgagcaaaacagtctttgaatatcgaacacgcaagggctgtgagtactcacctattgtagcatcttgcaccctcatgacattggtggtcctgcagtcaagaatttggtcgtggcacgttggccctgttatgctgttttattcaactcaaactcgtatctgcaaatcccatacaaaacaaaatatttaactcc

SEQ ID NO: 545598 - DNA, 2694 bp, Homo sapiens
  misc_feature (2345)..(2345): n is a, c, g, or t
  misc_feature (2388)..(2388): n is a, c, g, or t
  misc_feature (2427)..(2427): n is a, c, g, or t
  misc_feature (2534)..(2535): n is a, c, g, or t
  misc_feature (2551)..(2551): n is a, c, g, or t
  misc_feature (2572)..(2572): n is a, c, g, or t
  misc_feature (2611)..(2611): n is a, c, g, or t
  misc_feature (2638)..(2638): n is a, c, g, or t
  misc_feature (2642)..(2642): n is a, c, g, or t
  misc_feature (2644)..(2645): n is a, c, g, or t
  misc_feature (2659)..(2659): n is a, c, g, or t
agtgggtaccgggacgccgtgaggcggaagctgtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacagtctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagattaaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaacgttgaactgcagaatggtaatactcagctggccttacagatcatcaaaaggaatcagctgctcccctgcangtgaaaacacactctgaagtgagaaagaagccagtgttctacngcctcgtccacccgatccagcccatccaaatgccggctnttcaccactgtgcagagaaagtgatacttcacttttggaaaactgttacctgagacccaggggagaatttactggccattttagttgtatcacagcagaatgaatannagatggtgaaggctgntaattttgagtcaattctacncctgacttttggccaaaagcttacttaaaattaaggatntactaagtcatcatcagctgtttttcntaantnnagccagctattaantttgagccattatgtaatatatgccataggcaatt

SEQ ID NO: 545599 - DNA, 420 bp, Homo sapiens
atgaggaagtcctatgtgccaggccgtctgaatcctgggctcaagcgtcgctgtctgggctcccaaagtgtagattacagggtgagcatggacgtggctgtaatatgatttgatgaggttaggcatgatgtcagaattctattcaaatctggtctgccctggagctccaagcccatctccctagatgtgttctccacatcacctcttgggtttggacaggtaccccaaacacaaccctaaagagaaccacagtacttcattcagtgttccctatcacaggactggcgtcaccactcaacccctccttggaaacctgggtgccatctttgattcctagtttggcttttcctctctatatccagagtcgccaatcctactcctggcttcctgtcacatataccctcttttctccacctgcac

SEQ ID NO: 545600 - DNA, 122 bp, Homo sapiens
ctgttgtggcaatccaatacaggcgcattgccggcgcttattttgtctggatggttcagtgatcagtcatcctgagtcagtgacgccagcatgcttcctatatggctggttcagaatataag

SEQ ID NO: 545601 - DNA, 2504 bp, Homo sapiens
  misc_feature (2155)..(2155): n is a, c, g, or t
  misc_feature (2198)..(2198): n is a, c, g, or t
  misc_feature (2237)..(2237): n is a, c, g, or t
  misc_feature (2344)..(2345): n is a, c, g, or t
  misc_feature (2361)..(2361): n is a, c, g, or t
  misc_feature (2382)..(2382): n is a, c, g, or t
  misc_feature (2421)..(2421): n is a, c, g, or t
  misc_feature (2448)..(2448): n is a, c, g, or t
  misc_feature (2452)..(2452): n is a, c, g, or t
  misc_feature (2454)..(2455): n is a, c, g, or t
  misc_feature (2469)..(2469): n is a, c, g, or t
agtgggtaccgggacgccgtgaggcggaagctgtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcacaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagattaaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaacgttgaactgcagaatggtaatactcagctggccttacagatcatcaaaaggaatcagctgctcccctgcangtgaaaacacactctgaagtgagaaagaagccagtgttctacngcctcgtccacccgatccagcccatccaaatgccggctnttcaccactgtgcagagaaagtgatacttcacttttggaaaactgttacctgagacccaggggagaatttactggccattttagttgtatcacagcagaatgaatannagatggtgaaggctgntaattttgagtcaattctacncctgacttttggccaaaagcttacttaaaattaaggatntactaagtcatcatcagctgtttttcntaantnnagccagctattaantttgagccattatgtaatatatgccataggcaatt

SEQ ID NO: 545602 - DNA, 432 bp, Homo sapiens
  misc_feature (59)..(59): n is a, c, g, or t
  misc_feature (129)..(129): n is a, c, g, or t
  misc_feature (176)..(176): n is a, c, g, or t
  misc_feature (196)..(196): n is a, c, g, or t
  misc_feature (225)..(225): n is a, c, g, or t
  misc_feature (256)..(256): n is a, c, g, or t
  misc_feature (276)..(277): n is a, c, g, or t
  misc_feature (280)..(280): n is a, c, g, or t
  misc_feature (285)..(285): n is a, c, g, or t
  misc_feature (287)..(287): n is a, c, g, or t
  misc_feature (298)..(298): n is a, c, g, or t
  misc_feature (304)..(304): n is a, c, g, or t
  misc_feature (306)..(306): n is a, c, g, or t
  misc_feature (312)..(312): n is a, c, g, or t
  misc_feature (314)..(315): n is a, c, g, or t
  misc_feature (327)..(327): n is a, c, g, or t
  misc_feature (338)..(339): n is a, c, g, or t
  misc_feature (347)..(347): n is a, c, g, or t
  misc_feature (350)..(350): n is a, c, g, or t
gagggttttctcataaatgagggctgcacattgcctgttctgcttcgaagtattcaatnccgctcagtattttaaatgaagtgattctaagatttggtttgggatcaataggaaagcatatgcagccanccaagatgcaaatgttttgaaatgatatgaccaaaattttaagtagnaaagtcacccaaacacttcngctttcacttaagtgtctggcccgcaatnctgtaggaacaagcatgatcttgttactgtnatattttaaatatccacagnnctnacttntnccaaatgatcntagtantngcctananntatctttctctnacctgttattnntcaatttntcncagtatttttatacgaaaaacacttctattgatatctcttagtgtgcagttgataagaaagtttggtatataatggtgggta

SEQ ID NO: 545603 - DNA, 550 bp, Homo sapiens
  misc_feature (59)..(59): n is a, c, g, or t
  misc_feature (129)..(129): n is a, c, g, or t
  misc_feature (176)..(176): n is a, c, g, or t
  misc_feature (196)..(196): n is a, c, g, or t
  misc_feature (225)..(225): n is a, c, g, or t
  misc_feature (256)..(256): n is a, c, g, or t
  misc_feature (276)..(277): n is a, c, g, or t
  misc_feature (280)..(280): n is a, c, g, or t
  misc_feature (285)..(285): n is a, c, g, or t
  misc_feature (287)..(287): n is a, c, g, or t
  misc_feature (298)..(298): n is a, c, g, or t
  misc_feature (304)..(304): n is a, c, g, or t
  misc_feature (306)..(306): n is a, c, g, or t
  misc_feature (312)..(312): n is a, c, g, or t
  misc_feature (314)..(315): n is a, c, g, or t
  misc_feature (327)..(327): n is a, c, g, or t
  misc_feature (338)..(339): n is a, c, g, or t
  misc_feature (347)..(347): n is a, c, g, or t
  misc_feature (350)..(350): n is a, c, g, or t
gagggttttctcataaatgagggctgcacattgcctgttctgcttcgaagtattcaatnccgctcagtattttaaatgaagtgattctaagatttggtttgggatcaataggaaagcatatgcagccanccaagatgcaaatgttttgaaatgatatgaccaaaattttaagtagnaaagtcacccaaacacttcngctttcacttaagtgtctggcccgcaatnctgtaggaacaagcatgatcttgttactgtnatattttaaatatccacagnnctnacttntnccaaatgatcntagtantngcctananntatctttctctnacctgttattnntcaatttntcncagtattttaacgcggaaaaatttgttttgaaacccctgagtacccgtttaataagagaatttgggaaaaattagggggggaaattattttaaaccgggtatgcccaaaattttaaaccgtgtgaaaaccactgttttaaaaaaaaattttcattccgaaaaaaggcaagataaattgaaacagagaaaaaaaaactcga

SEQ ID NO: 545604 - DNA, 415 bp, Homo sapiens
ggagcatacagagtgtgctatcagcaaggacgggtctgtgctatctctgggtactacacggaattcagcccccacggaaaaagatgagtatgccggccggtgaaccaggtgacttggtcacagacccaagatagttaagtgggatcgagacatgtaagcagcatcatggaggttggaagatgccgcattaggatgggatgaattccaaattctgcttgcttgctttttaatattgatatgcttatcacacttacactttatgcacaaaatgtagggttataataatgttaacatggacatgatcttctttataattctactttgagtgctgtctccatgtatgatgtatctgagcaggttgctccacaggtagctctagcagggctggcaacttagaggtggggagcagagaatt

SEQ ID NO: 545605 - DNA, 767 bp, Homo sapiens
  misc_feature (32)..(32): n is a, c, g, or t
  misc_feature (262)..(263): n is a, c, g, or t
  misc_feature (265)..(266): n is a, c, g, or t
  misc_feature (637)..(637): n is a, c, g, or t
  misc_feature (702)..(703): n is a, c, g, or t
  misc_feature (713)..(713): n is a, c, g, or t
  misc_feature (726)..(726): n is a, c, g, or t
  misc_feature (732)..(732): n is a, c, g, or t
  misc_feature (744)..(744): n is a, c, g, or t
  misc_feature (747)..(747): n is a, c, g, or t
tttttttttactctcccccggggggggggggnggggggggggcgcccccccccccccaaaaaaataaaaaaaaaaaaaaaaaaaaaaaaaaaaagggggggggggggccggcctcttctttttttaagagaaaagaatttttttttttgggggggggggtttttacaccaagaaaaaaaaaaaataaagagggggcgcccccccccaaaaaaaaaaggagaggagcccgtttttttttttttttttaaaaaaaaaatttttnngnnaaaaaacccccccccccccccacaaaagaagggggggggggggggggggccccccccaaaaatatatttataataaaaaaaaaaaccaccgttcccccccccggtggtggggaaaaaaaaaataaaaagaaggggggggggccaaacctttggaaaaagccccccccccaagatgggagccccctctttcttttccccccccaaaataattttaaaaaacccggggtatatatttttccacactttaataaggggcccccggccctgtttgtatttttttctcccaaaatcttcaaaaaaaaagttttttttaccccttttggttaaaatttaaaaaagaaaaagggtttttgaaaggaaaaattttaagnaaacaatttttttaaagaaatttttaccccataaaagagtccccttttaaaaaaggcccattacnntaattgaagnaactggggtgccntaatgnaattcctcacanccntacacgtggctgacgattat

SEQ ID NO: 545606 - DNA, 112 bp, Homo sapiens
actcgtatattctgtgacaggtataatcctggagccaggaaaggctctgagaaggtgaaagaacaccacgaacaaagtcttcagatggggctaactcagcagttgaggtcac

SEQ ID NO: 545607 - DNA, 288 bp, Homo sapiens
agggtatcttttcactctccttctggccaaaagatcaggcctccaagatgtaactcatctcaaataagtggagaccaggccacgatggtttctcccagacagcggattctagtattggtgcttcatgcagcttcccgggaaggtttatctccttaataaatctggagggcagatctggccgtgtctccacaggtcacagggaccgccaacatcctttgcgcaagcaactccactggaaggtgccgggtgtcccggggcacatctttgctcgcagctcgtcgtcgccaa

SEQ ID NO: 545608 - DNA, 252 bp, Homo sapiens
agattggaacacgttggcaacattatggcgcatagagttactaatgtttggcatgcaacctccatccgccataagtgaatcttctccaactctctacaacgataaggcacttgttcgcctcatgcacgcagctcgctttgcatttatgtaataggcccattgagagcgtttgtgtgtggccatatatgttagcattctcagtgtgagataagagagcctcactcctcgcgtgccatactcgtacagcccggg

SEQ ID NO: 545609 - DNA, 208 bp, Homo sapiens
tggttagaatcgaatagtgcggcagaacgggatggaaaacgggtcacgacgggagaagccaaagaaaagtgtccattaacttcaagaaatactagggttctagtgctgggaaatcatctcagcttccatctaaaatagttagtctgtgtcttctaaataaacagagacctttgtctctgggttgagcctttcctcttctttagatttt

SEQ ID NO: 545610 - DNA, 386 bp, Homo sapiens
  misc_feature (63)..(63): n is a, c, g, or t
  misc_feature (65)..(65): n is a, c, g, or t
  misc_feature (67)..(67): n is a, c, g, or t
aggtgggaagtcctcaacgctgttgcccccaggctggaagtgccagtgttgaagatccttggncncnaatgcaaatcctcccaccctcacaggtaagcctgggacctacaggcacctgcccacccacgcccggcctaatttttgtatttttagtagagatggggtttcaccatattggtcaggctggtcttgaactcctgaccttgtgaaccgcccgcctcggcctcccaaagtgttgggattatagtcgtgagccaccgtgcccgtcctagagtcagattttaaatcttcaaatattcaagaccggtttattagctatttgaggttgtgaacgcttctccttccttacaagtgcaaagcctaactcattgaatgtgtggattaca

SEQ ID NO: 545611 - DNA, 758 bp, Homo sapiens
  misc_feature (189)..(189): n is a, c, g, or t
ggaggacatcgcgtaactctagtgatcatctccaccatggcctggggtctgctgctcctcaactcctccatcaactcaagggcacagggtgcgcgtgggcccatgtctgcctctgactcagggcgtgcctccgttgtcgtgcggtcctccgtgtgtactatgttcgtgtagtcaacgcgagtgcgtccncttgatcaacgtttgtggaaagctcatgctatgttgtacagttgagtggccattgagtacagcgtactggttctccatgagtacccaagcaaggcgagcgccagaggcgagatgagcccgcgagagactctactgagttatagtgaaggttcagtcacttccgtggccctgtcagagggtgatttgcgttagaatacagcgttacctcttagagcataccatatgtacatatgggctgaaacaaccgggtcacatacccccttgaaacccccaatttccttacccttgggggggggctttcccaaaaggtgggcctttgggaaaagggggaaaccggaaaggggggccttttggaaggtttttcaacttgttgaaccgtttgggcgaaggggcttccagaattagattagccaaaagggtactgccaaacccgagacgttgggtcgagataactatccgtgcgacagagattgggtgaacccaaaaaggtatgagaggcccctgttcccctttaaaggggggttccaagggccccccaaaaagggggccttgggcccccccccccttcc

SEQ ID NO: 545612 - DNA, 315 bp, Homo sapiens
aagggtccaggcttggggagaggccccaaagttgagaactagtaagtgaacaattgttgtactgaagcacttagttacgatgaccgctagatcatcaaacaacctgtggtgtaaatatgtttttcccaaaaaacgtagcacccttcagcaggaccctataaaactttcctccagcccttgcctctttgcaggtagccccttctctgctgagctgcccactgcaacatattttcacaattactctaataaatctgcccttctttacctacaactatcttggtaaatggctttaccacctgcaaaactgaccctagg

SEQ ID NO: 545613 - DNA, 1381 bp, Homo sapiens
gctctaccggcgggatttgatggccgtgactgtctcaccagaacagttctccgctcccagatcatggcgctccctcgggctatcctgccatcggaaagtcgcagacagtcgaggccatcgatgagtgataggttgacaggcagcgttcacctaatggcatgacccagttcacaaggccggttcctaactcatccacagcacttacctgggtaataccaatgtgctgggtatgtacatctacaatctgatgacggtgcaacgtcgaccaggccggcgatccaacgggatgaacaagcaaggagcgtggtggacgtgctgttgacccacttggtagagaacaccaacaccagtgtgtggtttgtggcgcatatgtgggacatacggtggtaagagcccccatcgagagccataccggaccgttcacatgagctgatcatgtatgcctgagtcaccaacttcaagttggacttgatattggcaaacgaaagcgtctgtttcctttattgaacgcaaacttgtgggccactatacaaatcataaaccgcacacgtataggggaccttttaacccagtgttccacgttggcaacagaacaagtggggggcaggcactcggaaggggattgagacattaaggagaagcacaagactcgcgtacggaacagggaccttacaggacaagccaattgactcaggaacaagtcacctttgacagcttaaggtcccattccccggtcgcttcgaatttggacccacaatcaaaccccaaaggaatggctggcccagtggctttccacttcccttgcctgacctcacgacagagaaaacggaggactccacaccatttagacttcgggatggactctcgaaagggttgaaatccaggggaaggcgcaaactttggtcggagccccagaaagcacaagcctctggcactttagggagcacacgacacgcagtgcagtgattttgcacgcccataggacgggagatacactcccatggttggacaaccccagcaaggtctggtctacgggagggcacaagggacttggaaggcactggaatccgagacgagcccactccgaggggctgagacccaaaagggaggacacaacaggggactacacaaccaaggaagaggtgcaaccacacaaggatccgagtgcggcaaacaaaccacacagcgaaaggcactggagccgcggcgcacacaagaagcccaccagccggattgggccccatacgcaacgaggaaggtcggagccccacgacatatcagcgggacatagggcaactcccatgcacaccgggcgatacccccgccacacttgtcggcgaaccgacagcagggcagcccggacaaagggagcaccaccaca

SEQ ID NO: 545614 - DNA, 1711 bp, Homo sapiens
  misc_feature (237)..(237): n is a, c, g, or t
catattcgggtgatagtactgagatgtatagattgacatagagtcgagtcatcatataccagctgtctgatactgtaagttggagtttttccttcactatggtgtggagacttgtgtcttttggaatccatagagaatacttgattgtgaaggctatggaagtgatgaggtatgttgtgaagtcttaggctatcgaatcatgtacacatggatgatcctctcatccacatcccacanatctactagacatagctccctagtcgtgatgaagacgcgtgcctctgcgcctgcgtaatcttccgaggggacaacgttgcagcatcgccctggctcaagctgtactaggcaagaagaaggtggtgtgtagcgcatgtctacgccaggagtcggccaagatcgtttacgacgggcatgtttaccttgctttgtcacacaagcgctaggggccctatctaaatgtacgagctccctaggttggtggacccattgtagaccttagttgtcggtaaggtactcctagccgctgtgacccattctctcttcacgtgcaagtgtggctttgctttggtgctaagttgcggcgaccattgcttcacttgtgtttgggtggcccttgcggggctctcgatggccggttagtgaccgcaagtttgggggagcccaagcaaaggtgccttagggctggaggatgctctcgattgcggttgtcaatccgtgcgaagacaccttcccaaagcagtcgttaccaaagccatgggtgccatagagcactctttaagcttagacaagccaaacacagtgggattagcgcccctcgtaatcgtatgtcgtagggcgatttgccgtttatggacctccctcgttcttagctgcatttgcacccgatttggcatgggcttcgctgtggctgaaagccacaaccggcttgttttcgttgggctttgaagccccttgtgctagctagctaagggtgaccatttgtaagttgtgcccgcaattttactcccaatcgcctccgtttgcctcgtggaacccccttacaagggggatgatccaagtgccggtggcctcttcccagtaaacgactcgggcgtgtgggcgtagagacgcaacctttccaggacgaccattcagggtggagaaacgcaccttaaacttacctgcaggaactaaggggcgacttcccacttcgaaacccacgcgagttgtgcactgaactcctgggtacatcgcgacgggctgaacaggcaattcaggccgcgggttttcccctttaaaacctttggccaccttgccccaccgggcacttaaccaagggcgttggctccaatatgcgcccatttacgcatgaatgtcgcggggccgactcataggacaaagggtcggcctgtgcgtatcataacgaaccggcttttcccaatgccaactgctctttgcccgcacgcgggcacccgtgactcgaaccccccctggcgcgcaccccacctagtaaaccaaccccctgacgagaagcacgattgctgggcgcagaacgcgccagccccaccgactgaaaaaggggccccattcgatagaccgcgcgagtacaccacacactccttgtgcccacgactcacacccctgcaacactgaaacacacgcgcccgcgtcagccataggagacagaccccatgcgcgactatccgaacacaaccgcacacgcggacacgcg

SEQ ID NO: 545615 - DNA, 137 bp, Homo sapiens
taatcgagtggtacccctagttttagaagttaatagcagaaggaatggaatcggcatagcgggtgatagccccgtatgagaaatgtagatggtggaactaggcgcgaatagagtagggcgggacacgtgaaatcctg

SEQ ID NO: 545616 - DNA, 135 bp, Homo sapiens
tcatcagctcgctaccatttatgccgtgaacacactggacaggtatgtctcaagcagctacacgtacagcctcatggagctgaggagctgctacggttacatacgcagtgtaacccccggactcgtaaacatgga

SEQ ID NO: 545617 - DNA, 413 bp, Homo sapiens
gagagagagagagagagagagagagagagagagagagagagagagagagagagagagagagagagagagagagagagagagagagagagagagagagagagagagagagagactctgccatgttcaacgtgggacctgacgctgacacgtaccgcctcacatatgcctacttcgctggtggggatgctggatatgcctttgatggctttgattttggcgatgatcctagtgacacgtttttcacatcccataatggcatgcacttcagtacctgtgacaatgacaatgatcagtttgaacgctactgtgctgcacaggatggatctggctggtggatgaacacgtgtcacgctggccatctcactggagtttattaccaaggtggcacttactcacaagcatctctccttggg

SEQ ID NO: 545618 - DNA, 106 bp, Homo sapiens
atgtgtatctgaggcggagtgaggaggagcagagattatgcactgcggtcagtctgggcgatacgagtgagacctgtctcagaaaaaaaacccccaaaaaacaaaa

SEQ ID NO: 545619 - DNA, 102 bp, Homo sapiens
acaacaggctatacaataaggtactcacatataacatgcaaacaggtggttttctacttggcccctttcagtatgtccccataagacaaacacggccatatg

SEQ ID NO: 545620 - DNA, 132 bp, Homo sapiens
agaaaatggggattcctccaacccgggcgatcaggacgtagggactaaggcacacacctccgccgttcttgtagcagaggtaggggcagcgccacacgttgcccaagcccacggcgcagcccacgcaacacg

SEQ ID NO: 545621 - DNA, 311 bp, Homo sapiens
caggcagatcacaaggtcagcagttcaagaccagcctgaccaacatggtgaaacccgtctctactaaaaatacaaaaattagccgggtatggtggcacgcacctgtaatcccagctacttaggaggctgaggcagaggaatcgcttgaacctgggaggtggaggttgcagtgagctgagatcgtgccactgcactccagcctgggtaacagaatgagacgctttctcaaaaacaaaaaaaagagtcagaaactaatatatttttcatgaaaagcaaaatccatttatcattagatcaagtctgttacaccc

SEQ ID NO: 545622 - DNA, 199 bp, Homo sapiens
taatcagctcggtccccttttttttttccagcggaataacgaaagttttatacggtatgtaagggagcgaaagatagcgggacgcggctatattcagattcaggcgtcaaataattctcaagttatacggtgcactttatttatatatacatatatagaccaatgcgacgggcgtcagtgtcggtctaagcactttaga

SEQ ID NO: 545623 - DNA, 133 bp, Homo sapiens
  misc_feature (104)..(104): n is a, c, g, or t
gataaggtttcactacgtcgtccaggctggtttcgatatcccgatttcaatgatcttcttgcttcggcttcccagtgtcgagattgcaagcgcgaacatctcgnccagctcccagggtggtttacatgtgact

SEQ ID NO: 545624 - DNA, 130 bp, Homo sapiens
gggtcatgaatttttttgtttgtcatggaaatgtaaaagtggaatatttaaacatttcagtttagttttgtaatgtcaggaattttttaaaaaaattaaaaaatgggctggagctttttttttttgaata

SEQ ID NO: 545625 - DNA, 113 bp, Homo sapiens
ccagacgaagtaactgctctgaaatgacttgacacaatagaacttcattttatctagttgaatcacttgaaacccagtattgttttcaatgaaatgtgccagtgtggagagag

SEQ ID NO: 545626 - DNA, 705 bp, Homo sapiens
tcatcagaacattttttattccttaccatcaataattctcaggactgacagacgcctttacaagaaacatgtagggttcttttccccccaatttgagtacatactactgataactgctaaaatctaaagaagccgggtgccattcgcaaaacaattcgcccaaggaacacccttttttggaaacttttgtttaaaacccggccactgaacaatgaacgtaagctggcgagatgaaacaaaatctttccggacatggataacgctcctacacggcggaggctttgaacctaaacaaagtcacatagctttgtcccagaataccaaggagaagggcggatacggatattggaccacatgttcctggcccggtgcaagacacctggcatcctagacggcgcgtgttactaccgccagcgcattgctgatcccggaacaacagggctaagcacgcggaacccaccatcctatcttaaaacgttggaaattgaagcggggcaatcacaccaacaacctgccgccctgctccccccaattaataacgggacgtcccgggttgtacaccggggaatactatatgaataccatcaaatagtttataacaaaccgcccataacactatgcccagaagtcgatacaactcatagtgaccaaaaggagcgaaaggtaatcgacacaggggaagtgggccagtaacataaaccacga

SEQ ID NO: 545627 - DNA, 624 bp, Homo sapiens
gttaaacaccagaatttggttcaacaattttcgaggacattttagcacctttttcaccgaggcgcgtttaaaagaaacaccccgcgggacaccccttgggtctcataatccgggccgtgtaaagaccactaccctttcccccactttttatttccaaaatgtttacctccaaatatattctgctaaaagaagtatagctcttgaaacacctatattgtgcctctcttttttaactaccccaaatttggggtaagaactccccctccaaaaaatgtggatcatcataaaaatatatgtaataattatatccccccactttacatatattttttggaaaaccttatagaatccttgagcaaccttttaaaatgtgtaagataaagagatcccccatactccccaatagtaatcccacaactattattggcatcttttgaacaatctctacacccatcttggaagtatatattcttcccaacacattcattgtattctattcatgtcccaggcgcagatatcctagtattaatattatctatcttattttaattatatttattatttataattgacttttctatttctcctctaaaacaaaaataatccccgcccatcaaagtcaaa

SEQ ID NO: 545628 - DNA, 133 bp, Homo sapiens
ccgcgggtatagatatctagttagtacagttgggtaatcttttgtaattcctaggaggtaaatttgtcataaatggatgcagattttctgcatagctataaaaatagtttgtggtaaactgctttcttcatat

SEQ ID NO: 545629 - DNA, 259 bp, Homo sapiens
  misc_feature (7)..(8): n is a, c, g, or t
tggaaanngactaagcagtagagcgttgcgattttgagaggccgggacgtggaatggttcgggtacaggctgagctcctgtctctctcagtgacatcgctttagccctgcgtggccatccctgacgcaccgccgtgatgcccaggaagacaggcgactggaagtccaactacttccttaagatcatccaactattggatgattgaatagaaagaaagaaagaagagaagtaaaaaagataaaataatataaaaaaaaac

SEQ ID NO: 545630 - DNA, 812 bp, Homo sapiens
  misc_feature (66)..(66): n is a, c, g, or t
  misc_feature (566)..(566): n is a, c, g, or t
gctgatcaacataggctggtgggagtacaggactcgcctcctcagggttccctgtgctgccacttngcagccatggcacaatgaacagatatgcagccgggtcggatgttacgagacacataagaatgggtacaatcaaacctggcagcaggattcagccggatcacatctaccacaaactgccagcaacaccttcagagtcgtggagtcaagttgcaggatcagcaggttgtgatcaattattcaatcgtgaaagggctgaagtacaatcaggccacgccaacttccaccagtgggagatgcccgcaggtctacggttaaactttgcaagtaaagaagaggcaacacattctccaatgcaatgctgtttgcctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagncagcgcccccgtctcatgtagtgggcctccaaccggaccctcaaagagcagaacacccagccataacaacgaagcgacacaacagagaccaaacgagaacaagacacaacaacaacgaagaagaaacactaaatcagaagacaaaagcgaggcctcccataaaggcccagacaacaaagcaagacagagaaacacacaagagaaacaaaagggaaaaaaaaaccacgcaaaaaaaagagaggagcg

SEQ ID NO: 545631 - DNA, 863 bp, Homo sapiens
  misc_feature (397)..(397): n is a, c, g, or t
  misc_feature (528)..(528): n is a, c, g, or t
  misc_feature (569)..(569): n is a, c, g, or t
  misc_feature (589)..(589): n is a, c, g, or t
  misc_feature (606)..(607): n is a, c, g, or t
  misc_feature (630)..(630): n is a, c, g, or t
  misc_feature (655)..(655): n is a, c, g, or t
gctggacgtgacatttatggtccttggacaaggcctcggattatccaggtcctttacctggaacataaagatgtcaggttaatatttacaatcagatcaactttggagaaattttctactaaaaatggaattcccccagaggtgggcaggaattatggtggggttctggacaggctgggtttaggggctggtgaactacacacaggcactggactagaagactaaaattctctctggcttaagccctttggaaatacctctggtgaggagccacactattaactaggatctaacctcccaaattagatctcaagggtgctccaatccttttccttcatattgaagagatattactctcttatgtggggtcttataattgactcctattatacccttnaagtgtcttccaggagaagaagaacgaaaattgtgagcttcaattattaaccatggtgtgaacctttttcctcctaatttccctggcacatcgtctccccaaaccggtggagaccctgtaattattctacnaggacaacgtgggtgttaagtccaaaggcccccagactggnagacaaggtatctacgtggncaacaaaagcgggccannaaatggatgtggcagacatgggngatctcatctatactctcctatagnaaaccagtcctataaagttaagttacaacttttccaagtgaaggtttgcgcaggctaaattattccaaggccccacggggtccttggagaaaattttccctattttggagtatattgttgcccattttataagcgcttggaaaccagtcttccgagtcataagttgcgttctcgggggattaggctctgcgttaccctgggtatcctg

SEQ ID NO: 545632 - DNA, 372 bp, Homo sapiens
agcacggagtaactgtaagcttctgagagaatagagcgctaggttcccaagcttagggaatgttggagggttcctattcattcctcttgacaaagttcctgggcagagcaaagtaaagggcttctaacctagggacaatagtcctagacttggggcaaacaactcttgtaatcggggtcagcaagagaaactctactggcaaatttgaatgtcaggtaggaggcctctagaacaaatgtgcaggccgggcgcagatggtacacgccctatcatcctagcactttggaaggccgagacgggcgggatcacgaggtcaggagatcgagaccatcttgggtaacacggcttccggggtacccggagctcaaattc

SEQ ID NO: 545633 - DNA, 585 bp, Homo sapiens
aataacatggccctgaataaacactgaactgcaagcggaaaatgtattgaccaaaacgaaacaatggaaaatggccaggggaaacccgaaaaaaaaaaaaaatacaacacaaaaacaccaggtgggccggggggccaagatccggtaaacccaaagggaaaccggcagacagctaaaattacaattagaagccaggcggtttgaaaaaagctaggcagtcaataaccctttggaacggaaggcacactccctaataggtaaaggtaacggcccggaaaaagggggcttataaagggaacacctacacagcctagttttgccacaaccttgaccaccaaaaaagttcaaaaagcgtctaaaggccaaataaaaggggagacgctaacagccacaacaccaatttaaccaagaagggtcccataccacaacgcggggattggcatgacagaccaaagaaccccaagaagaaagaaaaaaaactgggcggaggggacaaaacaggcacgggggaaaaaaaaaaccgaccggggtggagggaaagcacccagggaaggcccggttttgggaacaacaaattcgagcgga

SEQ ID NO: 545634 - DNA, 881 bp, Homo sapiens
gcaccaaattgcggatacgccggtcagcggggggtgcccggtgggccctggtggccctgtggatggggaaccgcggtggcttccgcggaggtttcggcagtgtgcatcctggtggacctggaggtcgctggcctgtgtgacgtgtggccggtggaccgatggccgcagtgagctctgcggagtgcaagtgccagaggataagggagttggactgcaccgtcacgcaaagttgtggcacgcttggatcaaatgacaatgagagatcatagtcacctgtgatggagaatcgtatcttcgttctccgctggctccaatttagaggacatcaggagaatcagttgagtttcgttcgctggggagcctcttctcaatggtactgacggtctttgaaggattactgccaggtgcagagagcagaccccgtgccgagccaggggaaccagtgttcaagtgcatgtcgttgctatcaggggactacatatggccacagtcgagtctgggctgttaacgtgctccaaggcagagtgggcaccgacataccgtggtgccatcatcctgggcaaggctctccatctgtacaccgtgacgcagaggctactgggggaacacagatcggccaaggcgcacagctgtcccttgcagaggtgacaggccgctgcggctctgcgctggatacgcctcaatccctgaaccaggtgcaactggcatcgtctccggcaccatgtgccctaagacgctgttcatgatggctggtatccgatgactgctaacacatcagccggggctgcacttgccaccctgggcaagtttcgccaaggtcagcctttgatgccatttctaagaccttaagctacttgagcccgtactcttgaaggagactg

SEQ ID NO: 545635 - DNA, 181 bp, Homo sapiens
acctggtgatggtattggcttctatcagcatctcttctctatatgcagtcccactaccagctggaactgcagtgctgcatcgactggagcccatgtcactgatcccctcataggatgctagaagccagtgtctgcctcagggaaggatatggacttgggcacagatggcatgtcaccgtat

SEQ ID NO: 545636 - DNA, 109 bp, Homo sapiens
cagcagatccttggtgtcatgcttgtcttccatctcaagcatttatccaaattctgctcacagacatgaggaagcaggctgtagatttaagggcactcaaggggcaaac

SEQ ID NO: 545637 - DNA, 252 bp, Homo sapiens
atctcttggcgtattgtcagtgtcttggcgcgaccagccagtgtctaaaatgccattggtttttcctttgccttagctgtagtcaagtggcatctcgatttaggagttgcctccgagagctgtgttctgtccatcacctgtgtattggccctgtgtttaccactctggcctgtcgtcacccccttgccccctgttgcaaattctcatggtacgggttgggtggtgaagagcgcgtgtcccactctcctcttt

SEQ ID NO: 545638 - DNA, 901 bp, Homo sapiens
gcatacagttgccagagtacccctggcattcccatgaactcgagcctccaagggaccgggaggatagcgggtgtcctttgtatagtggttggaggttcggtgatcattgctctggattgggtggactcccgcgcatgccagccacatggcagctattgcctcacctttctccagacagccgagtaccctctagtgcacgagctgtgttctttccgctcgcgaagagacgagggtttgatggactaggtcggcaatccatgccaacgtagtagtccagagcgaacgttggcgagcgtggtacggtagagctgcacacatgcaggcctcttgtcttaacatccgcctagttcgacctcatgtcgttgccgtatccgcttgggcttttgtcgatactaggacgcgaaaggatcgacacggtcacgtaatcggaggcccttttgtatcgggcttcggagatgggtgacacggcttgtttgctctctgagaccatgtttgcccaatatgtcgctctatgtgagtgtctctagagcacgaagttcattaactagctgagctctccttgcgcaatcgaccatgcactcgaattgtccaagtaatctagggggttctatcagcgtattcatactccctatggggcgggacccattgcgtaccactctcctggatatcgtagtgtccgccaggttgattactgtaatcgtgatagtagcaataagtcgagactgcaggggaacacgccatgggtcttctttgtgaccactggctccacactgtactccccccgctctctacaccttttgcgtgcttgcgtgcgattcctgggccatggctggtgccgacggattgccggagactgtcgtgacagaaccctcgtaatttgcgtgtgccatgatcatcaaga

SEQ ID NO: 545639 - DNA, 339 bp, Homo sapiens
  misc_feature (254)..(254): n is a, c, g, or t
  misc_feature (314)..(314): n is a, c, g, or t
aatctgaaagtggatatttggatagctttgaggatttcgttggaaatgggattacatataaaatctagagagaagcattctcaggaacttctttgtgatgtttgcattcacgtcacacaactgaacattccctttcatagagcatgtttgaaacactctttctgtagtatctgcaaacggacatttccaaagccttcaggcctctggtgagaaaggaaatatcttcaaataaaaactagtcagcagcattctcngaaacctctttgtgatgtgtgtactcaactaacagagttgaccttccttttcacagagcngtttggacactctatgggtcctctg

SEQ ID NO: 545640 - DNA, 189 bp, Homo sapiens
tagaggtatcccccctagtatccgcagtttcaatagactgtactatgcatgcagggcacttttgatcttttctgagaagtactgtccctacagtgagcttacaatattcagtgaaatcatgttgtcatcagatctgctgtcatcccagctttttgtttcatttggtcgcgcacagtcggaatcgatttg

SEQ ID NO: 545641 - DNA, 1006 bp, Homo sapiens
aaacagtaggaacggcgaggatctgaattttgtccaatggttctacaagcatttgagcttctggttcagagcttcatagttctctaacatcagaaagttcatttcttgaggatagcagaaccgaggccctcaagtgcaatgctcatttaaaggatccagagataaacagaaggagaatgacaaattacggagagtccctctccaggaagaccgtgagccctggagcaccttcagcggcgcagatatgccagcgctgaaggagagaaaatgaaaggctgcagaaagaaggcagcgagaaggagagacacaaccgggcagcggatccaggaggtccgctgaagcggccaggagctgagcatgcgtgcaggaggacgcgtgaaacgtcgaggcgagcaggctgctctcacagaatgacgagctatgcagatctctccgagtggagctgaaggcgtatgagaagctggatgaaagagacagcaggagactgagagagcgcgtcgggagaaggctggaaggggcaggatcctttgcagggaccctgcaacagcctcctgatggagatccaggctctggcttgcaactagaaaggaggatcgagaaccagaagcaatctgcagagcaaggctcaaggaacaggtggcaaggggggcagagaaggcacaggaaggagccctcactctggctgtccaagccgtgttcatcccctgaggtgcccttcaggctgacaaggactgatggtgacgatatatgccatggaaagtggtattcatttgatctgttgatctcgcagagtgacaccaaatcagttgagagaatctcaatctctgggaatggaaggatccctctcgggaacggggagtcgggcatacatcggggtgccgcggcatggccaacggggcaagatgcggcagttggcatgaaataggcgcaaacccgcgagcggggggaaccggcggcgaggggagcccggttgggggcacaacacggcctcccgcccagggaaaga

SEQ ID NO: 545642 - DNA, 196 bp, Homo sapiens
gtgtagcacaacctagggtcagttttggcaggtggtaagccatttaccaagatagtcgtaggtaaagaagggcagatttattagagaaatgtgcccgcaggttgttgtgatttgctgtctctaacaatgttcatacaataattgttcattattgttctcaacttggggctctccccaacctggggacccttcctta

SEQ ID NO: 545643 - DNA, 83 bp, Homo sapiens
taaaaaaaaaaaacggggtttgtggcgggactttgaacaatttcctcagaaccttttaataaataagtttgggaatgcttaga

SEQ ID NO: 545644 - DNA, 708 bp, Homo sapiens
atgaccccaatacgcaaaactaagcccctaataaaattaattaaccactcattcatcgacctccccaccccatccaacatctccgcatgatgaaacttcggctcactgccgtttggctgcctgtcctgatcctccaatatcaccacgaggactgattcctaggccatgcactactcaccagacgcctcagaccgccttttgccatcaatcgcccacatcagtcgagacgtaaattatggctgaatcatccgttaccttcacgccaatggcgcctcgaatattctttatctgcctcttcctacacatcggggcgaggcctatattgacggatcatttcgtctagctcaggaaacctgaagacatcggcattatcctcctgcttgcaatctatagcaatcaggccttcataggctatgtcctcccggtgaggccaatatcagttctgaggggccacaggtaatgacaagacttactatccgctcatcccgatatcatgggacaagacctagttcaagtgaatctgaggaggctaacgcagttaggacggtcccaccctcacacgattctttacctttcacttcagtcttgcccttcattattgcggccctagcagacactccgactcctattctgcacgaaacgggatcagaaaccctaggaatcactccattcgagtaaatcacttcaccttagtaacaatcaagagcc

SEQ ID NO: 545645 - DNA, 257 bp, Homo sapiens
actacacacacacgacacacacacacacacacacacactacctattctattcctcgcaaagaacgatcgctatagtctagaagcatagaattgcccccaagttccgcgcaccagctcgaattcatatgaagtgcacttgttatatccttagtagtatgctgtagggccagcccagcttacagactcccattattgtcgatcagtgccgtctgccctgcccatgtgcggcctcaggccactggcaggcaggcggcgaa

SEQ ID NO: 545646 - DNA, 292 bp, Homo sapiens
atatcccaccctccagtggttctgtcttggcttaagatccatcctgttgaagctcttggctcctcctgtctgagctgtgtttagtcttgcgtgagtgtttcacagcaggttgattattgggctttgggccaaggaagtgagatccaacatggtcaaaacccctgtgaactctagagccctgccctcagactcttaccgacaccacagctgtcagggcagagaccatggagcttggccgcagaggaggggggctgcatggggctcagatcccaccccgtgtgaaaaagtccta

SEQ ID NO: 545647 - DNA, 306 bp, Homo sapiens
agtgggtgacactattgatctttctctagtctgcaggctgtcatagaaggttcttagattatatttgtcatgtctttcaatcgcctgtaatcagtgactatcatttccacacttgtcttgagcatttaacccagtagtcgaatatagcttttgtttttatgcggcttcctgtatgggtattatccctcggtatgggtaatggtgcagaggcaatggagaaaagcagaagttgtagctgatgcaggtatcctatgcccttgatggatgagacttaaataaaatttttgaagttaaaaaaaataaaaa

SEQ ID NO: 545648 - DNA, 373 bp, Homo sapiens
gcgaggtctgttacccagcattcccagagcccagcacactgatgtacagaggagtcctccagcgaagggtcagtgtgagagggacggagagagggagagagggagaggctagccatgaacatgtgggaacacagagagaaagaagatgaacgagagagagagagagagagagagagagagagagagagagagagagggagggagagagagagagagagtgctggggtaggctggggtagggaagcagtccttaagatactaggttgacttgcacatggtgataggtgatgatataagctgtggctaggtcactgttgctacaatttctaggaggagcctagtggaattgtctgtaagctagtaacgtcgacgc

SEQ ID NO: 545649 - DNA, 222 bp, Homo sapiens
ctggctggaagacacatactctctgaagatcacgggggaggccgtccgcgtactacatagcagtcacgtcaggctgggacaattcctgtttacagagaactataaaagccctgccccctcctcacttggggctgatgccattctaggcctcagcctgtctgcatgcaggcgctcattgaaaacagtatgttgctccactaaagaagcacatgatagatagtg

SEQ ID NO: 545650 - DNA, 198 bp, Homo sapiens
acaggtaggattattgccaactacttaccgtataccaggaatatttataagccttgagagtacaaccctaataaggcagcctccgtgctcaaatagatccatctattgaaaaatcgataaagtcgagactaaagagagatccttggttgcgtataaaatcttaggttttaacttccaggctggcacagtgttgtaaca

SEQ ID NO: 545651 - DNA, 171 bp, Homo sapiens
agctaatcaggaaatgcatgaaagcatatcatggcattgcaaaacagcatggcgggtaaagcattacaagcatcatagcatctatggagcaaatacaatcagctcaatcagccaacccatgccgagcagaacactaacagcaagcaggacttgataggagcatgagcacat

SEQ ID NO: 545652 - DNA, 107 bp, Homo sapiens
gtttacgtgaccctagggtgttgtgacgtgtacattacgtgcgctgagtcggggcagggcgcctactagggtgtagaatcggcagtatgcttagttctgtggctgtg

SEQ ID NO: 545653 - DNA, 462 bp, Homo sapiens
tgagcgtactgatgtaagagcctgccatacttggttgctgtatatcagcgtattgattagatggtgactgtgtgaagctcacaagtctgtttgtgtctgcgaagaatgtgcggtcttttcttcatactgatcactatcaccagatttgccttcatgagttttccatggcctataccaagtatgtcggagattctctgcagcccaagacctacggccgcagcagcgtggaggagctcttgggagcaattccacaggtggtctggataaaaggacatggtcataagagaattgtagtgttaaaaaaatgacatgaaaagtcgtgcgagttcactacagtctctcccctggcactcatgaaaaccagccctcggagggcgagcgcatcctggaggtgcccgaatcgcacacagcctcggaactcacgcttggagctgacggcagtgggcccagtcacacagagca

SEQ ID NO: 545654 - DNA, 632 bp, Homo sapiens
cccaccttgacctgcctgaggacttccaggcagatggggtctgctccgcaggagtaggccgatcgttctaccaggtgcagccccctgcattgaaggccctgcatggagcaaggaagtggacgctctccaaggcgcgagaagaatgccatgcatcacacatacatcacgtgaaccagcgctgtgcaagagcgcgtccactttcacatgctgcgcgatggcacacccagagtctagcgagaccgtctcctcttccagacatggaggtcttcaacgccaacatcattcagctagccatcctgtcctcttcgctcaagcatccgttgcggctctaagctcttctactgcatccaagtggcaagtctctcgctccatcaccagccacttgcaggacccctaaccacctcactctggactgggtggccaatgtggagggcctgtccagcaggaggagtacaccaagcagaagctcaagaggctctgggtggtgcccgaccaacaagcagatcaacagcttccaggctcttcgtggaacgaggtactgaaaatcgctctgagcgatggcttctgcatcgattcttctcacccacatgctctggattttatgaacaataagattattcgattaatacggt

SEQ ID NO: 545655 - DNA, 312 bp, Homo sapiens
tgatcccattatcggtgatacggctgctcgcggtcatcatacaacgtctgagtgggacgtagacgtttgaagtccttgagacgacggattatgctgcgactgtgagtgcgtcgtagtttgcgtttgctaggcgaatacgtaatgaggatgtccgtccgtgggcgattatgagaatgactgcgccggtaaagcttcagggggtttggatgagccatggctgttactacacgggctatgtggctacttgcacgagtctgccatgagcgcttttcaggtctgtttgtcgtaggcagatagcagcttgttataatt

SEQ ID NO: 545656 - DNA, 903 bp, Homo sapiens
gcaccaaagtggctgtgatgacgcctgtgtgcatgctgttggtgggccctggttggccctgtgtggccctgggatgggtgaacctgcggtggcttcctgcggaggtttcggcagtggcatccggggccggggtctgctggcctgatggactggtgtgcctggtggccgatggcctgctggagctctgctggagtgcaatggccgagggataagtgagtggatgccctgtcaccaagttgggcctgcttggtcaatggacatgaagatcaagtccctggagggagatctatctcttctccctgcccattaagggaatcagcagatcatttgcatttcttcctgggggcctctctcaaggatgaggttttgcaagattatgccatgtgcagaaggcaagacccgtgccggccagcgcaccaggttcaaggcattttgtttgctatcgggggactacaattggccacgtcgggtctggggtgttaatgtgctccaattggagtgtgtggccacctgccatcccgttgggggccatcatccttggccaagctcttacatctgtcccccgtagctgcagatggcttacttgggggggaacagagcatcgggcagagccccacagctgtccccttgcaatggttgacatcggccgcttgctcggcatctagttgctggtacggcctcattccactgcacccagggggcacttggcatcagtacttccggcaacctgttgcctaacgaacgcttgcctcactgaatggctggtaatcgatgactggtaacaccttcagcccggtggcgcccgctgccacctcttggtgcaagttttcgccaagtgcaaccttttgaatgcccaattcttatgaacctactggttacttgagccccgatctctgccaggca

SEQ ID NO: 545657 - DNA, 255 bp, Homo sapiens
tcatagtagccagatttccataccgactgctcttgaaccacagcgctgatgtattcatgcggtacctgccgaagactcgacacggtcaggacatacggcaggcccacgccccagtgcgcggcatacggtcggaaacagctcggactatcaccacggcgtaaatagaggtgtagccgctgacgatgatcagcgccgccatgatcaggaagaacgcgccccagcagctctggatggtgtgcagggtagtaaggatcg

SEQ ID NO: 545658 - DNA, 1074 bp, Homo sapiens
tcggcacgagggagagacctagtctcgtagtcttttatttttttttttggggggtaggctcttaattaaacggttatggctgtactacagggtcagagtgcagtgtaagcagggtcagaggcccgcgttcagcccaaaaatgtggattttctctcccatatgtgactcacaggggggtgggttttcttcagaaaaagccccagaaggcagggaccaggtgagcctccaaggtttagaagtgtggaactggaaggcttcagttcacatgtgctgatttccacgccttccaggctggggcagaaaggaggaaatcgcccatgactgtgccaggttctccccattctggacaccagtggaatgtctgggtaaggacagcagcactgcacagcctcggtcttctgccagcgaggccaatcatgggtcaggacagcatattgcagtggtcagaagtgtctggagatccggaataagtgagacagggtgcagtgtaccctggtggaaagggcacttctgggcctgaaaacagctccatgtggagcccttgcaagatacagcgcgataggggccttgtggaaccaaaagcccaaaagccgtggataagggagacgccgtgccaggggccactggccaatggagagcaatccacccagaagcctttgaatcccccgtggtgtgcagaaagggactgtgagagaaggtgagtagacatttagagtgaacaggacatcatttaacaagcacagcaaaagtataagggttaaacaaaagttacaaaaatccaggaatagatttgagaaagaccatcatttaaagagaaggaatgatacaaatgaacatgagggggaatataaagaatgtatcaccaagaacatcactaccacgggaatgatcaccacgtgggaataaaaaacgacgtggaatgagccacagtagggggaggacccacagacgcaggggtcagcaacacaggagtgtacaccaaaagccagtgtcgcaagaacaagaccacacgagatggagagcgtgaaacaacaaagcgcagtgcaaagagcactgaggaaatacacaacccag

SEQ ID NO: 545659 - DNA, 313 bp, Homo sapiens
  misc_feature (103)..(103): n is a, c, g, or t
  misc_feature (120)..(120): n is a, c, g, or t
  misc_feature (122)..(122): n is a, c, g, or t
  misc_feature (143)..(143): n is a, c, g, or t
  misc_feature (171)..(171): n is a, c, g, or t
ggaaggtaattgaatcatgggggccggtctttcccatgctattctcataataatgaataagtctcatgagatctgatgggtttatcaggggtttccgcttttnctgcttcctcgtttttntnttgcccactgccctgtaagangtgccttacacctcctgccgtgattctnaggtctccccagccatatggaactgtaagtccaattaaatctctttttgttccccgttttgggtacgtctttatcagcagtgtgaaaacgaagtaatacactgtgtaactacacaaaacatcccctatttgcctaggctact

SEQ ID NO: 545660 - DNA, 309 bp, Homo sapiens
cagggcccctagtactctggccaaaggtctctgactgactccttcccagatcttctcagcttagcagctgaagactgatgctgcctgatcgccttggaagccccctggaccattacggatgctgagctttggataactcttacagtagaggattcccaactatatgaagacaccctagctggacgatcagttcttattaagaacctgacccctcaaactctacaacctcgatggactggaccctacttagtcatctatagtaccccaactgccgtccgcctgcaggatcctccccactgggttcaccgt

SEQ ID NO: 545661 - DNA, 391 bp, Homo sapiens
tccttcggcgccgagcacagcgagtcattgccacattgctggtggagctatagacctgctctcccgcgtcctgagccaggccagcgccgacctgtgtggccaccctgaggcacaaactaactgtcatgtacagtcagatcaacggggcgtcgtagagcactggtatgatgtgagaaacaggcagcaggatgtgcggatgactgcaatacagatcggtggagcagctacgacacgaatacacggaaatgaaggctctcttggacgcctcagagaccacctcgactaggaagattaaggaagaggagaagagggttcacagcaagtttgacaccatttatctgattctcctcaagtaagaagagtgagatccagaccttgaaggaggagattg

SEQ ID NO: 545662 - DNA, 363 bp, Homo sapiens
cactgcagccttgaccccctgggctcaaatgatcctcccgcctcagcctcccaagtagctgggactacaggtgcgtgccaccacacctagctagtttttctattttttgtagagatggggtttcaccacgttgcccatgtggtctcgaactcctggactcaagtgatccacccatcttggcctcccaaagtgttgggattacaggcatgagccatggcacctggtccattattagaattctatactacaaaataaatggaaggaattaggaagcaactagttgaactgtttttctaagaactttcaaatgggaaagtatagaattttcagctagaaaagggggggggcaaaaataaaaataat

SEQ ID NO: 545663 - DNA, 413 bp, Homo sapiens
caacaaaagcaaaaataggtaaatgagataacatcgagctaaaaagatcctgtacaacaaaggaaacgaccaacagagtgatgaaacaacttacagaatgggagaaaatatctgcaatttatctgacaagtattaataaccagaatatataaggagcaacaaaaaagcaagtatctgattttgaaatgcacaaatgatcagattagacatttctcagaagacatacaaatggttaattggtatatgaaaaaatgttcaacattactaataatactcagggaaatgggaatcaaaaccataataagctgggcacggtggctcacgcctgtaatcccagcacatgggaggccgaggcaggcagatcacgaggtcaggacttcaagaccagctcagccagcatagtgaaaccctgt

SEQ ID NO: 545664 - DNA, 327 bp, Homo sapiens
gctagaggacgcagtgctactccacaaacagctaatatccagaatctacaaagaactcaaacaaatttacaagaaaaagacaatcccttcaaaaagtgggcgaaggatatgaacagacacttctcaaaagaaggcatttatgcagccaacatacatatgaaaaaagctcatcagcactggtcattagagaaatgcaaatcaaaaccacaatgggataccatctcacaccagttagaatgacaatccttaaaaagtcaggaaacaacagatgctggagaggatgtggagaaataggaacgcttttacactgtttgtggaggtagcact

SEQ ID NO: 545665 - DNA, 278 bp, Homo sapiens
cagctcggtctcagtgatccccaatgcagcggactcggtacaaaccctactagccaggaagagagtgggggccaatattcaacattcttaaagaaaagaattttcaacccagaatttcatatccagccaaactaagcttcataagttaaggagaaataaaatactttatagacatgcaaatgctgagagattttgtcgccaccaggcctgccctaaaagagctcctgaaggaagcgctaaacatggaaaggaacaaccggtgccgagtccgctgcatt

SEQ ID NO: 545666 - DNA, 543 bp, Homo sapiens
ccccccgcgtctcgcccccgggtcccctgggggctattggagttataatggtggggtgatcttttatttggactcccctgtgtggaagaattttactccccggggatgtctcttccccgggtcccccacatggtgtagaaggggagtgtatatgcgcccttgaagagatgtaagtctttctcctgacgcccttcccaagtatcctccatagccccggggtttacacagcggtatctcaccccagagacttaaggattatgaggttgctccagctccagagaaagatgccagatacaccgtgggacaatcccacaagggccttaaagacgcgtgactagtgagctctaggctgtagaaattttaaaacatcacccatgtgattacatcgggccccttagattttctaacccaggaccagggtccccctttgctttgatttttttccaaaattggatttggggtccccagaaccaaggcccaagcttggttttaaggttcccatttggggttttggaccaaaaaaatttactttttttgtgccta

SEQ ID NO: 545667 - DNA, 991 bp, Homo sapiens
gaagtcccaggcgtgcggtggccatggcgctgtctacgtcgcgcggtacccgggccccgatgcggcagtgcggggggccggagggggcgaggccggggcgcaagggagtgcccggcgctgtcgaagggttgaagagcgggccccgcaaaagggagcagcaagtggcagcccgcgcaacaccagaggcgggctgattcgaccgagccggggaaccagtgagggcagaagcgcgaccccgggcggacggaggacagggtgaaccgacggcggagcgtgtgacaccagagggccccagagggtaaacaggcgaacggaatgggttagacggataaagaaacatggggcacaaacactaacaacgtgaggatcgcccacagggcaacaccagaggacaagtaaacacaaagacgaacagatgtccacacgggggaaccaccccaggtaggaagcgaggacacaccagcggagtggtagccagagggggagcccggaaaaacacacagagagaacaagcggcgagatgctggggccccaagtgtgagcccggcactttagaagcggagagaccgacatcctgtgacccccggaccagataagctgggggagagatacataaagagtacggacgggagcaagaagagccaaagcttaacacgcaaaggagtgttgccaagcaatactgtgtctacagaagggatgtcaccaaacaacgcggacaccaaggaggaactcgaataactacacaccagtgacgaagaacaccggtggggccaccggcatgcacaaacacagacacggcgggtgataccggcccatggaaacgacgcagtgacctggaggacaagtgtggacgggaaacagccttgttctccccacgggacgtgaaaccgtactgacccgtggaggcgaagaaaggcacaacgcgttggtgccacggagcgcgtgagagtactaccacacgatacgtacaacattggcggaccacgagtgc

SEQ ID NO: 545668 - DNA, 523 bp, Homo sapiens
tgtggccacggcagatcatcccctgggtctcccgagatcaactgtactaatgatgctcataccacatgatgaggaacgtaaggactagagtatcaccagggtatacttgaaacagcaaggtagggcgggtaaccttgcatacaacttagagtataacatcatggtgagtattccatccagagccagcactcgatgtattaacttacacctccaggtggatggtaaaaatgtcagcacgagaatggatcaaaaagcaggagtgcagagagagtgtgtgacaatcagaagtagacgaagctattaggaaagacaactgctctgaaattttagtacctattttaaaaggaaaataagctgattctctctcaggttcactgagggcctttggacctaatataaatattcttctcaacagtcctttccacaaatgtcttactcaaccctctctgttcagtaggtcattaatttagattccaatgatatgcaattcatgataatccaaatgaacagagattaccttggc

SEQ ID NO: 545669 - DNA, 309 bp, Homo sapiens
ataaccccccctgggttttttccccattctttttttggggggggggggctttaaaagaagcccattcccccggttttttcctcccccccgggtccccagggggggggggggccccccccttttttgttttttttttttttaaaccccccccccggtttccccccaaatgggggggggcccttttggggcccccccttttttttttgggggggtgggaaaagggcccctttttccccccgcgggggtttggggggggccccccttttccccaggggggggttttaaattttttttttgccccggggggga

SEQ ID NO: 545670 - DNA, 902 bp, Homo sapiens
  misc_feature (523)..(523): n is a, c, g, or t
ggcatagtgacttccttgcagagtataatatggaaaggggggaaaagagtaactttacagtggagaaatctaggacagacaccagctcagccaggtgattgatggttaacatcatccatgataagccctttctgatagcatgtcatccttgatagcagtcgacatcatacagaatgtgataagaatgggcactttagctctggtggtcctcctccccaggaactcgagaacccgaagtctgatcgaggagaacaaagcatcagcacaaattccaagttgagaagcattctttaaacatacctaacccagtacttctcaaaactatcaaggggcataaaacaacccaggaacaatcttgagaaccatggtccacagccaaggaggagcctgagaaggacacttgacttgcgtagactgtacctgtggtatcctacagtggaatgcattataccgcacggaccacacgaacacacacaaggggtcaattcgcgttcacgaaaaccctaaggcgaaccatcttgcnactacacagcttgttggaccttcaagttttcactacgtacatcgacgcacaacatggtttgcgaacagagcgcttacacagagggatattaagaaatagtccttaacatatagcaaagaagagactgcacacaggacaagccaccggggagaccaaggcaaaggggataacacaacacaggtgggacaactaaacaagcggccataccgactgagcaccagatcaaaggataggcgaagagcagtacgtgacccaacaaaggcacaaaaagacaatcgcaccaccgaggaaccacaacaataggagtcaccagagacagacccaaaaacaaaaaagggggacactaacaacaagacaaatggaaaaaaacaaaacaaaa

SEQ ID NO: 545671 - DNA, 166 bp, Homo sapiens
cggcgcggcctctatttggcgtgcatattagaaaacaaaggcacgtttcctagaaattcaactttacattaacacagaaaatcaattttatgagagtacagtaggttagcttgataatatagcaggttctaagtcacaagtcttcaagaggtttcttgaacagcta

SEQ ID NO: 545672 - DNA, 226 bp, Homo sapiens
ggcggcccggggggggggggacttccttttttttttggggggaatttggtttgggggattggggtggggcccccttttattttggggttaacccccctttgcccccgggttccccccggggtttttcccctttttccgggggcccccttttttttttttcccaaggggttttttttttgggggccccccttttttttttttcccctttaaaggtttttaaccttta

SEQ ID NO: 545673 - DNA, 167 bp, Homo sapiens
ttcctatcatcgccgcgtaatcttgcgcaccagcatgtgacgtatagagatgatcgatacagttaaaaaatttagccgctttacgtggcatcatatatcggatttacccctggggataccagaccctagtcgcagatcacgacttaacccatgaatgattgggatgc

SEQ ID NO: 545674 - DNA, 120 bp, Homo sapiens
cataatcgcatagttgcagatatcggagctggaactacctcttctgtaatttttattttttttcttcaaaacctactgaatttattaggttatggatttaaaatttctcctttcccctct

SEQ ID NO: 545675 - DNA, 657 bp, Homo sapiens
ctcgggttacgtgtagagcgattaggccctaaatgattgtccctctgggcttaccattgctcactgaacccgccattatcgttctctgcaacagtgtcttgtgactccctttctgtgctttctggattatacttggaatttttggatactctcctttgagcttccgggtctccttctgccatattcaccaaccacaccattgttgaggagtaaatgagagctggaaaaagcgtttcatttctctcctgagctggttcaaccagcatacgaagtggacctttcggacacaaaacagccactaaatcatatactgaaatcacagccaagatgagccacgcagtccattcagggaggtacttgataaacaccagggccatgagggcactaatcataatgagatatgcctgctggagtcgaagtggacctttccagtgaatggaaatcattcccaccacaccaaaattccagatcaggagtgcaacagtgatgtagtccacagcaacgttataggatttaaacacttcccccaagtaaatgaatgacaaaaagaacagcaacaatagagatgatataataagccatgcatggatgaccttatacacctgtatttatacagaaccaccaggaggatagtcatgacaacaatgacactgatca

SEQ ID NO: 545676 - DNA, 208 bp, Homo sapiens
ccccccccaggggggcccccccccccgggggggcccccccccccggggggggggggcccccccccccggggggggggggggggggggggggcccccccccggcccccccccccccccgggggggccattttttgggggggggcggggggggtttttaaaaattttgggggggggtttttgaatttcccccccccccggggggggggga

SEQ ID NO: 545677 - DNA, 330 bp, Homo sapiens
tttttggggcccttttcccccttttttaccccccccctttcccccccccccgggggggggggggggtctttcccttttttggtttttcccccgggtttttttcgggggcgcccccccccctttttttttttaaacttttaagggggccccctttttttttttttttttgggggaacaagggaccttggccccccttttggggcttttccccacgggggtttttttttttaaattttttttttggggggggggggggggccgggggttccccggggggcggggttttttgcccccccgggcccccttttttgccccccctttttcccccca

SEQ ID NO: 545678 - DNA, 643 bp, Homo sapiens
ggacgcgtgggtcgacccacgcgtcggaatcgctcaggaaagacacatctgcagattccagccggctaccctgcaaatagatggattccgactacacaagggagaaaacgcggaggtgacactctcctgcctggaaagaggacgaacgaccaaacaaacgcaaggactggactccatgccggaaggtatctggaagtcgtgacacgagcatctgcagctagccatattgaatgttgaagtgctggatattaaatgacaattctccccagattttcaagatctctcataccgtatgagatatctgagcagtgcagcagttgggacctcgccattcccctggacagatgcatagagagaccagatgatggggaaaattcccttccacacataactcgcatctctgccaatgatttatcacaactatcgaggttcggacccaggactgatgcagcccaagtatgcagaactcatagtggacagagagttagatcgggaagctgaacgtcaagctaccgcagcttcagcatcactgcctcacaacatggagagtacctcaaaggtctggctcatccatacctaaacaataaagcatccagactccaattgacaacagccctgcgttagagcacgccacactaatata

SEQ ID NO: 545679 - DNA, 376 bp, Homo sapiens
tttcatgggggatcaacccttccgcgtcgagttggagaaaagaataactactgaatgaggcagggtgaaagaacgtctcgagacagcgccttgctctattgcccatactggagcgcagtggcatgatctcgactcagtgcaaccttcgcctcccgggttcaagtgattctcatgcctcagcctcccttgtaggtcagattacgggcgtgtgccaccatgcctggtatatttttgtatttttgatagagacggggttttgccatgttggccagctggtctcaaactcctggccaccttggatccgcccaccttggcctcccaaagtgctggggttacaggcatgagccaccatgaccagccaaggcaggttactttt

SEQ ID NO: 545680 - DNA, 946 bp, Homo sapiens
  misc_feature (359)..(359): n is a, c, g, or t
  misc_feature (368)..(368): n is a, c, g, or t
  misc_feature (395)..(395): n is a, c, g, or t
  misc_feature (492)..(492): n is a, c, g, or t
accctacgaagagagtattccttagtgccctgtctggcaacttctggacagaccaggaggccttggggcttagagcacttcttcagcctcagctgcaaatccattttttcttgtcccttgttcccaggatgaagccacagtgtttcatcaggtacatttatcaggaatctctgtttctgtttatataacaatttaacttaagcctcaaccttcacagtgtacgcatcacatttccatggaaggattgcaggtattagaagatggtggatcatgtcttaaccacaggggaaatgtttcaggatgtttttatagaaactttcactaacaagcaggacacaggattgcagagagtggggtangaggcagtnaagggtgcattgttgttttccctcttntaaatgaagttataatgacatctgtgtttcaagagtgtggcaagtttggactgagcttgaaataaatacagtttaattggtttcaaataactgaacnaaatgaccattccatgccctgtgtaataaaatgttatagaattaaaacttattagacgttaaaatccatgaaggatattttgctggatgcccatccttcagcattctgatgaggatcttcgtgtatttgttcaatgaataagtgaatcagcagctaaatcctgacctttgatttcctcagttctctcctgcaattgtcactgatgctctcatctccagtccttgggcaaggcaggagttgaattagtatccccttatagtgggaggggtctagaaatagctgtgccactttagaagctaggctttgtgggcttttccgggggatggaatgatttcattttcctgctttctactccacataccaccaagatcagaattctgccctaaacactaatgtgtgggagcctgatgtcctgcctaagtcttgtcaaccatatcccaggtgactgacctcg

SEQ ID NO: 545681 - DNA, 95 bp, Homo sapiens
  misc_feature (23)..(23): n is a, c, g, or t
  misc_feature (28)..(28): n is a, c, g, or t
  misc_feature (57)..(57): n is a, c, g, or t
  misc_feature (85)..(85): n is a, c, g, or t
tgggaggctttatttccgggcgnaaggntctttgacccaagcgacaaaggtttaaanggtgcttggctttggccaattccttggnggttaaaaac

SEQ ID NO: 545682 - DNA, 823 bp, Homo sapiens
  misc_feature (1)..(1): n is a, c, g, or t
  misc_feature (5)..(6): n is a, c, g, or t
  misc_feature (10)..(11): n is a, c, g, or t
  misc_feature (124)..(124): n is a, c, g, or t
  misc_feature (780)..(780): n is a, c, g, or t
ngggnnaacnncgacggccgccccgcccggccgcgggggagaccacgggcccacaaggagaagggggacccagcgcgcgcccggaggggccgggaaacgacaaaagacccggcagggaggcgcnaacgcgcacccgcaaagggttttggggggacccacagactagcgcacagccgtcttgttttcaatgaggcacgccaacagctgtgtatctcgtcgagttgacctgtgttggccggctcgtttaccgcatcatgttatatagaaattgagctcttctgaaacggccaacagcttatgttgagtgatcccatttctgtcggtacgccccactttgaagacaattttgatatttttctgtgggcctgacagctcctatcggagtgggctctctttggttctcacacttactaagtgttggcgccgttctcataaccgcagatctatgactgttttaagcgcttaagtatcccatacattaaactcccctcccaacacaaaaaggaaagattatggtcgccttcaacatatatcatagtcctcgatatttacgcaatactaaatcccctaacaaggcccttcttccttgtgttttcaaaacttcggtgcctttttctcctatgcgtgcgtaagagagtctgcgaactctcctctatccatatacttatgtgcgccttttttgttctctatttcattatctttatataatgccggacttcgtatttctccttcttccatatctctaagagcggacacattaccataattttccttttgtanttacttgcttctggtctgatctatgcaccacacgaagtataat

SEQ ID NO: 545683 - DNA, 1450 bp, Homo sapiens
cccttgaacttctgatctatgtctacttacatttagctgagcaggcttactttcatgcactttactcatagcacatttcttgtgttaaccatcccttatagagcgtgacttgtataggccccatttcttacaacttcagaaatcttcacatttacccagtgcaattgtcacatgttgtatatctcattgccacacattcatacattaataggtattagcaacagggcattcaggatctatatatccaacacagcggtgcagcaaccagttcatttcaacataataaaccttattcagacatagcacaaatgcatttaacaaagcaaatgtatggtcaatagcacaattgtcccaattatcaacacagtctatttcccattagcattacatatcaagcaagattggtcaacaagtccccatgggaagggtgcatctggattcatcatatgtacagaacaatttcacacccactaggtaacccaagaagcattttaagcgaagacatcctttatacccaagcaaacagaaaccaattgtactatgaaaggcaacataccatatctccacacacacggcactaggcaaaacatttactctagggcacaaactcaaatcctccttaagaacccggattcaaagtaagtatatacccatcttgtaattatttccaacacttggaactttatccgtcattacaaacagcggtcccaacatatatgagaaaagacaaaaataacgccaacaaatttataaacggggttggcataacaagcgcgacatctactatacgacacattaccctgatagggccattatccctggaaaggttgtgctaacagcatccaaaggaagaactaagggaaaaacgaggccacgcaacaactccggcatacatacgggcaagccccaacttaccggggaattaacccatggatccctcaagcacaaactgtggtgcccaaaagaacacgtccaaacattcaggggaacgcacccacttaacacacaagagataaccaacacagtcaattctgaccacgcaaactgtgtatcaacacactacaaacacacactaaaaacaggacacttaatcaaaagatacaaacacgaaaggagtacagaacactcacgattaataaagtacacttctatcactacccagggtagtcaactcaaaaattcttaaacaatgtgcaccatcataaaccagaggacacaatggagaagatgaaacacagacacaaactaaatcaacccgtaccgaacacgatattgagcccaaacttattcaaaattattataggaacaccagagtatcttctttgaccttagacgtatacattgactatagcacatatattgatctacagtctaacaataagagacatgaataccaactataagaaagtaactcaacctccaacacattacactgataacacaaaacagt

SEQ ID NO: 545684 - DNA, 295 bp, Homo sapiens
tcgtcgagctcggtccggctgccccgcaagacgggagcggacactgcattacctaccagtgtgatctcctgtctgtgctacgaggcgctacaggttcggtgattcactgagtgatatgtgtgggttttggtgtgtgttcgtcaggtcctgcacctcctggctcccaggtgcgctgtgctgacgccgagggacttttcttgtgcttttgccctgcaggatttagtggccggtgaggagggtactaaccgcatatatgttgaccaatgccgtgaggccggacgtcttgcgggggctg

SEQ ID NO: 545685 - DNA, 1408 bp, Homo sapiens
ggcatcctgggtcctaggatccaggtaccgcggcttgaacctgcatctgaccggaagctgcgtcctgtcgccggttctgccggctccactgagccaggacaccgagcgtggcctatgaacggagcgtggacgtcgtgacatgaggttaatgagctgcgaggaaggcacgttcgaatgacacctgctgcagctactgggcgtcgtgcccattgttgccgtggccgggatggccgagcaattaagtggtactgggtgataggactctagaaggtgggcctggacaggagcgagggcctgtgagtgctggcacgccctgaggggccttacatgattcacaggcgacccttgtcccaccatgggtaggggaagacttgcgtggacatgggttgagccatgtgccacgatgctcgcagtgctatgttcgctttcttgccaagctcccgacgtcgcgcggcacatggccttgccatgtgtcctctccttgggacttccggtgcttcgagctttctagacgttatgtggccttgtgagcgtaaggcgtacgaccacgtctatgggatcactacaaatatcgggtaagcgagatggcttgcacggagcccgatttggttccaggcttggattgccataatccatgtgctttgctaggcacaaagatagggtgtgggccagcgacaagcgggggctgcctccgttccgttaaaccccgggcgaattctgggcctagagaatccgttatacaatagaagccccattattcccccaggggcgttcctaacctgtcggactcgcctggtggaggcgaaaacccttaaggaggcaggagaatcctctttgacatatgtgcgagccagtttctgactaggagtttagacccttaagagaggacttccttactttaggaaacatgtgtttccgaaacagggtgggtccccgataattgggtttggccctgtagggaggtttcccgcacaagatctgttccatatgcaaaagtcggcaagaaccctcgaggggaaacatggggggaactctcggcagttgggttcccggccgttttccaacggaagtctgtgtggataccctttagtggctcatttggtgccgcatggaatactttccagagaagtggcccccccgctaacacagttcttgtacttgggggttgcttatccccccagcatgttggtcacaacaggcgacaactactgcttgtgggaaaacacaggtggttgacctttccgttacttggcacaacaacattcccggtggcccattcaacatcggctgaccacaaacatgtgcatggtccatatcttaccgcggtgtgctgcatctccagaatttctacccagtgtggtgtaaagcccctatctaaatcgctttcccgctccaaaatgatttaacg

SEQ ID NO: 545686 - DNA, 426 bp, Homo sapiens
cagaggtcagttcgctatccctggagcctgcttcctgcccacttctctctctctctctttttcttttctttttttattggagattggattctcactctgtctcccaggctggagtgcagtgacacgatctcagctcactgcaacctccacctcccaggctcaagcaattctcctgcctcagcctcccgagtagctgggatcacatgttgtgcaccaccacacctgactaatttctataccttcagtagagacggcctttcaccatgttggccgggctggtctcgaactcccgacctcaaatgatccacctgcctcggcctctcaaagtgctgggatcacaggcgtgagccaccacgtagtcctctttctgcctcttttatgagtcaccattctaaatgtaattgggaaagtagggaagcctgaccg

SEQ ID NO: 545687 - DNA, 125 bp, Homo sapiens
gatgtctacaacaaaggatatggctttggcatggtcaagatagacctgaacaccaagtcttgtagtggagtggaattttctacttctggtcatgctgtacactgatacagggaaagcagtcaggc

SEQ ID NO: 545688 - DNA, 284 bp, Homo sapiens
gaacagggtaagcagacggtactatcacacgtactgaaaaacagtacctcatcaacacctaccagatactggaaaagccgactcactaaacaacgatggcgtaagaggtggtcttcttttgcaaaggcaacagtaatttgtgtggcatcattgtcaacagtgtacaaagcaatatttcgcacccattcaagtttacattatcaccaattgcttcattttttcattcaaacatagttgtatcatccaatcattcaccctattgccactgttgttcaagtaacatc

SEQ ID NO: 545689 - DNA, 271 bp, Homo sapiens
tgatctagaggatcctgctgctgctccctcttcacatgactgcattacagagagcggaagcccacggaacagctgcagaggtaggagccagcgtgttctcgcacttgtggccacacaggcgcccgggagtagcgctggcactcgttgacatcgacacacattctgctgatgccgtccaaaatagtaacccgttttgcattcgcagcggaaactggcgggagaagttccacgcaagggattgtccctttccaaaggggctcaagcagggggg

SEQ ID NO: 545690 - DNA, 241 bp, Homo sapiens
agatcatcctgactcagcctcctgagcagctggtacctcaggtgtgtaccaccacgcctggctaattttttaatttttgtagagacaggtttcgccatgttgcccaggctgctctagaactccggggctcaagtgatctgcctgcctcagcctcccaaatgctgggattacaggtgggagccactgcatctggcttctattctaattaaaactcgttgtcaccaactaaatttatgctcca

SEQ ID NO: 545691 - DNA, 289 bp, Homo sapiens
agaggatcccgttcacttctacactaacaggagggctggggtccctgccaccagttttcacctagccagtgatgtatttactccgtgcactagagattctcatacattgtaccaagttcagagcattgaaatatcattgctgtcgatctttcggtgcaagagaactgctctattgttgatgaatcccgtttttgcacacgtcggtagcatcatgatcgattgggctacggtgaaaactgggtggcagggaccccgagccctccatgttagtgtagacaattgaacgggt

SEQ ID NO: 545692 - DNA, 126 bp, Homo sapiens
  misc_feature (89)..(89): n is a, c, g, or t
aatttatgcaataagacctattctacgttctctgggctggccaaacacaagcagctgcactgtgatgaccagtctgggaaatcggtcanctgcaagttctgtgacaaggaatatgtgagcctgggt

SEQ ID NO: 545693 - DNA, 112 bp, Homo sapiens
aggaagtaacataagttgagttggggtggagttgggatcatcagaaggctgacatggaaccgcgtggagtgggcaatcatagcagtgtgaggtgggcaaggggagcaagggt

SEQ ID NO: 545694 - DNA, 1351 bp, Homo sapiens
gcttcgccgcttggctccgtctgttgggtggtgcgacacacgccgctgtgtcctcgctcgtggtgagcagcaggccactcagtgctggtcctggggcgtggcgcgctgtcacgccgggcaccgttgctcccagccctgctgagctgaaagataagaccctctgcctaccacgcagcgcacatggctgctcccatccctccatcctccctccagccctgccgcaaccctcacgtcgcccaccatcacacgacacctcgcactcatggtcacccaagctggatacatcacgacaccctttgcccccaccccaacgcgcacacgcccctacccccaacctcacccccaagagcgccaccctgcccgcaccaatgctcccccacgcatcggcctcctgaccaaccatatccaacctagccgcaaatccgccgccccaccccccaaacacacaccccggccactcccaccgccacaaacaccaaccgcaccaaaacccccgactcaccccacccccgcccccgcacccgcacccccccccctcacacccgccagccccccacccaacacacgcccccccacaccacccgaaccgaacgatccgcccgcgccacccgcccccccatcggcgcccaaccccgccccgcgaccatcccaccgccccctcctacactccgctcgcaccccctgcccatcgcctccgcccccccacctaagcgtccgccaccacccccctatccaacgccccaccagcgcacgccccccacacaccaccgccccaaacaatagaccaaccccaaacagaacctcccaccgcgcaccaccgccacgccacaacacgctaccaaccaccataaccgctcccctcgcacacccccccagccaccacacacacacccgcccacccaacaaacccacccaacgacacacaaacaccgacacgaacaacccaccacaacaacaccctaaccgacaagaccactggccaaccacacagaaaacggatcaactggcacttaccaaagacacccacacagtcggagccaacacagaccccacgcaaaccagacccacacacaacaaccgaacccaccacaaccactccgccccacccaggcaccgagcacaccaccgcccacaccaccgcggtgctcaccacaacacagaaacgcaagcacacagggacaacaccgacggcaaacaacacgccgcgcgccagatcacgcacagacagacaccaacacgcatccacgcgactcacagagcccaccagcagactcgcgcgctaaccacacacacacgaccggaacagcacccaacaatcagcagccaccacacagaaggatacacccgacag

SEQ ID NO: 545695 - DNA, 748 bp, Homo sapiens
atgcaaagagagttgccgcgtgtggagcggctctccatgaccagtctgaactggtagacaagctaaagaaatgtaacatgaatacacagttgccaacactgcgtgcagctgaatgtgtgctggttcacatgactccagagcaggccgcaaacctccagaagtgggcagccaacacttcagggagagccatgcacataaactacgaacaggtgaacatggttgatcggttagagcatatgatgatcgaaaacttagaaggacgccagtaagacctcgtggcagagatgacctgcaagctattagagtcacacctagaacgcttcctgacaaatgggcgggatacatgataggccgaaaacatgatggaccattacaacaggatacctcgagctgaactgagcacgatttaatgacttggctgggcaccaaaggacggaatgagcttggcctgactgagataacctattaatcggactaaagcttataacgagccagaacgcgtaccactgggtctgccggaggagaactgcatgctctttagcagtgcgtaggcctcgtggggacgtatacaccacactcttgagttacagtgggccctcagcgaggcccaaggtcctatttcgttgacgttgcaaagacatgggtaaataaaccaatctccccccttcaggcaatgcacagttagggtacattcagggaactcccgccctcccctttttgcccctccacgccgttctgaacttaatta

SEQ ID NO: 545696 - DNA, 204 bp, Homo sapiens
cgatgagccggtccgttatcgtccaacacatgcttctatgctcacgcagaaagggaaaaaacaggcacaagtggagtacggcaattaagtgtttattaatacatacattaataacatgcagtaacatgcatcacttctcacatttcattaatcaatgaagtgattaatttcatgaccatgtcttgacttaaaggtgttggggaa

SEQ ID NO: 545697 - DNA, 262 bp, Homo sapiens
atacatctatactaaggtaagcgcgacaatttccttctttggtggtactcccataaaaacacattccctttagttgaactttgttatagcaatcagactaagtatccttgctctcacttatcatctcttcatcacctaataccttttttaaattgttctccctataaatcgtccctcttggggtttctgaatttgaacctcaactgcctttttaatattctgattatccaatgtggtcgcctggttacatctgctccttggt

SEQ ID NO: 545698 - DNA, 641 bp, Homo sapiens
  misc_feature (146)..(146): n is a, c, g, or t
tctttgagatgtggaccgtcgtaaatcccatgggactactcgtagaggagctgaagaagagaaacatctcagctcctgagtctcgactcaccaggcagtctggaagcacaactgctcatgccatttatattttgttggcttatacntgtgacagaaagcatgattgcagagggacctggggaaactgtactcgttgcagaggaagaagctgcgcccgtggccctcaggaagctgtacggattcacagagaacaggcggccctgggactactccaagcccaaagagagcccaaagagagcagagcaaaccagcgttgccagctaggcagcaaggggtgacatcatcactactgagcaaagcagtgagacagggccagaggggaagagcgcagaatatgggagcagtgtctcagtgctcttcctgggccctagaactagacaagtgcttttcaggtgacatcaggtgacagggatttgtttcactttttttttctgtttctcttacacactggtttattactgtgtataatttgtacagctagatgtattttattccctccagctttgaagtgtagtcaaatacatgccatatgtgaagttcgttgtaatatgaataaaaagctattctttgaaaaaaaaaaa

SEQ ID NO: 545699 - DNA, 1181 bp, Homo sapiens
aaaaaaatttataaggtccaggaatcaaagatgacttgataggaattatgaatacatgcagaatgtggagtggttagaaagtgaaatcaatcgtattataggtccagcctagagggttgctgatagccaagtcacgtagcaacacaagtcagagtaggtagttatgtcctaagcaagaccagggataagatctgccaagtggtggcatgagtttcaatggaacccagatacagattaattggtgatcgccagatagtccaccctatatacccatatctacagatcagatggacatttatctaggctccatggaggtccacaattgggaacacagcatagctcagaaaagtggagggatcatatctacggaggatacatccattatcccaggtacaggaacctcgttcgaggaccccaacaaggtgagatcagtcaaagtctacatcagctatatacacttatgtggaaacggtctataaagttcctcgaaattcatatttcacttaaagcgccgtagattcatgagaatcaccgagataatcatccgtaggctgtgatttcaaatatagggtgtgagcacgggagccattgggcatggctgggagattcaccagagaaagggacacaccaggttctatactaaaaacacttacgtggtttcccaggacagaagtctaccctgataagatcttcggattcggaggcaaacttgacttctatgtgtctagctcagcgacatgagtcagatacgactattttgctccattaagacaacagggctatacaacacagaatcacattgggaaattccagaattagagcgccaaatgactccgaaaattgccataatcattggcacaaatgggctgaattggttcctggatggtacaagaagagcaagtggcaagaggaagagaacaggcaccatggaaccaaggcaaaaacgagaatggggccaaaagcttacgtgaaaacaacagagggggactgtacacagagcgaaaagaaaagacacaaacagaggcacgggcagaccaacaggaaagacgggagaacaccgacagagggacaataagtagacagcaaagagaggagcaaccacacgggaggaagaagattcacacacgcgaagaaccaagaagccgagagcaacaacgagggacacagggacgaaacgaacc

SEQ ID NO: 545700 - DNA, 279 bp, Homo sapiens
  misc_feature (14)..(14): n is a, c, g, or t
  misc_feature (134)..(134): n is a, c, g, or t
  misc_feature (182)..(182): n is a, c, g, or t
agatagttgttttnctgggagagttggatgcagaaaaacgacatagatgaccacagaggtccataatccacaaattataagcaatgggtgtttgtttttatacctttaggtttcctaagaacatttagattttncttaataggttggaaaattcaagtaatgttattactgattacattttncttttcttggaatttcccttaaagataatattgagccttactggaaacctccccaggtctttcgaagccacagtcccctcccactctagtgtaggaa

SEQ ID NO: 545701 - DNA, 398 bp, Homo sapiens
  misc_feature (316)..(316): n is a, c, g, or t
  misc_feature (367)..(367): n is a, c, g, or t
acggtgactcacagctgtaattccagcactttgggaggttgaggcggacagatcacaaggttaagagattgagaccatcctggccaagatggtgaaaccccgtctctactagaaatgcaaaaactagctgggtgtggtggcacgtgtctgtaatcccagctacacaggaggctgaggcaggagaatcacttgaaccaaggagtcagaggttgcagtgaaccgagatcgtgtccctggcactccagcctgggcgaacacagtgagactccatctaaaaaaaaaaattaaatattttttatttcctgtttattgcatntttgaaactttgttctataattttcctatttcaggatgtacataaacattngatgcaagagcacattatatggggggtttta

SEQ ID NO: 545702 - DNA, 923 bp, Homo sapiens
tttgcactacacacttctgttgcacctgaagctcgaattctgtctgatgagctggggtggtctgcagcctccctgagtgctggagaggctggggcctgcctgctgccgtcctggctgcctgctgccccctccctgcgtgccctggctctgtggagctgtgggctgcccctgctgctgcgggcacactggctggccagatgcgcctgaggcggtaccttcagcctgcaatgatgacggaaccctgggagatgcccccgtggagccagctgaagagcttgtgctgcttgctgtccagggctgctgctgcctgccgctgggctgcttgaaactcctcaaagttgagagcctggctagagggtgccgcccgccgggacgccggagggaaacggaagtcgggaggtgcaagagtgaccagacacggacagactggactgctgcatgaccttcggaacggcactgcgtaggcagcctccccggagcccacgaggctccccagcaccgttcactggtgggaggctgagccggtggaaaagacaccgtggaagatgactcagaggcgaccataatgtcgttacgtgtacacactctgcccaccctgcttgtgatccgtcgtcagaccgggctgcagggagctgctgtgtttgctgatgatcacacgtgactgtgtggccctgttgcctctggggtgtgccccaccgtttgcatctgtgccactgacatcgtccgctgcaccaacaaaaacctgtccaaggtgcctggcaaccttgcagactgacttaccgagcactgatctgagctattactcaacttgggctcctggactctgagctggattccagtatcgtctgcacacgctgaacccctactcctcggcctaacaactcaccagcatttcacggccagtttccacacccaattgactg

SEQ ID NO: 545703 - DNA, 910 bp, Homo sapiens
cctaggcatggaacccagcagccccctgggggagtggacagatccagcactgcctctggaaaaccagctggtaccacggggccatcagccgaacagatgccgagaacctgctcaggctgtgcaaagaggccagctacctggtgcgcaacagtgagaccagcaaaaatgacttctctctctccctcaagagcagtcagggcttcatgcacatgaagctgtcccggactaaggaacacaagtatgtgttgggccagaacagcccacccttcagcagcgtccctgaaatcgtgcaccactatgccagccgcaagctgcccattaagggagcggaacacatgtccctgctctaccctgtggccatccggactctgtagatgtgagaccagggcactatgatagacctggacccagtccttgtcacctgcacgggggcagcggttcttaccaaggacatgatgtcagaaacctggcttccccttgtcctaggatctagcaggcgctgaagattccttaatttattataaaggggagggaatcctgggccttggaataaagggaacctgtgtggaaaacaacaaaaacaagataaaaaaagaaaataaaaaaaaaaaaaaaaaaaaacaagagaaaaggagagataggaacaacaacaaagagggggggggggcgcttaaaatttttggggggggaacattggtagacaaggtgttttgtaaagagggcctatatggggatttttaagagagagagcgggggtatataaaacgatgtggggggagaaaatttatgtgtgtgcgagtggagaggacacctatggggggggcgacatggggagtacactaagaaatgcgcggagggaaaataattgggggtgtggggaacgcgttgttggggaagtcggttttatatc

SEQ ID NO: 545704 - DNA, 534 bp, Homo sapiens
  misc_feature (29)..(29): n is a, c, g, or t
ccagcctcttccgtgtatacaatacaccnctagatttatctaatagttagtgatgtgcacaccataaagtatcagtgaagctatctcatgttgtcctacactatcgttttcaaaaaatatctaccatctgccgccataagttgtgcatatatggtgcaaaaacgtcacgttaagtggtatatttctaatcaagtcataagtgcgcaaagcttaccatgtttgtgacagacctctcaagtgtgaatttcagtacagaagccttatatagtttgttgacttagaagatgccgccctgtgcttgaacaataaatgtcacgcagagttcgatgtcgttagattaaaagagagggtcatacaaattaattcttttttacacaacaagggtgttttgcattctgacctcaaagcaaagcccctggttaaaccagtccaaaagggccttaccttggagtacgtctttatttactcgtttttttgtaggccataccctaacgtaagccatttgatgacatgaaaaattctgcaggagctgta

SEQ ID NO: 545705 - DNA, 400 bp, Homo sapiens
cggcgctctaggcgttagcgagtgcgcggtccactgcgtgcggagcctgtggcaactcctatagcgcgccttgtggagacacgcgtcccagacctgtggctcctactggggagagcgctctgcggaagattgctggactcgctgaagagagactacgcacgagagccccagccacccattaaatcagatagagaggattcaccttcttacgctctgtgcggtcagaaaggactcattggctatgcgcaccacgaacccgagtcttttaacggatccttgagaaatgtggctgtagatgagactgagcacgcggggctgtaccgtgacagtggctgatttgcatgccatggactttgagccgagggtcacagacggtattactcggactctctcttcctgg

SEQ ID NO: 545706 - DNA, 200 bp, Homo sapiens
ttgctgcggtcgctctgaggatcccctatcgcgatagcggagcttggcgacagctgccaagcagtttcgcgatgaaatggggcctatgacgttcgcctttgtgcctggattcaaagtggccgtggagcggcagactttcccgatctacggaaccgaaatttgccctgaggcagtgacagcgaaagttttcattatcggtg

SEQ ID NO: 545707 - DNA, 766 bp, Homo sapiens
attttttttttttggaaattataaaaacaaatttaatttaagatctgaaatacaattcctaaaatatcaatttttccagaaaaaccggggcttacacaataagtgcaatggcctctattcagtgttaaaacggtgcatttagcattcaaattacaaaaaccagtgaaacaaattcaccattcctttcaacaattgtgagcaaagatagaagtgccttcagagacacccacccatagacagtggcacttgtgcaagcgaggcattgggcagtggtttacacattccaagccacccaatacacacacacacacacaaacaaaagacagccacaaaaagagcgtgtgggttatacacgagggatattattcacctctctcaagtgtgtgcaccacttagtgtggcaccctttgagtgaaaatatcgagggggcagttctgtgggtcacacatttcaccatatatacaacccacactattttctcagaaacacatatggggtgttaagagggtgtccaaaagagggaataggagacacaccaccccaggacattatcacaccacccacgtgcgagagacgccaaaaaagagcggcaacacaaacaacacggggaacacatcaacagaaaaaagagtctctaacccactccatggggcgaccacaaaaaaacaacagggcaacaacaccaagaggggataaagaccacagcctacggagaacaggccggacgaaccaacgggacggccatccaaccaacgcccacataaat

SEQ ID NO: 545708 - DNA, 757 bp, Homo sapiens
ccctctatctgatgcgatttgttgcttttttgccctcgttgtttgccccggctttctactggcccatctctgctttcatcgattctttttctttggtattatcactttggtgattttttgcgcttttgtgccatcatttttgttaattggtggtcttttatccgggtttgagcctcttctcgagtcttctgcttagtttcttcatgctctgctgtttgtcccggtgaacctcggccggatgcttgcctatctgatctcactggctagtcaactgttactggctttagaacccaatgtgtcgtgtactttatatttcgattctgttgcttcggagtgcgctaccgtctgtggtccctcttcatcagttgttgttatcgattttgctatctctacttgctgcatgtgtagtctcagtatgtgctggtgttcttgagtattttgttatggatctgtgcgatgttgcagtctgtcgttacggcttttcttatagtatttgaatttggattcagcgtaggtcctgtgggcctctgccgctacgtgcactcttcgtaggagtcgtccatgctctcgggctgcgctggggccgagtggctgccctgcgccccactcatttgcatggctcactcacacaccactcaagcaatagggcccacgcaataggaagaccccgcagagagagggtcagcaggggggccaccgcatgcgcctcccctcctatagcaccatggtggggctaggttacggggctagccccatc

SEQ ID NO: 545709 - DNA, 1006 bp, Homo sapiens
gctcctcagcttcagagcagcatcagtgacctgggacagtgaatccgataatgccgccttctgtctcgctggggcatcctcctggctggcagggtctgtgctgcctggtaccgctgtctcccatgtgcatgaggcatccctccagggtagatgcatgccgcgggaagagacaagataccatcccaagctgttgatctaggatctatccgatagccttgctctccaagatcaacctcaccgaaacatgggcgtgagtacagacgttcgatgccatatcccgcaagcgtggcaggcaaatcgagtctcgagcagcaagcacttaattttttcttgctgccccctgtgcagcaatctgctttcgtgtctgttatgcgaatagctcctgccctggggggtacgcacaaggcttcgaccaacatactaggtaaggacaatcctcgcctatgggccgtgcaatggccgaccctccattgtgtacgattccctggaggctccggtatccaatgtaacggtctccccagggaagttcctctcggttagcctcatatccagctctagcatagccgaatcttcctagctcgactctacctggcgaatggcactgttatccttccagcggaaggcgccttgtagacgctatggtggtgaattcatcctgttgtaagagagggaatggtcaaaaggacgtcgtaccgaaagtcagcattgagcacattccagctggtcgagacttgactgtgcggcacagcccgtatgtaggcccgaaagaagctaggatcgactgattgaccgtggaagaaactggtcactccccggcgagaaggtgtgtgggatctgggtccgcttgagcttgaacagctgactcaggttttagcttcttggtcgattttacatcttctcttctagaccggcccatggggactgaaaggatggttaggggtcatggtcttaaggatggcttaaccgtgtttattccccccgaggggtatgccaacaacctgttgct

SEQ ID NO: 545710 - DNA, 289 bp, Homo sapiens
tgcgtggcatcccagtactttgggcggccagtgtgcacggatcccctgagatcaggagatcaagaccagcctgaccaacatggtgaaaccccatctctactaacaatcaagttagccagatgtggtggtgtgcgcctgtggtcccagcaatagaggaggctgaggcaggcgggctgcttgagcccaggaggtcacgcttgcggtgcgctgtgtaacgtgccatgtactccaccctaggtaacagagcgagatcctgtctcaacgaatggggtaaatcctgcaaagaaat

SEQ ID NO: 545711 - DNA, 172 bp, Homo sapiens
ggaagggacattaatccaataaataaggaaggaagctgttgcattactcgggatttaaaagttgatttacatttatattcctcttctgggttccatgttttgtcactcatgtgcacattgcttcgccattgggccttccagtgtattgttctgcagtgttgaaacagatgga

SEQ ID NO: 545712 - DNA, 125 bp, Homo sapiens
cgcatggtagagatgtatttatggcagaggtagatagtctcacgaattcatagtagtacactggcagccgagctgtggtaggcatcctaataaaacgtgtccttataggctccatactacagact

SEQ ID NO: 545713 - DNA, 170 bp, Homo sapiens
tggcttgagctcaggagtttgagaccagcctgagcaacgtggggagacccccgtctacaaaaaatacagacattaaccgggcgtggtaccgtgtgcctggggtcccggctgcccccctctacaaaaaatacagatattagccgggcgtggtgccgttgttcttcgacgaa

SEQ ID NO: 545714 - DNA, 121 bp, Homo sapiens
  misc_feature (1)..(1): n is a, c, g, or t
nctagtgatctgcgctcagttttcaaagtactgggattatataggcatgagcactgagcctggccagaagcgttttcttcaaaggcctcagtgagataaattagatttggcatctcctgtc

SEQ ID NO: 545715 - DNA, 216 bp, Homo sapiens
actaagaggaggacagaggtggaaagagctaaatgtccttgaaaagaccttgaaaacacctgagtgtaccgcccactggagagacatacacatggacccctccacttctttctcctgactggcgaaagacagctgcgaagtgccatgcaaatacaaccaggtcttcgctgcatagctggacagtgtgtcatcagtctgataccatcttctgctcta

SEQ ID NO: 545716 - DNA, 100 bp, Homo sapiens
gcttatatcattcctgagtgcgcggagggctcatgtacccgtatatacctgttatcattgatgtgggcccccctttgcattaacagggtacctgagctca

SEQ ID NO: 545717 - DNA, 242 bp, Homo sapiens
gcgcatggagctgtcagaaaagttaccacagggataactggctcttggcgtactcatagagggaagcgtagagcgtcgctaggggtattttgcttcacagcgatagaaagagccgacatcgaaggatcaaaaagcgacgtcgctatgaacgcttggccgccacgagccagttatccctgtggtaacttttctgacacctccatgcgccacccgaagtgccacgcaatgtgccacccaaagag

SEQ ID NO: 545718 - DNA, 124 bp, Homo sapiens
aacaagctcactgcacaccatgcaggcatggccatgcacgcagccacgtggcagcatcgcacaggcagcaggcagctcaaccacacttcagtggcagtcgctagtatcccacacatccatcaca

SEQ ID NO: 545719 - DNA, 150 bp, Homo sapiens
  misc_feature (48)..(48): n is a, c, g, or t
ttgcgatggcgcggtacaggctgctttactcggaaagggatattgtgnccatcatgcccttcattgcctaactacatggttacatgtccatatgatccaccgtgcaatccatgcacgtaagtgagcggagtaatgagccaaccttcgggg

SEQ ID NO: 545720 - DNA, 189 bp, Homo sapiens
tcgtgcctggcctcaaaaaaatgtttttacaatcctccctctctagttactgtttcttcctgaccccataccagaaagtggaataaatcatacccttttgtattcccattcctttgtgtagttccctttccccggaacacgctttctccctatccttcctctctgccctcccgcaaaacacagcatagt

SEQ ID NO: 545721 - DNA, 785 bp, Homo sapiens
atagtaaagattaagtatataaggggcttgaggtacatataggtctgttcaaaaaatgacagctgtgtattaggttattgacctaactttccttgccaagtaaaagtctaatgccctgccccattagattcactgtacatgtcccgtggcttataaacaggctatctccccctgattaagaagcatgctccttttgagtctctacgataagactgtattttaggagcaggctggaaaaaatctttgaagatgttgcccacaagataactaggaagaaaaacaccagtaaatcagatgtggtgataagtcaaacaagactgggtggcaggctgactctttgctacttttgaagagttttcctcaataaatgaatcaagtaaatagtaacatagggaaatatttagacaaattaaacacatgaattaaagcaaataaagttgatacattattaccacatgcaaaatttctgttgccacaaaaaaaaatctatcatgcattcagaatcttgggattcttaaatgttctttggttctattctatatgtactttcttgggggcccctctttctgatataaagataggaatttgcctaaaaaaataattttagctcaagatgataagcctagggaccttctcacttatatgttggcagacaaagactcccaaatttttggctcccaattcctcttttccatattccaaggcgtggcttcacttcctcctctcaaggaaggagtgggagcacgaatgtcgggtacgagtcaatcgatctgcttgtgtttttt

SEQ ID NO: 545722 - DNA, 549 bp, Homo sapiens
gtcagtgggtacagatgtatgtcacatcgagacagaggttgggcatgaggagtgtctctcgtcacagtttgcctagaaggctatcaaaaagtattgttcttaattgtcagaaccatgttgcaccatgagcacgtctgaaacgggggacggtacaagacaggagtctcccagtatcacctaccctggacagagcagagcactggcgcgagagctgagagcctgagcatgtagcttccttgattgggaggcagaagagatgcccaaaggaggaagcgagaacttggaattgtatctcgcatggccctggattcttaggaaaatcatggcttcccaactggatgggcagcagggacttggggtgaagtaaatggtagactacccagccccgagtgacacagaacaagaacatgaatgtagtttaaacttttttcctactccaggagccattgggattccaatagggaggaggctggaggagtctcagttactagttccttctatttcccccaattcaccagtctagctgcttgcctagaaagtattttcctc

SEQ ID NO: 545723 - DNA, 103 bp, Homo sapiens
gcagtctatggggaaataagcaacagccgtcctcattcccctcccagcttcctttcccagtcagcagtgtggaggggagaaactcacgccttgcctcctactg

SEQ ID NO: 545724 - DNA, 882 bp, Homo sapiens
  misc_feature (221)..(221): n is a, c, g, or t
  misc_feature (228)..(228): n is a, c, g, or t
  misc_feature (252)..(252): n is a, c, g, or t
  misc_feature (257)..(258): n is a, c, g, or t
  misc_feature (292)..(292): n is a, c, g, or t
  misc_feature (296)..(296): n is a, c, g, or t
  misc_feature (301)..(301): n is a, c, g, or t
  misc_feature (309)..(309): n is a, c, g, or t
  misc_feature (311)..(312): n is a, c, g, or t
  misc_feature (353)..(353): n is a, c, g, or t
  misc_feature (369)..(369): n is a, c, g, or t
  misc_feature (378)..(378): n is a, c, g, or t
  misc_feature (390)..(390): n is a, c, g, or t
  misc_feature (395)..(395): n is a, c, g, or t
  misc_feature (429)..(429): n is a, c, g, or t
  misc_feature (435)..(436): n is a, c, g, or t
  misc_feature (441)..(441): n is a, c, g, or t
  misc_feature (451)..(452): n is a, c, g, or t
  misc_feature (460)..(460): n is a, c, g, or t
  misc_feature (475)..(475): n is a, c, g, or t
  misc_feature (490)..(490): n is a, c, g, or t
  misc_feature (494)..(494): n is a, c, g, or t
ggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttnggttttncattttcataccaggcttaattgntcaanngactttttaattttggaagtactctgacacttcnaccntctantttattananntgggagggcaaatttttggtccaaaaacttacagacaagtncttggagagatttccnattatattnttagacttatangatantttttcccatactcagaatgaaaaccgggattanacgttnnggttngggggttttnnggtacaantttagctaatagctncaggctgagagattngtancatagcttgacaatttttggtgttgcacttgaaaggaatcacaccatttattccttagaagtatttcctgtgttgttctacccctttggacgacgggttgggactcccatttctcatccgagaatttatttacccttccggggctgtacagtcatctttaatcctattcctcttggctgttggtagtaagagccctttgggattgaacctttgctctctgcttgatttcaaacctgtggaaccccagatctgtaagtctcctgtggaatgcgttggctaatggtacgctaaatacccgctttttgttgtaaattgccccaattctgaggcctttatgtactacactggggccaatcgggtgggtaattttatccctgaccctctgtcg

SEQ ID NO: 545725 - DNA, 245 bp, Homo sapiens
ctgagcgggtgggagcgagggaagtggggggggattgagggggagaagaggggagaggggaggggagggaaaggggagagggggagacagggggggggaggagggcgggggggggggaggggagagaggggagaggagggcgagggagaggggaggggaggggagagaggaaggggagagggggaagagcaggaaggggaggaggggggggggaggagggggcgaggcgaggagggagggggagg

SEQ ID NO: 545726 - DNA, 344 bp, Homo sapiens
gtccccttgttgggagagctccgtgcgctaaattgtcagccagtaccagatcatcgatcctctcataccaagagaatctgaccgatgctccatctagtacaaagggccgctcgtagaagagcaagcagttggaatgctgattcatgagttagaatgtgttcccactgaagcttgcgcataccaaggatgagagttcaagacgatggaggatcagatcagaactacgacatcgtcaccattggggcgccagcagcacactgccaaggttttaagtcaggaggtctccggaaaaagctgcacaaatttgaagagaccaagaaacatacatcatctggctgccagtc

SEQ ID NO: 545727 - DNA, 212 bp, Homo sapiens
aaaaaaatttagtatattcatgtcgaggatcaaaggattgtattattaaataagcaccaccgaaaccgctgtaaatactgcaggttacagagatgtattgcgtttggaatgaggcaggactctgtccaatgtgaaagaaacccacttgaggtatcacgaggaaatctccacctgcccgcttcacaggaaagtcttatccagggccttcgtgg

SEQ ID NO: 545728 - DNA, 981 bp, Homo sapiens
  misc_feature (361)..(361): n is a, c, g, or t
  misc_feature (478)..(478): n is a, c, g, or t
cgcaggctcccaaaatggcgagtgaggctgcggggactcgctgagcagcgtagaaggagcgtacaaacgagtaggagctgctacacaggaccaatagcccaagtagagctaaccattgaaaaacagacatcagaacgcaaacgcatggagcggagagccgtgtataaagatactgcatttatacaccattcaacagtggcctgaatacaggctactgtagaaatatatgctatgatcgagacgggggagcgcgtacgagtccgagctccaaggtggactgcacgagagcaagctgtcgttgaaggacgaaataaaaccaaatgatgaacatacctaagcgataacgcccgcgcaaaggaantctaaaacggcaccataatctaccgaaggaagaaagaagagacaataaagaagataagacagtagattaatacagtactaaaatgataactataatcaatcaaaaagctctatatancatagaaacgtcaacataagacgataatcatataaaagaaccgatcataactaaagccacaacaagaaagcacatgcaataacccgcactggaagaaagatgaggcctgggaaattaacatacgacattcaagcgattcagatgaagagcgaaaagaatcattaattatctagcaatgaataatctataatgaggagaccgatagattgccgaaaattctgaagaaaatctatgatacaaccgaaataaactaagatgaagataagcaggagagcaataactatgatagacttaaaaaagatacaaaagatcgctatacatgaaaggatcgaataattaatgaaatattaaaataagctattccaaagaataaaacaaggggccaaggccatgcaaaaatgacaataaggaacagaggaactgaaagctgttaagaaggatgggaaatgattatggacaggtggtaatataaataattttaagggaacatgaaagaagagtca

SEQ ID NO: 545729 - DNA, 259 bp, Homo sapiens
  misc_feature (8)..(8): n is a, c, g, or t
gggctgantctagaggttccctctgatcgctctgcgttcttcttcatcatcatcatcctcatcatcgtcgtcatcatcatcttctgtgtttgctgaagtgatttcactttgtacctacactatatacaacggtatcttgattaaggtccaggaatcacatctggatttatccactagagaaaaacttgtgttctttgatgctcccccatgattgagcgatccagagaaagggtaccgcagctcgaaatttggtgaatca

SEQ ID NO: 545730 - DNA, 1132 bp, Homo sapiens
ggacaaggtaatccacgcaagatgaagcccaacatcatctttgtactttcccatgctcctcatcttggagaagcaagcagctgtgatgggacaaaacggtggatcactaaggccgattaccacagtgaattatcccaattatccacacggacaacagggccagccactattctggacaaaaaggcaagcaacaaactgacatccaaaggcagaacaactattcaatacacatatcatgtagatgccaatgatcatgaccaggacccgaaacagtcagacaatcatgatttgaatgacctacataagacgacaaaatcacaaacagacatctaggtggaagatcaacaactgctcaataatccacacagacagtcagagaccatgataacatcataagggtacatttgcaaagggtaaagtaataacaccataacaggaggcaatacgctcactcgtgagcacaacaaacatcctatctcacacgatccaacgggacactaagcccaactggacacacggaaatctaccatgtccactctcccacacacacgcaaacgaacaccgcctagaagtacattggacttaagtcaaagacaaaatctaacgccctacaggagacaacaaaacagggatgacaaacacagcggaatcacaaagacaacaacgatacacacaaacgaaaagaagcaccacacaacgaaaacaaaaacagcagacacaacacactacccagcacgacccacagagcccaaacacaaatatgtatcacgcacacagagcacgatgccaaccagacacaagagcaaacagacgtgcggaccacgcacaaacaccacagaaacaacagaaaagaaaaaaaaaagacactgaacaacaagaacaccggccagaacccacaacacacacagtcggcaaacgaacatcacaagccgaacgccgacgacaaccagagagagaatggagagacaacacgaagagagtcgagaaaagacaatagctcgtgaagcacaagcggccaggacgacaccgacgaaaagcagaagcgccgacctcaacgagacgaagcacgacaaaaactagctcagcccagacgaaaaagagaggagcgcggacgacggagccagagaggaac

SEQ ID NO: 545731 - DNA, 695 bp, Homo sapiens
ggtttcaccatgttggccaggaaggtctcgatcccttgacctcgtgatctgcccgcctcgggctcccaaaatgctgggattgcaggtgtgagccaccgtgcccggcaaaaaaaagaaaaagttttttttgtttttttttttttttggaaacggagttcttcgctcgtgtgtgccttaggcgtggagttgcaggtggcgcgaatctgggcttcacgtgcaaccttcgtgcctacgtgggtttcacaccaattctcttgcctcagccttcccaagtggtgcgtgggatataccggcgttgagccaccgttgccgtggccaataaagaaaagagttttataagttgccgaggcattggtacgcatgtgctctcttagtcccacgtatactacagagaggctagagcgcaagaaggactcgctgtgagcccaaggacgtcataggagttgccaagtgacgcacgttgatcaagcaccactttacacttccagcctgtgggtgaccagatgtgagacccttggtctcttaaagaaagtaagactaaattaacatagacaatatcgagacaccgagggaagatcccagtgttgtgctgtgtattaggtcccataggtttccatcatcgggccgtgttacccaccctccgtccaggagcacatccagaaacactttattcggccataatccgtacccagtct

SEQ ID NO: 545732 - DNA, 236 bp, Homo sapiens
tcagtcacgcgagcatctcagctcatccagcatcctcagctcactcgagcatcctgcagatacaacgagcatcctcagctcagcccagcatcctcaggtcaggccagcatcctcaggtcacaccagcatcctcagatcaacccagcatcctcagatcaacccagcatcctcagctcattccagcagcctcaggtcactccagcatcctcagctcactccaacatcctcagctcacc

SEQ ID NO: 545733 - DNA, 113 bp, Homo sapiens
tcagctcggtaccatccaacgccgcgtgactgcatcaacgccgcgtgagcatccaacgccgcgtgactgcatccaacgccgcgcctttccaacttgcggctgttggatgcagt

SEQ ID NO: 545734 - DNA, 168 bp, Homo sapiens
ggagctccaacgccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccct

SEQ ID NO: 545735 - DNA, 1074 bp, Homo sapiens
  misc_feature (60)..(60): n is a, c, g, or t
  misc_feature (387)..(387): n is a, c, g, or t
cttagagctaacttgggccaggccctgaatctgcgctgtggctgtccctgaacgtgctgnagccctcctgtccctttccccccaagtcagtattaccctgtgaagccccttccctcctttattattcaggagggctgggggggctcccctggttctgagcatcatcctttcccctcccctctcttccctcccctctgcactttgtttacttgttttgcacagacgtggcctgggccttctcagcagccgccttctagttggggctagtcgctgatctgccgtcccgcccagcctgtgtggaaaggagcccacgggcactaggggagccgaattctacaaatccgctggggcggccggggcgggagagaaaggtggtgctgcagttgngtcctggggggccattcgattcgcctcagttgctgctgtaataaaagtctactttttgctaaaaaaaaaaaaaaaaaaaaaaaaaaaaaactttgtgtgcggcgcgcgcgcccggggccctcggaaaacagtttttaaagacacacaatcgggtgtgggcgcggcgcgggggcccaagggggtaagtgggaacctgtgggccaaacacgggtggttcccaagaggagaaacccgggggccagagcgaacaaagaggggcggggggattctcccacaccaaatataacaaagaccgccgcgggggggccaacccgagaagcgcggtctggggagacacaaaaatctccacagagagggggagtcctagagagaggggcgtcctataaagagggggggggaccctaactatcaaacacggggagagagtcccaaaaggggggagagctcgcggaaaactctcacaatataaaagacgcccgatgatctcgggtggtcgtaaaacaacgcgtagaagaaagaagggagaagagaaagagaaataaagcaaaacaaaaaaaaagaaaagaaacgaacaaaataaaccaagaagaagaggaacaaagcaaaaacaaagccaaaaaggtagactgaagagagccgggaaacacaaagagggagagcaagcaaaagacagaaaaaaaaaagagg

SEQ ID NO: 545736 - DNA, 923 bp, Homo sapiens
  misc_feature (923)..(923): n is a, c, g, or t
ggacgggagtggcggccgcgcggaggatggccaagatggcgtgcagctgcggacttcgcttcgcgtgggtagtgtttgggccctgcggtggcgcggggctcccgggctgcgcgtgcccggggtctgctgtgcagcgcgcggcccggggcagttccccgctacggacaacctcaggccagtggcctgtgtcgtcgaaggtctgggccctttcccggacggccggacagtggattgctggttcagcgcctggggccattgcctggggcggcaggggggttgcggggcttgggccgtgggctctggcctttcgggatggtcgagtggcccaagtggaccttggaaagctgggaacccagcgcacaaggctaattccggtggggtacttcaccggttggcactaccctactacttccctttgggcacccaacaccaaggaatcccagagaagagggtataccaagtgtaattacataaaatggcaaggggtggttagcagcccatcacgtggaccaaacaggacactgggaaccttaccggttggagaccataacccgggcaaaaccatagggatgagggccagttgtctgccatacccacctgggaaagtgcactggcaagggcctaacaggggcacgctcgggagacctggccctgagaaacaagatggggacggaggattccacaaagagaacagggggacaccaccagagtcggaaaacgactcggcgagcggacggaatgggcgaccaacttggccggaggcccaaagggggagaacagcacgtggatcgacgcgacccatagcttgtacacaccaagaaaggcgccagataccccccaaagacaaagctggaggggggataggcaaccggaggggcttgggcccaaaacaaaccagagaaagccatttgggccgccgcctn

SEQ ID NO: 545737 - DNA, 129 bp, Homo sapiens
ggacgaggacgtggtggttggtttcgtcaagtgtgttggacctcctggggagagtggggagctgctgtggcggctgctgaagggctgcgacgcggtggggaggtaggcaaggcggtccatggcggtggc

SEQ ID NO: 545738 - DNA, 1190 bp, Homo sapiens
  misc_feature (816)..(816): n is a, c, g, or t
  misc_feature (961)..(961): n is a, c, g, or t
ctccccctccgccgtgcggtggtgtattattaccacggccttccgttttttggtgggacccggttccacgactcgccgcttgggggtgccccccaattccccacgccggggggtgttgggccgcccccccacttatgggagggactccccccggggacccggatttccgcgccttctccgggactttcttattgcctttatgggccccccccgggccccggagtttaccacactgtgttcacccaccacggggggaaccacgtcttatttgagcccaccctttatgggccccctacattttttaggggttcagccaccccctaattaatggcaccacaagttttttgtctacccccaaaaaatcccacgggccctgggttatccccggttccccgggagaatttctccccggggaatatttctcgtctcgaccccccccaccgcgcggtctccgcgccttgttctccgggagggggcgccccttagtctttttatttggttggttgctctccccggttttcaactctcacttggggagagagatttgggggcgccccccacaaggggctttgccagagagagtctttgttgggtgttttctctggggagataaacctctcccgagagggacacacagagagggtcgtataaatctcgcactcgagaagttttttttgtgaatgtgccccctcgagtggagttccccccccgccgcggaggagccccctcgctttataactattctatccgcttgagacacctcggctctgtgggcccccacccgctcttttgtgctccacgcacacccgcggtgtntgttcttcgggcgcactcaccaagagtgtagaagagtttcactcgtctgtggccctcggggagacccacacactcggtgaaagagttgggcccgctcataagagaagcgcccctcgcgctcgagaccaccggtggagagcacttnttgtgagacacccacacacagagttgaggagtatctgcccacccaccccccacttctcacgaacacgaaagggtgtggaaagccacgagagccccctgtccacatgccccacagccacgtccccaccaacgcactatacaccgggtttcccttggcacagctgtatatttctggaggttctggaatgttgctcttcttaagacccttttatcaaaattttgtaccaaga

SEQ ID NO: 545739 - DNA, 404 bp, Homo sapiens
acctctgtctgtgagaataggattgcccactcttctaacagaacatcttcctagagcttaccctagccagcagcggggagctgcagtacagttacaacccagctcgggcgtcaccgtcactgaggtacgccaggatgtctactgctttatcctctatgaacatggcgggctctgagctgctgtcgctgctgtggctcagagggtcagtgggacggctagaggggaggacgtggattcccagggagttgctcgctcgcattaaaatagtcaccattgcctctactggaagcttctcacgaacaatcactcgacagcggatcagaagagccgcgttgacctggcaaggaagggttttcagtggttgccccaatcagagtgatcgtcccacattccacgtgagggtg

SEQ ID NO: 545740 - DNA, 646 bp, Homo sapiens
  misc_feature (68)..(68): n is a, c, g, or t
  misc_feature (105)..(105): n is a, c, g, or t
  misc_feature (186)..(186): n is a, c, g, or t
gagttccgccatggcctccttggaagtcagtcgtagtcctcgcaggtctcggccgggagctggatagntgcgcagtccacgacagaacaaatattcggtgctttnaacctacctacaacgagcgcgagaacctgccgctcatcgtgtggctgcttggtgaaaagcttctccgagagtggcaatcancttatgacaattataatcatagatgatggaagcccagatggaaacaacgggatgttgctgaaacaggttggacgaagatctatgggtcagacagaattcttgctaagaccacgaagagacaacaggttggggactaggacaccttgctattatattcactggaattggaacacattgccacaggaaaatttactattcatcattcatggctgctgatctctcacaccaatccaaaatttattccctgacttttacttcacggaaagcacaacaggagcgcgtcaatttggactatttggtcttctgggaaaacttcgtttaccacaagggacatcggcgacggtgtatattggctggggtattttgacaacagaaccattaatcaggccgtgtgggcccacattttttaacctcaagattcttgttgagaccaggagccatcttgttttaaccacggaat

SEQ ID NO: 545741 - DNA, 894 bp, Homo sapiens
  misc_feature (68)..(68): n is a, c, g, or t
  misc_feature (105)..(105): n is a, c, g, or t
  misc_feature (186)..(186): n is a, c, g, or t
gagttccgccatggcctccttggaagtcagtcgtagtcctcgcaggtctcggccgggagctggatagntgcgcagtccacgacagaacaaatattcggtgctttnaacctacctacaacgagcgcgagaacctgccgctcatcgtgtggctgcttggtgaaaagcttctccgagagtggcaatcancttatgacaattataatcatagatgatggaagcccagatggaaacaacgggatgttgctgaaacaggttggacgaagatctatgggtcagacagaattcttttaagatacatcgagagaaaatgtggggaactagagaagtgcatatattcttgtgataggaaacatgtccatgggaatatacgtcattattatggatgctgatctctcatacatccaataatttagttcctgaaagtctattaggaagcatcaacggaggtgtaagtggggagtaatgtctctggaactcgtgtacaatggaaatggggtgtatatggctgtgttttgaactcgaagaatattcagctcgtgggccaattttaaagtcagatctggtgagacaggagctctgattgaacaggaaagttgggattatgccgaaagaggttctagagaaattgtagaaaactgtgtttctaaaaggtaggtctcagatgggatgatggtcgggcagaagtggatatacttattgggagggccatatcagtgtggggccggtaatggtgactccagtggaggacgaaattttcttgtgaagggtatggctttgagaataagaagaaccatagagtctcggtaaaaaacgggggttgtaagtctaaaaatgggggggttttaccagttttatagggagaaagtttggaggtttacacaagcggtggattgg

SEQ ID NO: 545742 - DNA, 683 bp, Homo sapiens
ggtactggagccattggtggttgagttatgctgatggcgcctctctgaagggcaagttcaaagtcataagttgggtgctgaagacaagaaatgagaagtagtggatgagattgtagaacgtgacgcctcgcacagcatattggcttttatgacccccatgagctgaaaggcaggtcgaccacagctcgacaactatattgccaggttcgaaacgggataagtcgcaagacaagttaaatagaagaccaagaacaacattgaaagcaaaccaaggataatactgacagcgtgcgaaatgaactggagccttgaggtggatctagacttacaagcatactatctggggaattccagtcgaccaatggctattgcttacgaggccattaacttgggtgtagcaccttcaacccaccttcagtatatgtatagcaccaactactttggtaggcccacacttccgtggtaaactagacccttgtgcaaatagccaaagatagaattacccgggcgatagggatcccaccatagacaaagaacgctgtataactcctacgatgaacgatacatagagaacacgctgactggaaacaccactgactgttgcacgtggacaaaacgcattaggtacttgacaggcatggatacaaagtaaagcacaacgcatggcacacggggagcacaga

SEQ ID NO: 545743 - DNA, 369 bp, Homo sapiens
  misc_feature (152)..(152): n is a, c, g, or t
  misc_feature (180)..(180): n is a, c, g, or t
  misc_feature (193)..(193): n is a, c, g, or t
  misc_feature (291)..(291): n is a, c, g, or t
tgatgtatcgcccaacacacacactgaaaacaaaacactaacaacaacaaagtaaaaaacagctgtgtgtagtgatggaaagacttcctcttagcactgccattccctctgcttggaatgcatgtaaaaaacttttttatagcgggctaaanatcgtacactgagtaaccaattctcacngtccctagacccncattcttatgttccttcttcttcctgtattttctctccctatgtccatattctctttctgtccacgtattcctgtttgttcatacggcagttccactngtgagtcctgtactcatttctcattcattcatggctcactgtgtgtcatgttctattctaggtgtaggggataacata

SEQ ID NO: 545744 - DNA, 250 bp, Homo sapiens
cccctggtgggttttatcaacagcctcaagttttccagctttggggaatttctggtggttggggtagggcaggagcacaggcttggccgatggtggagaatcaaaaaggctgggaattttgtttgcatcatcccactccgcagggtccctgtacccccagttggtggttcctgacatttttatcctccttatttaagtccttcccagggtatgccccaccctttttgtattaaaagcctccttttttgga

SEQ ID NO: 545745 - DNA, 986 bp, Homo sapiens
tcgctctcctggttgacttatggtaatgccgtcactttaacctctggtccggagcatggtcacgctgttgccattgtgccgtacagtggagataagtggattcatgactgtgcagcaagaaatatgcgcattacactctcagtctgcttgcctagagctagcaatgtaatgatgttagcacattctatcctgatgatagcgactgatctttcctggggacgaagtcttctgtacttgatataattgactataaagagcatacactgaatctaactactagttcgtcgctcggtcgcttggataatctttggtcatttgcagcatacttgacaaacaccaatgcttactacgatgcgtagctgatagctaagggtgacaagtaatcgcgtcgcatgggaaagttgacattcatggcacacaaatttgttggttcagcaatggacaatattagtaattcgcctctttagcttgtggagagacatgtctctacaagaaaattttctgaagttcaaggatcctaaaggattcaaggttgatgccccctttttatggaggcccaaggacatgttgtgtaagcaagggtacacggtgaaattttccccaagaaaggtgtgccgtccttaatttaattattacgtgtctttcgcggtcgcaaagttacagtaggtcatgcccataaacagggtgggttaaaacttccacaatctctcctcttaggtgagacaggtgtatcctccaaatggtacaaagacacgttagaggtatcatacacgaacgggtgttccaggtcacaacatttcggttttgatcccccagtgacgttcccattgtaaaaggctagcccaacaacgtgcatattgcaacccttgtttggctaacggaaattgagcaatctcgatgtacattacttactggaaggcggatacacatgggttaccctcaaatggccttgagttcgttgcatggattgtgcaacttgtcgcgaa

SEQ ID NO: 545746 - DNA, 189 bp, Homo sapiens
gcacgagctcatttctactaaaaaaaaaaaaaaaaattggctggacatggtggcgcacgcttgtaatcaaagctaatcaaggctgaggtgagaggatcgcctgagcctgggaggttgcggctgcagtgagctgtgattgtgccactgcactccagcctgggcaacagaatgagaccctgtctcaaagtg

SEQ ID NO: 545747 - DNA, 407 bp, Homo sapiens
tcctgggtcacataatgccaagtgaggttaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagacaagaagaaggtcagcaaggcccctgaagacaagaagaagagactggaagatgataagagaaaaaaggaagacaaggaacgcaagaaaaaagacgaagaaaaggtgaaggcagaggaagaatcaaagaaaaaagaagaggaagaaaaaaagaaacatcaagaggaagagagaaagaagcaagaagagcaggccaaacgtcagcaagaagaagaagcagctgctcagatg

SEQ ID NO: 545748 - DNA, 916 bp, Homo sapiens
  misc_feature (916)..(916): n is a, c, g, or t
ggtggtgcttacggagaaaatccatgcagcagtgaaccttgtggcttctcttcaaatgggctaattgagagcgtgagtaagaggagaatcagctttcaggggcattcctaatgggcagtggatgacccagtctatttacagaccaaattccttcctttagtaatcattgtggaaaaaagaacaggaagaagaaagccatgttaagaatggtgcttctcaagtctgtaaaatgctgcagttttaatgcagttgtcaacaagtagaacctcagttggctacctgaagtgttgatagtatttactctagtggtgtaattgtaatgtagaacagtgtgtgttggtagtgtgaaccgtatgaacctaagtagttgtgaagaaaaagtagggttttgtaatactagctttgtattgacataattatcattccaggtttaatatactatatttccatttatgaagaacattgatttcttttgggagtcacttttaatctggaatttaaaaatacaagtctggagtatctatagtagatcttaatgggaataacctagatattcaattatcctttatacttagaagggatgcaataattacactgttaaggaggaaggtggtggttttggatatcaagtaaagctacagtgggcgttaatgtggaagtgagtggacaaaggttaactcaggtcctggcgtatcgaagtaagactcttggtaaccatggggttggagtggcagagacaatggctacagaagagcaggttgataggcaggtgtgtgacctagcaaacatgggagggacagaggcgaatttgcatgtttcgatgatatagaggatctcaataaagcactagagaggagacagtatcagtttctttctttctcttctctctcttctttctcgagaagagacagaaagn

SEQ ID NO: 545749 - DNA, 475 bp, Homo sapiens
atattcccggattcccgttgggtcttccgggtaggacgctgtagagtcaattgtgctgacaacacaggagccagaagagacctggtatatcatctccgtggaaggggatcaaggtgacggctagagacagacttcccgctgctggtgtagggtgacatggtgatggtccgacagttcgagaaaggtcgaaaccagagctcagagaaaaaggtacattccagctagtgcgtcattcggatcgagactgatacgtcagtaccggtatgaaaacgatggctgtgttacgttagatttattgagagataatgctaggaggtcatacgatgtagaccaattaaatagggcagacgcatgaagaaggtgtcttagccgaatttagcagtgacgcagggtaggccaagagcgaggtgtaggcaggaacttgctcgggcccccggcatttggcgatcccaactggcgtggggcagcagtagca

SEQ ID NO: 545750 - DNA, 303 bp, Homo sapiens
ctcaggatcccccgccattacaactatctcatactgtttagatgaaatagtcctagggcagacagttgtggatggcatctgggaagtctgaaactcctatctgtgtatatatcccatttgctaaagactttctaaccaaagtcttaaaagggtccatgactccccaaccacacatacatacaggaaattaaggatcattgatttttcacccaagtgctattattttacatactagaaatttgggcttcagagggattagttaaaaattggaaggttgcgtagcttttatttattgttagaaac

SEQ ID NO: 545751 - DNA, 106 bp, Homo sapiens
ttttagaggatcccacagaggaggtggacagcacggggggtgtttccctgcctgtggcatttgtgtgttggctttgagctgctgtctgagtagtggcactggggtg

SEQ ID NO: 545752 - DNA, 1039 bp, Homo sapiens
ttctctgctagggatcgttagtgtgagcactcaaacattagatatcccgaggtctcctatggtgggtggcaggatttaaaattcaatcaaatcctgtcctagtgttgtgcagtgtcttcgggcctgtggacacaggtgaatgagggaccagccctgccctgggctgtgagaagagatcagtacacccagagttagacatgtttagtagaaaaccggcatcattatgtctacgggtttcgtgtccattatttcatttccttacaggataaacagcctttattacagaaacaaaatggaacctttcatatacaaccttagtctttaaaggctgtgtggtccgtatcatgaatgcccatccagaggcaggattcgggcacatacctgtactacctgctccagagtgtgcgctccccacatcccctgagtaacccctctctggactgctgcctcagacacactgacggttccgtgtgagaaggttgacctccccctctgtgggggcacccagtctagggggaggtaccgctgccattttccctatgcaaaactcttaccgttgccctcatctcccgaaaccttgcagtaccctgacatggcctacatctgcacttaattttcttgccagcgcaagagacaccggaacacagccatgggccacatggtcacgggggggcctgcgtgcaccagaaagtgacaatgacatcagaacggcccgatctgagttgttccaaaagggcaacataacagtatctttatactggtcaaccggcctttggggaccggtcacaggaccgatgtgggcgcagaaaatcctggcacgggaaaagcatcatgttactgttgtcaaccgtaagcgcctggtaaattctcacccagtaagataagaccagcaaacataactgcttacgttcagacaacgacagcatcaacgacacagagcctcactgttatgtacccacatcgcgccgcatgatgagatgatatgacaagcacaaatgacaagtcgtcccgcatactatacagtagcacactaagtaaa

SEQ ID NO: 545753 - DNA, 500 bp, Homo sapiens
acgagcttgaactcctgacctcaggtcatctgcctgtcttggccttccacagtgctagatttacaggcctgagccactgcccctagccctcttctttttttttaattaaaaaaaaaattttttttttgtttgagacagagtctcactgtcacacaggctggagtgcagtggcacaatctcggttcactgcaacctctgccttccaggttcaagtgattcttgtgcctcagcctcccaagttgctgggattataggcacccaccatcacgcctggctaacttttgtatttttaacagagatgaggtttcaccatgttgaccaagctggtctcaaacttctgacctcaggtgatctgcctgcctcagcgtccccaagtgctgggattataggctgagccaccatgcccagccaaccttcttctatttaaaaactcttttaaacaaaggcaaaaatacatagcaaccaaagccaaaccaataaaccaaaatagctgtcttaaa

SEQ ID NO: 545754 - DNA, 254 bp, Homo sapiens
acttctagtggctgcaccacctcctcctcctcttgccagatgtgggctccagacgagctctctccgtagctgccattccgtgagtggttatagatcgtggtgtccctctcagctgctgcagtggctagcggcattcatggcaaagtgtcggatggtgctctcctccaggtactactgctcccaatttgtcatgtcggcatgtattagctctagaattaccacagttctccaagtaagagggtgccgatcaatag

SEQ ID NO: 545755 - DNA, 444 bp, Homo sapiens
gcacgatggtacctggtataaaataggcacgtaggccaggcgtggtggctcacgcctgtaatcccagcaccttgggaggccgaggagggtggatcacgaggtcaggagatcgagaccatggtgaaaccccgtctctaccaaaaatacaaaaaattagccgggcgcagtggtgggcgcatgcaatcccagctactcgggaggccgaggcaggagaattgctggaacccgggaggcggaggttgcagtgagcagtcagggtgacggagactccgtctaaaaaaaaaagaagaagaaatgcagagcctcaggcctcgccccagacctagtgaaccagcatcacaagtcacaagactcccaggtgatttgtacgcacattaaagtttgcatggggagactggctggtgagtactttaacaatcttcgtaaagcacactgtttcagtta

SEQ ID NO: 545756 - DNA, 191 bp, Homo sapiens
gagctgcgcgcgcaaggtatgagcatcgatgcagccatcaccgaactgctgaggcgccgggggcacaccgtatgaaagcgatcagcctcatccctgcccttgtgcagtcgctgctcaccctgatcgtggtctctgccgccttgctgctctatgaccgtactgtggtgcgcccagcgctacgcatcggcatg

SEQ ID NO: 545757 - DNA, 216 bp, Homo sapiens
tgtccaattgtgcagtcccattctttgtgattaaaatactagcagtcctcgaaatcctctctggatagatgcactgtgcgacagacgctattgcgatacttgagtcacaattttcctgagctgtgtcctccagctatgtgtgaataaagctgtagctcgataatgctaagggcaagaccaaaataataaggctaatgaaatatcattcagcaacag

SEQ ID NO: 545758 - DNA, 103 bp, Homo sapiens
cttttttgaaaaagaaagaaaaaaaaaactttgtgtatgtgactccaagcatgtaaccttaagatggtgcattttaaactggcaataaaggcctttcccaaat

SEQ ID NO: 545759 - DNA, 539 bp, Homo sapiens
actaaaccggtctaccgaacggacaagtgaagaccgtgtctgtactttacattacatgaactatgataatttagaaacatatataagtctccacacttccttattttcacaaaaatgccatagagagacaaattgaaacataacaaactagatatcttctctcatcccatgagccagccatggcaaaccagcagcagcagctcaattcagtcagccagaggaacaggtgaattctcatccacttctcatctcatgccctacaagcagagttttttcagcagcttgaagcacagcactgttgcactcatttattttccacacataaagcacattctccttgtgcactcaaactcacaatgtttaaaatcaggaaattagcattcaatgtatcattataatctaatccttcagcccctattcaagcattagcacttgtctcacatagtgtcttatataacaaaaagttccaagtctcacacacatcaacaccatggtcattaaacatgctcaggtcagtaaaagtaacctttcaatctgaa

SEQ ID NO: 545760 - DNA, 220 bp, Homo sapiens
cactgtgacacggaagaagggggtgaaataggaccatttacaaccacagaaaaagctctgtacatgtctagcgcctggcagaggggggcagcagggcagcagggggctgaagccggccctatttgtagaggatatcgtagtgtccaggccggtaggagaaggtagaccttggggctcggagccctcagggaatgatgtgcggcttggtggtgccgccctc

SEQ ID NO: 545761 - DNA, 1039 bp, Homo sapiens
  misc_feature (621)..(621): n is a, c, g, or t
ctgggacccgggccacagggtcagacacaagggccggcccggggaacactcaactgccaggtccagttaccagcagggtccccagggccccgggcaagcgcatgctggggtccgccatctcgaggcaagcatcgttccagggcatcgtcctggggggctaggcatcaagggctatggacagaatgcctgtgcaatcccagagaccccgtcgtgatcgttacctggtggaatgttgcccccgctgcgtttgccttccggccgtggaccctgagagtcatgggctctgccccgcccggtcccttgctccccagctcagttctggatttggggctgcccgtaacgcagcccgttagctgcttgtgcaccgtttcctgtccattgggcatcccccagtagtcaccccactccaccgaaaagtaaactgcaggtgaggccgtgccccgagtctttctctcggtgtgatttggcttatccggggcgcttgccttgccatgattctaactctctgcccattcgcgcgcaaggcacgtgggccgtggcccggctgggtcggctgaagaacttgcggatggaagctgcggtaagaggccctgatggggcccaccatcccggacccaagtnttcttcctggcgggcctctcgtctccttcctggtttgggcggaagcatcacctggatgcctacgtgggaagggacctcgaatgtgggaccccagcccctctccagctcgaaatccctcacacagccacggggacaccagtgcacctattacccagcgggaacaggatggagcacagagactcttggacacggggccgtcccccttgagtagagacccgccactcatgactgatagtacgccgctgactctggggtcagatcccgtgggctaggactcctgcccaccactcgcaggaaaccatgaggcataggggagactgttgagccttcagtgtactgcatgtgggaagtgggctccatgcacatacctcacagggctgttgtgacgggcgctataacgccgtggcaaagacagggt

SEQ ID NO: 545762 - DNA, 295 bp, Homo sapiens
gctcagtttggttgggttatttccgtattaacgctagttacgtgctaacaggctcaatattcctagaatgataatatcagactagctgacaagctccttgtttcttgtgatgtcttctcgtttcggagatgggccttttggtaggttccgtgtatccatgaataagttctgtcatgattcactattctataacttgcatgacctttactgtgttagctcttttactgttcttaatatttaagactttctttgttaacgacttatatgtccttatcattgtattaaagctgttgta

SEQ ID NO: 545763 - DNA, 550 bp, Homo sapiens
gaggaaaagatgacttcattctcgcggagaaagaaacaaccagcgtgcctatgcgtataaatcatctctctacagctacaaggaatagcatcccccatggagtagatcttcagtaagcgtctcatcgggtacagattgactatcagaccacggggattctgaagaagaaatcagaatgcggggctgagaatagttaaagggcttggagccagaaaactgtgccatgcataactccatcattctggttactgaccctcaggctttcacgaatacccactgtgctgcgctcgtcttcatcatcatagcctattagaagcaatggacgagaagcaatcgtgaaggaatcagtagtgaatacatgcatgatcccgtgtcgtagtctcatgcggtggcatgcttggtgcctgatccctgtccacagtggtgagggggctcggcacccctggctatctctcgggacctccctctaggtcctcctggtctgggctttgtggctctctgtttgcttttgggcagtatggctgtcctgtgatttcaggggcaggcgtgg

SEQ ID NO: 545764 - DNA, 639 bp, Homo sapiens
  misc_feature (525)..(525): n is a, c, g, or t
  misc_feature (561)..(561): n is a, c, g, or t
agactacaaggtttacagaaccctttaggatactgacatcatgtgactgacaccctagcttgagtactggagcgctcttgactcaccgaacagcctccacctcctcctgtcagcagttgcagtccaggtcatagaggtattcaagacagactcaactcatccacccaaggtcacacttgaggtgaccaaggtgaactatcgatgagccagtgaatgagacagatgtcattctgctggagcagaatgcaccatgctgtggccactgtgccagcctatacaacgtgtatgagaaggacgtcaaggagctaatcttgcgtgctacgtctattgcccgtacaacggattacgccgacgcggacacagtcctgcccaagtgtctagctgcctctaactatgccacgctggacatgatccgcgagggcatgccttatcagtactacgatccatgtgagactgtcactcataagcaggtacaggactactacgaggatgagcacgactgcagtcttatctgcagctcacggntgtgaaggacctctccgctctgcaagcatgcagctncgacctgtcctacagtacgtaattcaacgcactcttgcactgatgtgacatcgttatagacgtctgcgatcacggttt

SEQ ID NO: 545765 - DNA, 174 bp, Homo sapiens
acatcagcttaaggatgtggacaccagctggactgtcctggcaagctctgggttcaaggagcagctaggcagaactccagccttgaatgttcttccctgacttggaggatgggacagaagatactggacaaactagtacggccagcatgcaccagcatgtggaggcatgtgcag

SEQ ID NO: 545766 - DNA, 106 bp, Homo sapiens
ggtcgcagtcgagctcgaaacatccaaatatcttcaagttcacgctattttcagctccaaagaatttatgtgctattcctacaacttccttctcgatgttttcttg

SEQ ID NO: 545767 - DNA, 1354 bp, Homo sapiens
gtgatcccacatcctacagtcccgggaacccttcccaacttgccagctgaagtctgatgctggacatgctggttggcaatgtgccgtggaagaacccttggcacacgcgtgactatgtccatgccccaaactccacagtgcatacatggatacacctgcttggagcgacagctagcgattggccacggcacacggacctccgacaagaccacggacgacacagcgttgacagcattgaatcctcaggtggtcaattgaaaacctttgaactggcccgttcggcgcactgggccttgccaggctcacgcggaaaattcttggactccccacacgaagccaagctgcgtgcaaccaacaatacaaacatgtcgcatgcccactactcacacagtggtgtatgcctgcgaacaggagacgatattcgagttgttgaccgacattagagctgatgtacatgagcatagcgctacctatggcggcactgcttgaaagggcacactgtaccaacactggcacccaatgtaacaatttgccgtaggagtggcggtatcaaccaattaggcagcacaggaccaaccacaccttgggcgccgaacgaatagcaccgacgagaacaaacaggttagccaacctggtacttcggacaatgggcggggtaggacccggcgacacacgattccaaataaacggttacaaacatggacccctaccagacaaacacaccccttggacaatgaagcaggcacacctttgcctgtagcaccagaccaacgacctgggggttggcacgacacaacgcctactttaccacttggttgtttgaacggccaacccggaacgcggagccttttgccgacaggtgaaaaaaaggccccttttcccagggcccagatttgcaccaagggtaagacccctggacaggccccacaaggtacacccccacggaccactacaggggaagccccccaatttcccacaacgtttgagaacccaactgcacctcgctcaatggctactttggttcacaggcattacccccttgggtatttggcacgcactagaacagacggccctacattacgaaggaaattcacgtatagcgcagatccggcccagccagcaaaacacatacaatatgttctacaccggaaacgtagtactggccatcttgtggattcccattgacaactgccccccacgttggatttgcaacccacaaaattggatactaccccgtgcgtaggatatttgagaccacctcccgtggccctctacggggcacaaccagaatactcaagtagtgcgtaacagaggatagtaaagcgccccacaaagcagagcgaagcgctgtagg

SEQ ID NO: 545768 - DNA, 790 bp, Homo sapiens
accatgtgtgaattcaaaataatcaacttgggtttattataaaaaacaaaatatattaatataatgtatactaagatttttctatgcaacacttggccaggctgcggtggctcacgcctgtaatcccagcacttttgggagaccgatggagggcggatcacagggtcaggagatcgagaccatcctggctaacacggtgaaaccccatctgtactaaaaatacaaaaaattagccgggcgcggtggcgggctgcctgtagtcccagctactcgggaggctgaggcgggagaatggcgtgaacccgggaggcggagcttgcagagagcccagatcgcgccactgacacatctgactgggctgacagagtgagaccctgtctcaaaaaacaacaaacaaatcacacctaagaagaatatatgtgacctatgggcacagggcgcggtggctcacgcactgtacatcccagccctcttgggaggccgaggaggctggatcacagaaggtcacggacatagagacacaatccatggctaaacatgcgtgaaacccaaggcactacctaaaaaatacaaaaataaaacacataccaaaatgcgacgaggatgaccaccgcaagaccagcaaatcaagaaggacgaacccacgaccacaggccgcgacccccgaaaagccgcacgacggcagagaaccagcaacgccccctgcaatccaaccgggccaccccagtgcagaacccacacacacaaaacaacaaaaaaacacaccaacgcacagaaaacaaacgagcga

SEQ ID NO: 545769 - DNA, 82 bp, Homo sapiens
gacagcagcttctacatctgcagtgctaggactagcgggatagatacgcagtattttggcccaggcacccggctgacagtgc

SEQ ID NO: 545770 - DNA, 133 bp, Homo sapiens
  misc_feature (107)..(107): n is a, c, g, or t
  misc_feature (116)..(116): n is a, c, g, or t
atgatacgatcgagtcggtaccagcggaacagcactgaaattagagatgtgtgcagcatgcctggttaattttttttacttttggtggagacagggctctctctatngttgcccanggctcatcttgaactct

SEQ ID NO: 545771 - DNA, 324 bp, Homo sapiens
catgtctacacatattcacagcagcattattcgcaataaccaaaaggtagaagcaacccaagtgtccatcagtgggtaaatggacacaggaaatatgtttggtccgtacagtggactgttatacagccttcaaaaggaaggacattctgtcctatgctacaacatgggtgaacctaaaggacattgtgctacgtgaaagaagcctgtcacaaaaggacaaatactgtctgattccatatatatgaggtacccagagcagtcaaattcatagagacagaaaatagaatggtgattatcagtggtgtaataagtgtagaaatggaa

SEQ ID NO: 545772 - DNA, 768 bp, Homo sapiens
catctccatgacattactcatgaccttggaaagtaaaataggaacctatgaaactatagatatgtgaattagatagggttatatcaagctgtttgggtcacattcactatgccgagacaagtaaaagtggactctcagcgtaggactaggcagcgccctggttaagagtagatctggttgtgattcatcatgggaagggtaatacttgacaagcatatgctgtctgctttctgtgctctccaagtactaggttaaggctccaacatgaaggcatgtcaaggagagtgtaaggatgaggttgcgtcaaatatccagatctatatgtcgggtaagaaacatgaatcttagtctttgtatttagcataggagcctgtcttgactgggtagaatacaataattctatatacatttgcaagtccatgttaggtgtgtggtagggaacaaatcgatttattttatatacaaaaacaatcactttagtatgaagccatcaatgtgtccctagatttctcagggttacgagaaactgagttcatgatgatgacttacatgccttcaataatagagagacattggggttgaattgcagcctttggtatgggtgaggtcaagtgaaatatgatagtgcattagacaataaaatatctatgtctatatcatcgatcaattgttaagacgtctaacgtaagttgtactcgaaccactgttgttatggattgagatcctgtgagttgtttaaggggaaaaggcagaagggattggaaaatc

SEQ ID NO: 545773 - DNA, 93 bp, Homo sapiens
ccctcccacacagctcaaatggaaggaaactgattaacacatagaaattgtaggttgtaatcttgtgccaaccaataaaaaccagtatttcac

SEQ ID NO: 545774 - DNA, 406 bp, Homo sapiens
acaaaaccaacaggagagagagagacagaaatagagagagaaagggagagatttattatgaagaactaggtcatgtcattacaggggctgggaagttccacagtccaccatcggccagctagagacccaggattacctgttgtgtagctccagtctgagctagaggcctgaaaccggcagaattgatggtgcctcagtggcttcgaggaggcccacccactctggggagggacaactgccttgctcagtctacagattcacgtgttaatctcatccagaaagaccctcacagacacacctagaataacgtttgacctaacatctgggcacctaatggctcagtcaagttgacacttaaaattaaccatcacagacaataaaagagcctttttaaacatcaaaaaaa

SEQ ID NO: 545775 - DNA, 409 bp, Homo sapiens
actagctattaagccatggataaacatggaagaaactgaaagtgcatattactaagtaaaataagagaaccttaataggctacatactgtataattctagctatatgacattctggaaaaggaaaaactaaagagacaataaaataatcagtggttgacaaggattgagaaagggagggatgaatagaagcacagaagatttgtagggcagtctattctgtacaacactacaatggtagatacatgtcattatacatttgttcaaacccatagattacagagtaccaagagtggaccttaatgtgtagtatgaaccttgggtgataatgatgtgtcaatacaggcttataaattgtaattgtacctctcttgtgggggatattaatgggaggctttgcagtgtgtgggc

SEQ ID NO: 545776 - DNA, 159 bp, Homo sapiens
actgttccgtgcttgacacaccgtgctctgcgtctgcatacatcccgtgccccatacctgcccgtgcacgtgccgtgcacacctgcctgcgcacccacacacctacctgcacacctcctccgtgcccacacacctgcctgtgtgcccagcacacttacc

SEQ ID NO: 545777 - DNA, 240 bp, Homo sapiens
  misc_feature (179)..(179): n is a, c, g, or t
actgataccaatggcgtctaatttcatcaataatactacgatgtgacggtgcactgttcttcagcaagctcggaacaattcccgttacagagtttgggcccatctacctagagtactttctgaataacgttcatgacgccaaccacgtctcaatcaatagtggtctgagtggtttgggntcactacgcattcgtgctagggctaccgaagcctcggagattctgtacatccatggctcga

SEQ ID NO: 545778 - DNA, 1560 bp, Homo sapiens
atcacagtagcttgattctttcagccctcatcctctcacttgatcagttgttcaacagaatcagctgacataattgacacagtttattgggtgttaagtccgctctatagggatagtgactactttttttttttttttgctcttcttcctctcccctttctttatatgggtttaaatttaacataaagttgtttttataaggcttatttgtggctttaacttgtaagtctgattacatcattattgttccaaattcattatctctgtaggaacttttagttccattatatgaacactggataacctaattttttttaatgctttaaaaaaatggcaaaaagacgtcaggccaccctcatagtaagtggtgtagtattaaaatattttcacggaattaaaagtagcttgctgtcaaagaaacacctgagatgaattggtgtgaacgaattttgcaagtttaatttgatttatttcagagaaaatagaaaaaacaatgttagaaggttatttaaaatgatacttaaataaagaaagtgtgaggtctactttaaaaaaattcaaatgaagagaaaaagaaaaacagcattctagaaatggcatttctcctaattaattttccacttaatggaagattatcaattgtcctattttatgatcccaggactgaagacagttgtgggatatctgtcatatttatcctgtgagtcattgtgaataatgacatacagtactgaagtaatctgattttattctttggaaattcaatgcattggtcacactaataacatcaacatctgctatcacttatctttttaaaactaaccaaaaaagtgctgggattacaggcatgagccactgcacccaactcctctttcgtctttctttaacacacactaggctctttgtgtattatgattcagtgctatttgtaactgtgtcccagtgaccaaattgcactcgactcgatcagctgttcatccatttcgtgttttttcctgtcaaacattaatccagcaaatatatgaggtatttaccaatttattttcttagtattacaaaataattcattagcataaagtacaatagtgaaatatttgagttgttcggaacctcaattaatcctgttttacatttcagacctaaagctggcaatcaggagaagaagcactttgttttaaatgtggagaagataacacttgattccatttcattgtcattagtgtattaaccagcaggagaggtgatgagccatttttcaaatgaaataccttttatttccatataatttttttattttagagttcaatagctgtttctatgattatcctcaatttccatatgttactgaatctgaaaaacatctttaaaattcaaacagttccattttctctcttgtaagtgttaaatgtgataaaagtacatattttaaattgttttcagctcttggatatagcagcaataaaaacactaatttgtgggtatttaagaaaacctggagaataaactcatactttaaaagatcacaacacacaccacacccacacacacacataccacccg

SEQ ID NO: 545779 - DNA, 259 bp, Homo sapiens
ataagtagaactaagattctatcttggacaaccagctatcaccaggctcgtgtcggtttgtcgcctctacctattaatcttcccagctattttgctacatacaacggtgtgctcatttagctgttcttaggtagctcgtctggttacgggggtcttagcttttgctctccttgcaaagttatttctagttacattccttatgccgaaggtatcaggggttcagtcctatgctcatataatgctacgttgtcatttctca

SEQ ID NO: 545780 - DNA, 1600 bp, Homo sapiens
atcacagtagcttgattctttcagccctcatcctctcacttgatcagttgttcaacagaatcagctgacataattgacacagtttattgggtgttaagtccgctctatagggatagtgactactttttttttttttttgctcttcttcctctcccctttctttatatgggtttaaatttaacataaagttgtttttataaggcttatttgtggctttaacttgtaagtctgattacatcattattgttccaaattcattatctctgtaggaacttttagttccattatatgaacactggataacctaattttttttaatgctttaaaaaaatggcaaaaagacgtcaggccaccctcatagtaagtggtgtagtattaaaatattttcacggaattaaaagtagcttgctgtcaaagaaacacctgagatgaattggtgtgaacgaattttgcaagtttaatttgatttatttcagagaaaatagaaaaaacaatgttagaaggttatttaaaatgatacttaaataaagaaagtgtgaggtctactttaaaaaaattcaaatgaagagaaaaagaaaaacagcattctagaaatggcatttctcctaattaattttccacttaatggaagattatcaattgtcctattttatgatcccaggactgaagacagttgtgggatatctgtcatatttatcctgtgagtcattgtgaataatgacatacagtactgaagtaatctgattttattctttggaaattcaatgcattggtcacactaataacatcaacatctgctatcacttatctttttaaaactaaccaaaaaaggccgggtgcagtggatcccacccgccttggtcgcccagagtgctgggattacaggcatgagccactgcacccaactcctctttcgtctttctttaacacacactaggctctttgtgtattatgattcagtgctatttgtaactgtgtcccagtgaccaaattgcactcgactcgatcagctgttcatccatttcgtgttttttcctgtcaaacattaatccagcaaatatatgaggtatttaccaatttattttcttagtattacaaaataattcattagcataaagtacaatagtgaaatatttgagttgttcggaacctcaattaatcctgttttacatttcagacctaaagctggcaatcaggagaagaagcactttgttttaaatgtggagaagataacacttgattccatttcattgtcattagtgtattaaccagcaggagaggtgatgagccatttttcaaatgaaataccttttatttccatataatttttttattttagagttcaatagctgtttctatgattatcctcaatttccatatgttactgaatctgaaaaacatctttaaaattcaaacagttccattttctctcttgtaagtgttaaatgtgataaaagtacatattttaaattgttttcagctcttggatatagcagcaataaaaacactaatttgtgggtatttaagaaaacctggagaataaactcatactttaaaagatcacaacacacaccacacccacacacacacataccacccg

SEQ ID NO: 545781 - DNA, 190 bp, Homo sapiens
cccccacccccgttggtgtaagacggagagtataccttgtctctgcgacgtctacgaggtggacttctacttcggccattcaatagatatctcttagcacctgcccgatgctgcctctgtgctgggcaggggaaaagaggggttgagcagggaatgcctaggcctcactttagcttgtctagagagggag

SEQ ID NO: 545782 - DNA, 1515 bp, Homo sapiens
atcacagtagcttgattctttcagccctcatcctctcacttgatcagttgttcaacagaatcagctgacataattgacacagtttattgggtgttaagtccgctctatagggatagtgactactttttttttttttttgctcttcttcctctcccctttctttatatgggtttaaatttaacataaagttgtttttataaggcttatttgtggctttaacttgtaagtctgattacatcattattgttccaaattcattatctctgtaggaacttttagttccattatatgaacactggataacctaattttttttaatgctttaaaaaaatggcaaaaagacgtcaggccaccctcatagtaagtggtgtagtattaaaatattttcacggaattaaaagtagcttgctgtcaaagaaacacctgagatgaattggtgtgaacgaattttgcaagtttaatttgatttatttcagagaaaatagaaaaaacaatgttagaaggttatttaaaatgatacttaaataaagaaagtgtgaggtctactttaaaaaaattcaaatgaagagaaaaagaaaaacagcattctagaaatggcatttctcctaattaattttccacttaatggaagattatcaattgtcctattttatgatcccaggactgaagacagttgtgggatatctgtcatatttatcctgtgagtcattgtgaataatgacatacagtactgaagtaatctgattttattctttggaaattcaatgcattggtcacactaataacatcaacatctgctatcacttatctttttaaaactaaccaaaaaagtgctgggattacaggcatgagccactgcacccaactcctctttcgtctttctttaacacacactaggctctttgtgtattatgattcagtgctatttgtaactgtgtcccagtgaccaaattgcactcgactcgatcagctgttcatccatttcgtgttttttcctgtcaaacattaatccagcaaatatatgaggtatttaccaatttattttcttagtattacaaaataattcattagcataaagtacaatagtgaaatatttgagttgttcggaacctcaattaatcctgttttacatttcagacctaaagctggcaatcaggagaagaagcactttgttttaaatgtggagaagataacacttgattccatttcattgtcattagtgtattaaccagcaggagaggtgatgagccatttttcaaatgaaataccttttatttccatataatttttttattttagagttcaatagctgtttctatgattatcctcaatttccatatgttactgaatctgaaaaacatctttaaaattcaaacagttccattttctctcttgtaagtgttaaatgtgataaaagtacatattttaaattgttttcagctcttggatatagcagcaataaaaacactaatttgtgggtatttaagaaaacctggagaataaactcatacttta

SEQ ID NO: 545783 - DNA, 842 bp, Homo sapiens
gagatcgcaccactgtactccagcgtggcgacagcgagactccgtctcaacaaaaaaaaaaaagaaaaatcacaaaagaaaacactaggaaaatatattcaattaaatggcaaattaaggatcgaaattggtggcttcaaaaatatcttggcaatggacttctggaccaccaattacccaaagttggggccaaacttcacagatttaaagggcatcattctccacgagattggcccacaggttcaaaccaccagctccagggctcagggggtctccagggccacccttgtcatctggaccaattggcctacaatttcaagggattcccattatccgtggtacatggggtaatttactagaacaagtcacggaagtcaggactgataacagatttattaaccagcaatgtggttagcaattcgaatttaatggcgtatcgggaatggtaaagttacggttaacccaaaaatgtgcatagggtgaggcccgggaagggtcccaaatgcagtcttggtatggtccccagcccatgtgtgtagcaaatatgcagagtattggcaaccagagaagtcttacctgagccttactatccagatccttggtagggggttccataacatggggtatgtcggactggaatcagtgaccattgatggtcaaatcaatttcgagcctcctttggtatcccaaaagggccagggccggataaccacaggcccaaaacgtttataatcaccatgatggggacatacaggggagtggccaagctggcatctgggagctcaatctccttaaggttaagagtatctaaggggccacgtgggcattcgcaaaacacatca

SEQ ID NO: 545784 - DNA, 199 bp, Homo sapiens
aactcacgtgagtctgtctgatgcatcaagagtctcgacactaattcacatcatcgcgcagtaggcatcggcatacgtcggtcatgatatatggcatgatctcagtatgatctcgtgctgtctatccgcagaccgcgagatggtctagagtcagcttacatccctcagcaggaaagtttacccatgaggattggtggga

SEQ ID NO: 545785 - DNA, 934 bp, Homo sapiens
atcacagtagcttgattctttcagccctcatcctctcacttgatcagttgttcaacagaatcagctgacataattgacacagtttattgggtgttaagtccgctctatagggatagtgactactttttttttttttttgctcttcttcctctcccctttctttatatgggtttaaatttaacataaagttgtttttataaggcttatttgtggctttaacttgtaagtctgattacatcattattgttccaaattcattatctctgtaggaacttttagttccattatatgaacactggataacctaattttttttaatgctttaaaaaaatggcaaaaagacgtcaggccaccctcatagtaagtggtgtagtattaaaatattttcacggaattaaaagtagcttgctgtcaaagaaacacctgagatgaattggtgtgaacgaattttgcaagtttaatttgatttatttcagagaaaatagaaaaaacaatgttagaaggttatttaaaatgatacttaaataaagaaagtgtgaggtctactttaaaaaaattcaaatgaagagaaaaagaaaaacagcattctagaaatggcatttctcctaattaattttccacttaatggaagattatcaattgtcctattttatgatcccaggactgaagacagttgtgggatatctgtcatatttatcctgtgagtcattgtgaataatgacatacagtactgaagtaatctgattttattctttggaaattcaatgcattggtcacactaataacatcaacatctgctatcacttatctttttaaaactaaccaaaaaaggccgggtgcagtggatcccagcactttgggaggccaaggcgggtggatcatctaaggtcaggatttcgagactagcctggccacatggcaaaccctgtctcta

SEQ ID NO: 545786 - DNA, 193 bp, Homo sapiens
aacgtagtatggtgatgagtggcatggagaatgtgttaaaatcatataattacacctgcaactgtgatgtggggtactatgcggcccagctgtcagctcgtgattcagtgtgagccttcgcacggccccaccagctggtgtaccataggactgtacatcactacttcgcggaaaccttcagccttcagactca

SEQ ID NO: 545787 - DNA, 247 bp, Homo sapiens
atcaattactaccgtataggccaacataattacccccatactccttatcactattcctcataacccaactaacaatattaaccacaaactacgcggctacctccctcaccaaagcccataaaaaataaaaaaattataacaaaccctgagaaccaaaatagaacgaaaatctgttcgcttacattcatttgcccccacaatacctaggactaacccgacgaacgtactgatcattcctatggttgta

SEQ ID NO: 545788 - DNA, 1661 bp, Homo sapiens
atcacagtagcttgattctttcagccctcatcctctcacttgatcagttgttcaacagaatcagctgacataattgacacagtttattgggtgttaagtccgctctatagggatagtgactactttttttttttttttgctcttcttcctctcccctttctttatatgggtttaaatttaacataaagttgtttttataaggcttatttgtggctttaacttgtaagtctgattacatcattattgttccaaattcattatctctgtaggaacttttagttccattatatgaacactggataacctaattttttttaatgctttaaaaaaatggcaaaaagacgtcaggccaccctcatagtaagtggtgtagtattaaaatattttcacggaattaaaagtagcttgctgtcaaagaaacacctgagatgaattggtgtgaacgaattttgcaagtttaatttgatttatttcagagaaaatagaaaaaacaatgttagaaggttatttaaaatgatacttaaataaagaaagtgtgaggtctactttaaaaaaattcaaatgaagagaaaaagaaaaacagcattctagaaatggcatttctcctaattaattttccacttaatggaagattatcaattgtcctattttatgatcccaggactgaagacagttgtgggatatctgtcatatttatcctgtgagtcattgtgaataatgacatacagtactgaagtaatctgattttattctttggaaattcaatgcattggtcacactaataacatcaacatctgctatcacttatctttttaaaactaaccaaaaaaggccgggtgcagtggatcccagcactttgggaggccaaggcgggtggatcatctggtctcgaactcctgacctcgggtgatccacccgccttggtgccaaagtgctgggattacaggcatgagccactgcacccaactcctctttcgtctttctttaacacacactaggctctttgtgtattatgattcagtgctatttgtaactgtgtcccagtgaccaaattgcactcgactcgatcagctgttcatccatttcgtgttttttcctgtcaaacattaatccagcaaatatatgaggtatttaccaatttattttcttagtattacaaaataattcattagcataaagtacaatagtgaaatatttgagttgttcggaacctcaattaatcctgttttacatttcagacctaaagctggcaatcaggagaagaagcactttgttttaaatgtggagaagataacacttgattccatttcattgtcattagtgtattaaccagcaggagaggtgatgagccatttttcaaatgaaataccttttatttccatataatttttttattttagagttcaatagctgtttctatgattatcctcaatttccatatgttactgaatctgaaaaacatctttaaaattcaaacagttccattttctctcttgtaagtgttaaatgtgataaaagtacatattttaaattgttttcagctcttggatatagcagcaataaaaacactaatttgtgggtatttaagaaaacctggagaataaactcatactttaaaagatcacaacacacaccacacccacacacacacataccacccg

SEQ ID NO: 545789 - DNA, 1610 bp, Homo sapiens
atcacagtagcttgattctttcagccctcatcctctcacttgatcagttgttcaacagaatcagctgacataattgacacagtttattgggtgttaagtccgctctatagggatagtgactactttttttttttttttgctcttcttcctctcccctttctttatatgggtttaaatttaacataaagttgtttttataaggcttatttgtggctttaacttgtaagtctgattacatcattattgttccaaattcattatctctgtaggaacttttagttccattatatgaacactggataacctaattttttttaatgctttaaaaaaatggcaaaaagacgtcaggccaccctcatagtaagtggtgtagtattaaaatattttcacggaattaaaagtagcttgctgtcaaagaaacacctgagatgaattggtgtgaacgaattttgcaagtttaatttgatttatttcagagaaaatagaaaaaacaatgttagaaggttatttaaaatgatacttaaataaagaaagtgtgaggtctactttaaaaaaattcaaatgaagagaaaaagaaaaacagcattctagaaatggcatttctcctaattaattttccacttaatggaagattatcaattgtcctattttatgatcccaggactgaagacagttgtgggatatctgtcatatttatcctgtgagtcattgtgaataatgacatacagtactgaagtaatctgattttattctttggaaattcaatgcattggtcacactaataacatcaacatctgctatcacttatctttttaaaactaaccaaaaaagctggtctcgaactcctgacctcgggtgatccacccgccttggtgccaaagtgctgggattacaggcatgagccactgcacccaactcctctttcgtctttctttaacacacactaggctctttgtgtattatgattcagtgctatttgtaactgtgtcccagtgaccaaattgcactcgactcgatcagctgttcatccatttcgtgttttttcctgtcaaacattaatccagcaaatatatgaggtatttaccaatttattttcttagtattacaaaataattcattagcataaagtacaatagtgaaatatttgagttgttcggaacctcaattaatcctgttttacatttcagacctaaagctggcaatcaggagaagaagcactttgttttaaatgtggagaagataacacttgattccatttcattgtcattagtgtattaaccagcaggagaggtgatgagccatttttcaaatgaaataccttttatttccatataatttttttattttagagttcaatagctgtttctatgattatcctcaatttccatatgttactgaatctgaaaaacatctttaaaattcaaacagttccattttctctcttgtaagtgttaaatgtgataaaagtacatattttaaattgttttcagctcttggatatagcagcaataaaaacactaatttgtgggtatttaagaaaacctggagaataaactcatactttaaaagatcacaacacacaccacacccacacacacacataccacccg

SEQ ID NO: 545790 - DNA, 973 bp, Homo sapiens
  misc_feature (111)..(111): n is a, c, g, or t
agcggagacggagtttcgctcttgttgcccaggctggattgcagtgtcacgatctcggctcactgcaacctttgcctcccatattcaggcagttctcctgcctcaacctcncaagtggctgggattataggcgcctgccaccacgcctagctaattttgtgttttagtggagatggtttcatcatgtggccgggctggtctcgaactcctgacctcgggtgatccacccgccttggtgccaaagtgctgggattacaggcatgagccactgcacccaactcctctttcgtctttctttaacacacactaggctctttgtgtattatgattcagtgctatttgtaactgtgtcccagtgaccaaattgcactcgactcgatcagctgttcatccatttcgtgttttttcctgtcaaacattaatccagcaaatatatgaggtatttaccaatttattttcttagtattacaaaataattcattagcataaagtacaatagtgaaatatttgagttgttcggaacctcaattaatcctgttttacatttcagacctaaagctggcaatcaggagaagaagcactttgttttaaatgtggagaagataacacttgattccatttcattgtcattagtgtattaaccagcaggagaggtgatgagccatttttcaaatgaaataccttttatttccatataatttttttattttagagttcaatagctgtttctatgattatcctcaatttccatatgttactgaatctgaaaaacatctttaaaattcaaacagttccattttctctcttgtaagtgttaaatgtgataaaagtacatattttaaattgttttcagctcttggatatagcagcaataaaaacactaatttgtgggtatttaagaaaacctggagaataaactcatactttaaaagatcacaacacacaccacacccacacacacacataccacccg

SEQ ID NO: 545791 - DNA, 1070 bp, Homo sapiens
cgcatgatgaaacttcggctcactccttggccgcctgacctgatcctccagatcaccacagagagtattcctagcgcatgcactactcaccagacgcctcaaccgccttttacatccataactcgcccacgtcactcgagacgtagattatggctgaatcatccgctaccttcacgcccgaatggtcgcctcattatgctttatctgcctctttcgtagcacatcgggcgaggcctatgttacgcgagtcatgtttctcttacctcgatgaaacctgaagactacctcggcaatataatcctgcctgcttatggcataggtatatggcccaccgcactttcatagggtcgtatgatccctccctgtgaggccaaatatcgattctgtagggggccaccgttaatttacaaacttacatatccgccatcccatacattgggacatacctagttcaagtgaatctgatgaggctcactcagtaagacagatcccagccctcacaacgattcttgacctcttcatcttcatcttgcccttcagttgattgcgaggcccgtaaacagtagctccaactcgctattcttgcatcgaagacgggattaaaacatacccctctaggaatgagcctccccattcccgataaatatccagcccttccttcccttttcgtgcacaatcatatgacgccgcgggttacttgtcttcgcttctatccttaatgacctgtagaactatgctccaccaagagcctcctaggcgagcccagagaaattattccccggggcgaacctccgttaaaaaaccctccccagatgaaggcccgaatgaaatttcctaatagggcaccacaaattcggatccggccttagaaaaggaggggcgctgccaagaggattacaccccctgcctggaggatcccccccctttttctcacaaggtaatttttgccctaccaccctttgtggctggcgagagaccccctccgagaggacaggcacactccgtgggagcgtcagcacccacgcccttaaggggcgacaaaaaagggcgcgggcgcctctcgccgccag

SEQ ID NO: 545792 - DNA, 796 bp, Homo sapiens
  misc_feature (32)..(32): n is a, c, g, or t
  misc_feature (73)..(73): n is a, c, g, or t
  misc_feature (103)..(103): n is a, c, g, or t
  misc_feature (112)..(112): n is a, c, g, or t
  misc_feature (217)..(217): n is a, c, g, or t
  misc_feature (220)..(220): n is a, c, g, or t
  misc_feature (239)..(239): n is a, c, g, or t
  misc_feature (468)..(468): n is a, c, g, or t
  misc_feature (490)..(490): n is a, c, g, or t
  misc_feature (655)..(655): n is a, c, g, or t
  misc_feature (694)..(694): n is a, c, g, or t
  misc_feature (701)..(701): n is a, c, g, or t
  misc_feature (727)..(727): n is a, c, g, or t
  misc_feature (731)..(731): n is a, c, g, or t
  misc_feature (761)..(761): n is a, c, g, or t
cgacaggcaatcctttctcatttaagagtagnaatggcgctctagtagtcagaacgcccctcaagttaaaagngtgccttaattgttcagtatcggctactgngatttggtnacagcaaaccacatggtctttcctctggtatatgattagggcagggaccttcttgttgggccaatggctgcgcaggttttgatgacatgggggatacaataagtnggncgttgtatgggaggggggnagcggggcctgggcttgtgcccttgtcactttctgtttggggccaggggggtggagcttgatgacatctcctaacaatacccacatgcacatctctgtcatccttaaatcactgagtcttggacttcaggttctccttgtgccggtccacaagggaaccaacccactccaccgttttctgcttggcttcctcccagctgtagagtggcttatacgccaaatctcgctgngccttcttataagagcaggtgnatacgctatttgacaatgtgactatgtggcggttgggggcggtcgataggtgtgagttggcctgagtaggaagctcactatttccagcaggaagccaatccaatacatcagggataaaggaaagctccatctggaatcaaggcggaggccgaactctttgctcanggtgtgattaaggttatcatagctttggtgaggcgtgtnatctganatatagtagaactgtcctcggatgcntggngccttcttggggttctgcaaggccctcaangccagaatgtgggcccaggccacattgccaacata

SEQ ID NO: 545793 - DNA, 1747 bp, Homo sapiens
taatatattgtgtatgtttggtttgtattctatgtgtagtatatctcttctgtatagatctagtatctattttgtttcatttatttattatgatgtctgtacatctgttataagtgtacattatagattgttcataagttcatgattgatttgttaattcgctggtataattatttaggtattggagctattggatagattgtttcaatgaaagtgtattgggttggtgttgtgtctgtgtgtgatgtgtatctgttgtggtgatggtttaataactgtttttaatcacttatttatattttagtgttttgaattatcttgtgtatttgttattgttgtagtgttcagtatttcctgctctctcatctcgattttgtgtgtctgttcttctctatatttttgctttctttcgttctcctcaatctcctcttgtgttcgtgtgttgtggtgaatacgtatcttccatttgcttgtaggttctatcaatgtctgttcggtcgttttgtcatcctgtttcgtagctgctcattgctcttcgtcgtgtgcatattttgtctatcttcgtcctctggtatctctgtttgtttgtccttttctggtgatagggtttttttggtatactaatggtatattctttattgttttttgtgtgtttgaatggtgtgtgtcttcttatgtgtagtgtttattttgtggtttcactgggttgtacttaggtctggttatctctagtcttctttgtgtgctcttatgatttggtggaatggataatttggacctatgattttttgcttctatgttataatgtgtctttttctatattaattgaatttgaattggtatttatttatttgtctcttatttttgtttcgctattctcattaggtatgtagattttttggtaatgtgtcttgctaatttattctatgttggggttcatgtgtaatttagggtggtatgggttttgacaagtttagtcgtaatagtcttattgttttgtgatatgtttctatgttatggtataatttctaagtatttgtgaatttgggtaattgtatgctaatttccatgtggtaattgtttctatattggtcttcattaatgttttttaaatatctaatgggtcccttatcttttgattctagtaatgtcttagttatcttatcccctttggtgtatttccctgggttcccctcttgtcttatatcgtcgtcctcaagcgtttcggcgtctttggcgtaaccttcgtctctgagtaaacgttggtaactttttccctactttttctctgtggtactctggctcgtctcaggcatagacgatcttcgtactgttttcgtcccagcgtaattctatcttatgctatatgtatggtaatctcttccttgccttgtagggatgggctttgtactttgtgtatatgaatctatttgtggtctctcggtcctagtataaagatttttctaggtagttcttgtattatttatatctcctattctgtatctaggtagtagtgtgtaatgtttgtgtctgtccctgttgttatctcgtgctactattgttctctgtgtctcaatggatcttcgtagaatagctatacttagactgtcatcatagaatgtatcgtagcaggtagcatgagtttttacaagtgacccttcccttccctcctaccactaccatcttatggggtctggggcttctctcgcaccccctagcacctctgtcatatacaacctggaggtcc

SEQ ID NO: 545794 - DNA, 299 bp, Homo sapiens
  misc_feature (27)..(27): n is a, c, g, or t
  misc_feature (63)..(63): n is a, c, g, or t
  misc_feature (65)..(65): n is a, c, g, or t
  misc_feature (68)..(68): n is a, c, g, or t
  misc_feature (79)..(79): n is a, c, g, or t
  misc_feature (86)..(86): n is a, c, g, or t
  misc_feature (93)..(93): n is a, c, g, or t
  misc_feature (96)..(96): n is a, c, g, or t
  misc_feature (106)..(106): n is a, c, g, or t
  misc_feature (115)..(115): n is a, c, g, or t
  misc_feature (156)..(156): n is a, c, g, or t
  misc_feature (165)..(165): n is a, c, g, or t
  misc_feature (167)..(167): n is a, c, g, or t
  misc_feature (173)..(173): n is a, c, g, or t
  misc_feature (178)..(178): n is a, c, g, or t
  misc_feature (206)..(206): n is a, c, g, or t
  misc_feature (221)..(221): n is a, c, g, or t
  misc_feature (232)..(232): n is a, c, g, or t
  misc_feature (246)..(246): n is a, c, g, or t
  misc_feature (252)..(252): n is a, c, g, or t
  misc_feature (274)..(275): n is a, c, g, or t
  misc_feature (278)..(278): n is a, c, g, or t
  misc_feature (286)..(287): n is a, c, g, or t
  misc_feature (295)..(295): n is a, c, g, or t
  misc_feature (298)..(298): n is a, c, g, or t
ttcacaccacaaaaagataatcacaanaaaatatacactaacttaaaaaaaaaaaaattatantntanataaaatgttntattctntttttangtnggtaaaattnttttttttncttctacataaatttctattcatgaaaaaataacaaatatnaaaatacantnatagtntgcanttcttctatagaatgaacatagacatanccctgaagcttttantttacagggantttccatgaagccncaaacnaaactaattatcaaacacattnnttntttccagnntcaaatanatnc

SEQ ID NO: 545795 - DNA, 816 bp, Homo sapiens
aaaagcaggctggtcggtcgggatttaggataaggtcctggctgcggaggagtgatggcttaaggcccaggagggcgccctgcaagtgactgctgcagagatgagggctgcttagctcctgagtgccacaggctgagaaagcaacctgacatgtccttctgataagcgcactggtagaaactctaaacgatggttggcttcgctttcatgactgggtgggtgatcagctagagaccgtggtaggtgagggaggagaggcacgagactagacaccggatggagaacgctgccgatgaacagctcgtacatgacaaactgtgcatggttcttcttgcgatgagagggttggaagcaaggacacatcagccatttacgcagcataccaaggtgcaggcgtccggtatcctcgggcaatcgcgtcatgaccgctgctctcatatcatgaggtatagggagactgaggccaggtaggaggaggtaacttcaatgcactgcatggaacccttttgatacacgctaatcctatgagaccagagagacagctacctggctccactcctgcacggcctggcgagggcagcagccagcctcctgcgtgggtgtgaggacgttccccggacgagcccgggacacggagggcacggtggagctagcacccaggggcagctccaggtcaggcgacggaccctccctctagctgctccccccatggcaccggcaaaccagcaaacccagcgacgccagcaacgtcacagacagtaaacctagattttaaccaagaaatcacacagccccgtttctcatgcccacttatgg

SEQ ID NO: 545796 - DNA, 139 bp, Homo sapiens
gtagttgggacggttgggccgtcctgctggtaccggcatccgaccctggtactgtagtagctggacttcacttggtggcacagaccgtgacgggacctggtttaccatgtggtggccctacaccggtactgtatggtac

SEQ ID NO: 545797 - DNA, 471 bp, Homo sapiens
  misc_feature (79)..(80): n is a, c, g, or t
  misc_feature (82)..(82): n is a, c, g, or t
  misc_feature (91)..(91): n is a, c, g, or t
  misc_feature (101)..(101): n is a, c, g, or t
  misc_feature (109)..(109): n is a, c, g, or t
  misc_feature (115)..(116): n is a, c, g, or t
  misc_feature (121)..(121): n is a, c, g, or t
  misc_feature (135)..(135): n is a, c, g, or t
  misc_feature (139)..(139): n is a, c, g, or t
  misc_feature (143)..(143): n is a, c, g, or t
  misc_feature (153)..(154): n is a, c, g, or t
  misc_feature (159)..(160): n is a, c, g, or t
gggggattgggtttctctggctttgggagccagtaacttgagatcaggaggctccatcaactgagttttacatttgctnngnactgcatgngtcctctccnggcaaggntgtttnngggtncgtgatggtcacgngggnttcnggggtcctcnntggcnnagattgctggggtcctcctgttcttcttattctctgcagtgggaactcatagccaaggagattcctcttggaactaagcttttccagccagaggtaaaatatttcctacctttttctatgcagccatccttgatttttgtgctccactcggctactgttcctttttagttgtagcccagaactgtcccagagctattttcatccatgaatagttgttaaattgttgtttttgtgagaggatgaaggttagcaccgcctagcttgctgtcttcctgatatcatctctccttttttatttaaactatttatac

SEQ ID NO: 545798 - DNA, 635 bp, Homo sapiens
cgggcagtaggcagttagcgggacggtgatgtagtaagtttgggggagataccactgtgcccggggataggggaaagaccccagatgttgtcattgttcctgggaggtggagatcctgtgccattggtggttggtagtgcatcctaagagggggcggcaccattggatgattaagggtgatcccattaggcctggggtgaagaaggccatgaatgggtaataccattaatcccattaactggggggaggaccagaggggtaaaagattgataccttggactacaaggagggaagatcactgggcttaggggaggtacccccacttgattcttttggggggactctgagatgcaatgaaaggccatagcattgcactatgaatgggcccttgttgagagggttcctcactggggggggggtctgaacagggtcctgcatggggaggggaggaactctgagggaggacaggtaatccaatgggtccttgaatgagggaaaccagctgtccctgtgtgagggacactgagaatggacagggcgagttgattaacccatgattggggcagaccactgtcatctgaaagggattctacgtgagtaagagtcatccaactggactacccagggcttgtaca

SEQ ID NO: 545799 - DNA, 812 bp, Homo sapiens
gactaccgccatgagtctctggcccagtacagagggccagagctggacacacggctcctctaacctgtagttcaatatacgcacgcaggacctagtattgtcgaaggaggaccaggtgtgtgaggcgagatgtggcgccgcagccttgaaggtgctatcgaccacgtcgagtaccaggacgaagagccgcgagatagtgaccagcgttgtatgaaagagtacacacggacctcccaggagctgcagactgaagcgtactgcaattgaggcctgtcaatgagacgtatcaagatctttgaagagcagggtcagagtcaagaagaaatgcagtaaggaatacctgtgagcgcttccggcgtgagggcatactgagaactgagatgcaaaggatcgctgctgaacctccgagtcggcgtcagagttccctgcagttgcctgacgtatccataggagagccgcatgaagctggcagcagctagctgcgggcccagggctgcggacgaagctagagtagatcgacaagcgcatgaagcagcctcaagccggagctcatgcagactgcgctaagatccgagagcagtacctcgtgtggctcacccagaaaggcgcccgggagaagaaaatcaacgagtggctggggattgacaggtgagactgaggaccaggtacgcaactctatggaggacgagggactgatctccctgaaccatcggaggaactgcggcttgttaacgctgggctaaagatcaaccggacgcagggctgaggatatgctgagcggcaagtgggatggaccttcctcatccgcgaga

SEQ ID NO: 545800 - DNA, 386 bp, Homo sapiens
atcccagcacgggtagataggtaatgtgataaggaagtagggtaaggatgagtggggaagaagaaagagaggaagtaaagtttaataatgccttttggggtggaggtgatgatggaggtggagattagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaccagtattgatatggtaaatgcgataatggaataccatggtacccattcgagatatacccattcgagag

SEQ ID NO: 545801 - DNA, 1282 bp, Homo sapiens
  misc_feature (206)..(206): n is a, c, g, or t
  misc_feature (449)..(449): n is a, c, g, or t
taattcatagttcgctttttgttcttcgacttccctatctatcttcttcttgctatcttataattgcaagactttttctaatctctacttttctggacatacactctttatttcctccttacatgtttcccagcgattctctcttgtggtttttcactatttaacccactatatcaccttgtttaaattctctcaatgtcttgctncttccttgagatatctaccgggtatttattattaggcctaaccacatcgttatcctcctaactatttctgtaaatctcactctttcgacacccgattttgttcacactctttgaaacagatgtggtttctcctatcgggcatggtgttcaacagagtgtagataataaatatgttttgttcatgcatgtcaccgcggctcttgtacaaaatcgtgccccttttttgggcacatgtgttcactntaaggcatacttggcacatatgtcacaaaaggccttggttctcattcttcaagaaaggggtatacccaactctgtctgtggctgacagttaactgtaccccactagaactaattaataccaatcccctagatccccattggaaaaaggggagatatgtgtaaccctggggcatcgaagggacagggttaaacccccaagttgccattttagttcaaggggaggtccacaagcactctcccaaaccagtgtttcaaaccttttatgaggagttaaatctgccagcatccagaacttctgctaaagatgaataatttgtttctccaattagctagcaaaatgtagctcattccctttaatgttacttcttgtgtatatatgcgggggaaccatctatcagagaccgatggccttgggaagcctgagagttgctgcccactgatccagctcctgagtataatgggggcttgtccaaggatctcattcaaggacatgggatggctctcgtctggacttattactggatatgtgggcagagagcctacattcagtttacctaatgaatgggcagacagttgtgttacttggcacatattaagccatcctgttcttcgttattacccgattcaaaactactggtactatctgtatattccagacttttgtatcgagaaagcactgtataactttttgttctgttagctgatagtatgtagcctccagtcacattcgctcatgcttacttgatctatcatgaccctttcacgtggaccccttagagttgtaagcccattaaaagggctaggaatttcttaccgccgggcttgctcataaa

SEQ ID NO: 545802 - DNA, 110 bp, Homo sapiens
tcaacagtggtaggcccagccacggcctccctgctctgatggtgttggacatccctggtaaacttggctgttgagtatttccattttgatactttagagcatcaaatttt

SEQ ID NO: 545803 - DNA, 845 bp, Homo sapiens
cccctccgctccaggcttccttctgcaacaggcgtgggtcacgctctcgctcggtctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgga

SEQ ID NO: 545804 - DNA, 129 bp, Homo sapiens
tagacagtgtgcggcatgatccagacatgcgagctagtacagtttgtgcagcgcgtcatgagcctcgacgaaaagcagctgtcccaccagttccccatgcctgactgcgcattctcgctacaacggttc

SEQ ID NO: 545805 - DNA, 1103 bp, Homo sapiens
  misc_feature (74)..(74): n is a, c, g, or t
  misc_feature (84)..(84): n is a, c, g, or t
  misc_feature (89)..(89): n is a, c, g, or t
  misc_feature (91)..(91): n is a, c, g, or t
  misc_feature (320)..(320): n is a, c, g, or t
aagcagtggtatcatagcgcacagtgcccattacggcctgggtcacagtaagtactttctgtgccgctactgtntatccgcagnccatncncctttctttcgggctaagccgccccggggactgagagttaaggacgagttggaggctttactgggccacagggttcctactcgcccctgggcctccggacaaaatggggtctgcggttggtgtcctggcaaaagcagggtagaagggctgcggggcgggcccagaatccgagcctgcagagatgggagcagttgcagtgttgagggcggaagaggagtgcgtcttgttntgggaactgcttcacaggatccagaaaaggaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgga

SEQ ID NO: 545806 - DNA, 1749 bp, Homo sapiens
cccctccgctccaggcttccttctgcaacaggcgtgggtcacgctctcgctcggtctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggaaaaaaaaaaaaaaaaaaaaaaaaaaaaaaaaaaaaaaaaaaaaaaaaaaaaaaaaaaaaaaaaaaaaaaaaaaaaaacaaaaacacaaaaaaaaaaaaaaaaaaaaaaaaacacaaaaacaaacaataagaaaacaaaacaacaaaaaaaaaaagacagggaggggcacctcaatgatcgcacaatcacagagaaacagagaacacaaaaacaacaacacaagaaaacgaaagaaagcgagaagcaggagagagagcgaccatccaataaagaagagagacacaagacaaacacactacaacaaacacgacacgtaccaaccgcgcgagcgacgagggcacgcaggggcgggagaaaaagacggcgaggacaggagaggcgcagacgagcgggagagacacaaaaaaagaaagcccagaaagggggcgcgaggcggcggacgaaaagcaggagagccaaacaaccgaacggcagacccagaggcaaggaaggacgagggggagtggatgagcattcctatcaacagtaaagtaatatagacaggagagataagagaggcaacagcgagagagaagagcggcaagacaggaaggagaagaaggaaacagagaggacggagcaaaacagaaaagagaagagactcgcccacgctaaccggaacagaaatataaaaaaagacaagagcaacggcaagcaaggcgaacagcagggggagaggaggaaaggacgaaaacagacgacaacaggcaagaacagacggcactcaaacagatataaaccgagaaagagcaagacgaaggcaacacaaaggacggcagagcaacacgagagaacgcgagagcgggaggcaaagagaggacaatgcagaaagcgacggacaacaaagaacgcaagcagcagaaaa

SEQ ID NO: 545807 - DNA, 871 bp, Homo sapiens
cccctccgctccaggcttccttctgcaacaggcgtgggtcacgctctcgctcggtctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgga

SEQ ID NO: 545808 - DNA, 703 bp, Homo sapiens
  misc_feature (7)..(7): n is a, c, g, or t
  misc_feature (13)..(13): n is a, c, g, or t
tgtgctncggtgntctagaggatcccagatattccgggatctgatagttgatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgga

SEQ ID NO: 545809 - DNA, 1847 bp, Homo sapiens
  misc_feature (397)..(397): n is a, c, g, or t
  misc_feature (527)..(527): n is a, c, g, or t
  misc_feature (564)..(564): n is a, c, g, or t
  misc_feature (574)..(574): n is a, c, g, or t
ggaggttttgactctcgtggcgccccagggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggcccaggtgagcgctgggccgggccccggcctccgcgcggccccgcatctccgtgaaggtcacggcggggaggctgcgggcgcgggcctgggcagcgcggaagcggtaccggccacccagcgtccccggtcccagctgcctgccgaccttgagcgtgtgggatcagggctgggcgcccacctctccgaacggcaganagcccgtccccagcgtgggggttggcgggacgggctagctgccgtggcggggctggggctttcccgaatggcgcgcccaggacggctcttgcggctggctgtccaaactgggcccgcgtcctgaagtgancccagcctgatctcggccagctgcttgtgaccttggnctgtcccagnacccttggtcacttcggtctgatccccggctcaggatccaggaacaccctctcctgagagcgaatcacggtctaggggtcagcggcggagagggatggggtgggtagtgggacagggtgtgcgtctggtgccctgcaggaggaggccattgctgggtggagaggtgggcgctgagagtcagatccccaggtagggctgggtggtgtcctggcaggcgctgagcggagatcttgcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgt

SEQ ID NO: 545810 - DNA, 767 bp, Homo sapiens
  misc_feature (42)..(42): n is a, c, g, or t
cgagctcaggtaccccagatatgtccggatctagacgtgaangtatagtaccggatgctactgtgtccacatgataggtaaaaagggtagctcccggagtctgataggtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgga

SEQ ID NO: 545811 - DNA, 1019 bp, Homo sapiens
tgcgtacccgggctcccgggaaagtgtaacggggaataaatcgtcgaccacaacgcagtacagagacattggccagtggggacatctgacatatcggtgttgatgcatgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgt

SEQ ID NO: 545812 - DNA, 1123 bp, Homo sapiens
cccctccgctccaggcttccttctgcaacaggcgtgggtcacgctctcgctcggtctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacacagccacacactgctgctcgacgagcaaagcgcacgcctcccgacgcccctgcacacgaaaccaacagcctaactgactacttgctaacactgtcgacttactgcgacacttacaccacacctgctaacccactactgcgcaacgccacacctcttctctttctggctgctcatccaacagcgcagcctacactggcacccatctggcttcttgcacaacttctgctaacctgctctctcctactccactaccaactaaacaccttactgcgcctttcctccgctctgccaaccacaccacacacacaacacaaaacaacacaaccacacacacaaaacaaacacacaaacacaatacaacaaaacacacacacacccctccacccaatctctccctccacacccaaccccacaaaaccctaccccacccccccactcgacacaccacccacaccaaaacccccactct

SEQ ID NO: 545813 - DNA, 1075 bp, Homo sapiens
ggaggttttgactctcgtggcgccccagggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggcccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgt

SEQ ID NO: 545814 - DNA, 403 bp, Homo sapiens
cccctccgctccaggcttccttctgcaacaggcgtgggtcacgctctcgctcggtctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatcagatcccgatatctgggtcct

SEQ ID NO: 545815 - DNA, 1115 bp, Homo sapiens
ggaggttttgactctcgtggcgccccagggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgt

SEQ ID NO: 545816 - DNA, 906 bp, Homo sapiens
gtcttcctgccgccattcttgtttcacgcgtatccactgcaccaatacatgcctcggtagaaaactactaaaaatcgttgccttgactcactgatcatgcgacttgtcacgtcaatgccctcaagagcgtgaagtacaatgaggttactcggcatagctagcaaattcttgagccatgtcgtactatgcaatcaacgctcatccaagcagcctctgcatcgcacatccaggtattccaactcactatggcgaactcatctgcacactaagtcacctacgttttggccggccatgcagctgcaaattggatgaacgaaccagtcaagtatagtcaaatacctacgcagtcggatatgagacctgaaaggtacggtacggctatgtccaacatatggcgtcttcgtgcaggttactacgggacgcttactagtagatcatctatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgga

SEQ ID NO: 545817 - DNA, 1186 bp, Homo sapiens
ggaggttttgactctcgtggcgccccagggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctgatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgt

SEQ ID NO: 545818 - DNA, 193 bp, Homo sapiens
agacctaactcttggtataattcagttttcttcctttcaaaagaagtaacgtttccctgtttgtcaaattttgtcacagtaaatactggggctacactggctaaagtggcttgagagacgtcagaggttctaaaccggtgcacttcacctgccacgcggagccggtcgggcaccgcaaacgtgcgcgctcggc

SEQ ID NO: 545819 - DNA, 1154 bp, Homo sapiens
ggaggttttgactctcgtggcgccccagggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgt

SEQ ID NO: 545820 - DNA, 1320 bp, Homo sapiens
ggaggttttgactctcgtggcgccccagggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggtacacgggctgcccatggggtggtgctggagagatgggggaagggctgacttgtgcttggaactaaggagccatggatctggtcctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgt

SEQ ID NO: 545821 - DNA, 230 bp, Homo sapiens
  misc_feature (109)..(109): n is a, c, g, or t
  misc_feature (171)..(171): n is a, c, g, or t
tctagagcgatccgccagtaatagactccttcgtgatctggggatgtgccacccgccttttccctgtacttcttcacgcgtggtagccctctacgttggactggatccngttccacgcttgcgccgatgtggaggccaatgtgccgccccttcaacctgcccctcccacangcgctggcgcgggtaccccgatgcctggactccaaaaccctcgtaggcggactcctcta

SEQ ID NO: 545822 - DNA, 489 bp, Homo sapiens
  misc_feature (481)..(481): n is a, c, g, or t
gtagcaggtggttaagggaagaggaggcctcaactgcataaccacattgtatgtgtccttggcatcactgcagtggggagcctggggctgggtgtcactggaattacagtcacaaagggtgttccaattccacaatcagctcctctgagaagccaagggcccggagcctcaggagatggggctctgggaagcagtgggtggcttggagagaaacccagaaagtcaccgtctggttgattcggacgtggttgcactgtcctcgatcctcagtcttaacctccctcttctcaggaccctcacactgggattcgtaagaaatgtggaccccaggagggagtgaagagtgttcaagggtcacggtggaagacaggctctatgggaagagagcgagtggataaccacgtgaaggcagaaaaggactccaaccccaccttatgtcctctccaggtgttcccaattctgccagcaccctatccacaancacctgcg

SEQ ID NO: 545823 - DNA, 714 bp, Homo sapiens
cttctttaggccagtcaccctttcccttcccatagcccttccactctgggacgaacccatttcccgcacaggattttctttccacaagggcccccgctacatagtgcgcctctcgcctctcgcgggataattaacatctatcatggggggggatacatatgggggtgagaccgcgaggactgctgccccactcacaactcacgttgtaggatggtatccttgggggaagtatgacacgtctctcaaactcatcatcacaaagccaggggtgagacacatcactctacaatgtcccactcttctctcccagaaccgaggggaagactacgactcttcctacacacgtgttcgcgcgcccacgattttctgtgcgctgaactccacacacagatagtaataaggtggcgtacctgtcagtgtgttgtctcttccttcacacacggcgtggcgggtgacacacccaatacaccatgatggattctcttgattaagaatagatggtcccgcactttagtcaaatcctttcgtagtcagtgcgtggcgcaccacgtggagtgcacaagcgcgcggagagtctcccgcccactcactgggagacgttgggtatgacgaggccatccttgggagacgctcctgaggatgcaaagggcctcgcctgcgcgccacaaagagggtagccccgggcgcgcctgcacaaacaaaagcaagaaaaga

SEQ ID NO: 545824 - DNA, 415 bp, Homo sapiens
ctccttcatcatcacctcacgtccttcatcatacctactcttccttcatacatacctacccatccttacatcatacctacacttactatatcatacctacccgtcctttatcatacctgccttcttatactttcttttctttcttccgcgtgctactatgcttcttacctttaaaacttccttatactgcttcttaccttctaagcttaatcttcttcctcttcttattctggcttctccattcttgatgcttattcttctttcttctgacctcctcttatctaactacttagttcttcctcttactttccttcttccttctttctgcttcttttacttttgactttcttctttccttcttattcttcctctccttcttcttaggacttctttcttctggtaggtatcatggagg

SEQ ID NO: 545825 - DNA, 747 bp, Homo sapiens
gggtgctctgaggatccccccgtccgatggctatgcccgtcccgtccgaatgcccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgt

SEQ ID NO: 545826 - DNA, 705 bp, Homo sapiens
cttagagtttgacgatgggaggggccatggcaatggcctggccaggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgt

SEQ ID NO: 545827 - DNA, 410 bp, Homo sapiens
tcgattctttatctgcatagaccatccattttttatgtctcccgggagataacacatgtgatatttgtcaaacagtgcctggcttatctcacataacataatggcccccagttccatccatgtggctagcaaatgacaggggtatgataaaagtaaagggcctaataatgttacactagatgataataatataccacattttctttatccattcatctgttgtggacacttaggttgattccatattttggctatggctattgtgaatagtgctgagataaacatgagagtgtagatatctattcaatatattgatttcctgtcttatagatatatatccagtactggaattgcagggtcataagaaagttctattttctattttttaaggaacctccatactcttcttc

SEQ ID NO: 545828 - DNA, 516 bp, Homo sapiens
tctccggtggatcgattatagccacgtactctggtgatataggtcggaaaggtatagcaagcggtgttcagttgtcggcgaaccgaggagtacacggatcgaggacaccaactctcccgcatgcactgggatcctcaagacagtgctcgaaactcatgggcggagtgcgcacactgaggcatacgcatgatgactgtgcgagaataagagacaatgcctcacgcatcagcagccttccctcttggagaccataactttctgagtggtagtgtagtgaactgaactccatggttccctattgcatgcagaccaccgacactctgtatggaatctgctggaaagaccactcggtgaaagaggccatgtcataacattgcattaatctactaagtcaacgaagacattggtaagcatgccgcagagaacttcagatgacactcaagctaaggctgtgggagaggactaggcttatgtggtctagtgagcattcgtacctgagtgattgggcttcgggcc

SEQ ID NO: 545829 - DNA, 1234 bp, Homo sapiens
  misc_feature (742)..(742): n is a, c, g, or t
  misc_feature (786)..(786): n is a, c, g, or t
  misc_feature (792)..(792): n is a, c, g, or t
  misc_feature (796)..(796): n is a, c, g, or t
ggaggttttgactctcgtggcgccccagggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccacctttttttnatttctttaatttttttactttaacccttacttttttttttttntttttntttncatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgt

SEQ ID NO: 545830 - DNA, 491 bp, Homo sapiens
gatctcgctgggaaacgtagcctattttttcaccggctgccagccatctggcccaccccaccctgttcaatttcccttctgctctttatcttttcagctatgactgactatatcagttaatttacttgtacgtgtcctctctgctgtctccttaccctgctcccctacaccatgtatttccttcctttaccatttcctccttggaattgtgctgtgtttcgttgtcctggaggacagaagagcaggttaaggcatgagcatgtgtgtatcactttgaagaaagagaaaccaggtattctgctacagtttggagaaaaacccaatgaaggaagaaatgaaagctggctctgcagagtgccttaaaaatgactttaattaggaaattctgagttgtcagtcttcagatgttacataaactcaaacagatgttgcatttcacttctctgggattaaaaaaagttaaatacagtgtgtattcaacaacaacaaca

SEQ ID NO: 545831 - DNA, 941 bp, Homo sapiens
ggagtaatctattactcgatctttccagagaaaaacattcgtggtcttcaagctcccagtacatcacctcaaggccgtcctgggggaggcccggatgctcaatgccagcattgtggcatccgttcgtggagctacgcgctggtgcagcgatagtctcaccttcgaatgcgctctcagactgcggtggtaggcgtgcagacctcacgcgcgcaccgagtccatgacactcctcccaaggacacgtgtgatagcccggagcgtgctctatggtgtccttgagtccatgaggcaaagttgtgcctgaccgacgcctagtgactccgtggtactagagggaaacgagcttgatagcgcaatggagaaggtgcaccagtcacgagagcctgaccatttctggggaccccatggctgtgagggcacgagggaccacggggtcgaccgaaggttttgatactttgcggcagtagctgtgagcgtccagtctagtgggggcgataggcaggtgtccaagaagagtatggatcacgcacactgaggcggcggtgcgagatatccgtgtcgagctcatcgacccacaggcggaagaacaggtgcagctggcctcaagattggaccagtctctctttccagctggggcctctaactcaaggccaaaattcctcccgggcgtctcggaaacgcagcagtaggaaccagaggatcgggagcacccagagaaccccatgggtccccaagcagaaatggcataagccccggacccccgtgttggcgagcccgggagatgcacagcggcaatggaggcctggtgtgaactaacctgagaaccaggccatcaatgaaccagatgagcctgactcgagctaaccttcgatacggcagaagtcttggcatccgcaggcggggaacgtgggccctgcccaaattggcccgggctgatgttg

SEQ ID NO: 545832 - DNA, 260 bp, Homo sapiens
gcaatccataagtgtccttatctacaaagtgaaaagttggacaagatattcttcatgatctttttcgattttaaaatgtcatgcaattttagagaaaagctgaagggtcacccaatatggcgcgacaccaaaagacaaatacgaggacaatcactttttcactttccgcaaactatgcctggacacttccttggcgagacttaatacaccagacaagaacacactatgaatgcgagacagagggagacagaggcgaaata

SEQ ID NO: 545833 - DNA, 460 bp, Homo sapiens
cggtgatctagcaggatcccgggagccttacctgggctgctgacagacgtcggcagggctggagcacctcgcgttggtgggaagggagggcctgtggcctggccgagttgctggccaatgtggccagttccatcctgagcacatacgggctctctggcagcagtgcaccttttcaccgccaaagaggtgtccttctccaacaagccctacttccggggtgagttctgcagtcagggtgtccggtgagggcctcatcgggggctccgtccactctatgtgccagagggctcagagcttctgcgacagccctggggagaaggggggtgccaaacgactggccctgctcgtgcttgctctcccggcctctggcctgggagtaggagagggccaccatctcctacatcctcactctcactgatgaacagtttcgggtgcaggatcagttcccagtgacgcccgt

SEQ ID NO: 545834 - DNA, 626 bp, Homo sapiens
agcggggggggtgaggggaaggaggagggaagtaggacttcaacatggcggactgcggcactggcggttggctacggtgacggcactggcccggagcgggcacgagcttggaggctgggtggcgttcgctctccctaggggcgtgtcgggagctcagcggggaccgaggcctgggaggccggccggtgccagcgagcctttcggcgttctgagacggcggcagcgagcgggattcaggttctaaagtggcttctaagaagttgggtgcacgattttcatgggcactttcagttaccttgatgatgtcccatgttaacgacaggagacgacaattcgaaaacaccgagctgaaagttggtctgagcctatggcttcgtccttgcctgattgtttgcaggttagtcagagaagtacagtatgacttctctttggaaaagaaaagcattgagtgggctgacagagatttaaggaaagatcgaagaagccgagcgggaagcagagtgccaaatagcggaaggccgaagctcgagtgaacttctaagagtggcccagagggcgattgcagaatgagctgctccaaggactcacgagtacagccacggatgccacctccgtattaacgccca

SEQ ID NO: 545835 - DNA, 1019 bp, Homo sapiens
atttatttacagtgaaaggcaagattccgcaatgcaaaggcaacacgagagactttttcctaccaattttctaatgaaagccagtgacagtttttttttatttggttctaagtttcatttgcttaaaatgaaaatgtattcttaaaactaaataaaaaaatatcatattatcagtatttctggctgcaagtgaatgaatacttattctgaaaagacccgtctgaatggccactctataactaccgtgttttgttagaaaagtatattaaaaagtagaaacagcatcatgaatgaagaaaagggatagaaacaaagtataaaatatgtaatcttttaaaaggaccttatcaaggagaatcttagtgaaactttaaatgggagattcatacaatcccaaagctttcttatttcctattcaatgaataatttactttttagatgagattcactaacattattgcagaataactgtaattgaaaattattaaagctctatctttattgcattttaaaactcgtgcattaggtgtttgaccaggtctgcctcatcattaagagtttgaagaaacgcaaaatctctgtctcccaaagaataaagagcaaaaacttaatagctttcttgtttcccagaaagatgctaatatgatgaactgaatgtcaggaataatagattaaatgaggtgtaacctgggaagagaaaataagaatattttatgtaaatgtcacagaacctcaggaactctttgatattatctgctggatttgactgttcattaaagtaattagggttaagaaggataaagcaaatattctttaaatttagagaaatttcataaaagatagtggcggaagattccaatacggagcaaggacaggacattccaacgaaggaacaacacacagaaacacaacaaggggaaagcagaggaaaataaacgaagaatcggaaacagagaagaacgacgaggatcacacaacgcagaacgaaacgacccacaaaaaaagtgagcacacaacac

SEQ ID NO: 545836 - DNA, 454 bp, Homo sapiens
gacgccgcatttctaaacatacatttacggatcgcatccaatccgttgcttcggccgcgcggtcgaggctagacaacggccatccggcaagcctcccgcccccggctggggagtggccgtagcccacgatcagcgaagcgggacagagctgtccgaacccccatgggcctcatcaagaccatcggccgcaagccgggcgtccagcggatcctcggcgttgccgccgcgggctatctccggctcgtgcggcgcaccaaccgcttcaccgtggagccggagggcgcctatgggcgcctcgacgcgacgggtccgttcatcgcggcgatgtggcacggccagcacatcatgatctcgttcatgcgccgcccgcaggacagggtggccacgatcatctcccgttcccccgacggcaacatcaataccctggccctgacccggctcggcgttcgggtga

SEQ ID NO: 545837 - DNA, 256 bp, Homo sapiens
  misc_feature (39)..(39): n is a, c, g, or t
  misc_feature (238)..(238): n is a, c, g, or t
gaattcggcacgagccacagaggggtccatacggcgttnttctggatcccgttgtaacttaaagggaaactttcacaatgtccagagcccttgatgtcctgcaaatgaaggaggatgtccttaagttccttgcagcaggaacccacttaggtggcaccagtcttgacttccagatggaatagtacatctctaaaaggaaaagtgatggcatctacattataaatctgaagaggacctnggagaagcttcttctggc

SEQ ID NO: 545838 - DNA, 232 bp, Homo sapiens
gcacacctcctacttctcatatacccatttcgtaccagaaaatttgaggctgggcacggtggctcacgcctgtaatcccaacactttgcggggccgagaaaggcggatcacaaggtcaggagttcgaggccagtctggcacacatagtgaaaccccatttctactaaaaatacgaaaaattagccaggtacaggccgggcgtggtggccacctgctcaatcccaggtcgacg

SEQ ID NO: 545839 - DNA, 256 bp, Homo sapiens
aattttgaggattcctttacccctttttgatttcctggaaacagctgcctgcctgcattgcacttctttttcccaggagtggggttaattttaaagtccagttatagtttggatgttagtatagaatttttaaattgggaatttaaaatcagggctgggggctgggaggcccaaaatttttgatccccttttttatggatgtgtccccccttttttgtccaaataaaatgttttggaggttttgactccttggtta

SEQ ID NO: 545840 - DNA, 547 bp, Homo sapiens
  misc_feature (185)..(185): n is a, c, g, or t
  misc_feature (208)..(208): n is a, c, g, or t
  misc_feature (251)..(251): n is a, c, g, or t
  misc_feature (298)..(300): n is a, c, g, or t
  misc_feature (302)..(302): n is a, c, g, or t
  misc_feature (320)..(320): n is a, c, g, or t
  misc_feature (418)..(418): n is a, c, g, or t
  misc_feature (461)..(461): n is a, c, g, or t
  misc_feature (470)..(470): n is a, c, g, or t
  misc_feature (486)..(486): n is a, c, g, or t
  misc_feature (528)..(528): n is a, c, g, or t
  misc_feature (533)..(533): n is a, c, g, or t
aagaaccataaggaggcttgtttgcccaggggggaacggagagaggcgggcgagacagaacagaacaccgcccacagccgaaacccaccgggggaccaaatacaggggagagaaccacacaacggaagaaccgcccccaggacaaggggaaggggccaaaacggcaacaccaaccagaggggagncaaggcagaggacccgagagccngggtctcccagactggaaccgcgcacccaggggagggcatccnaacggggacccccccaggaggcggggaagacaggaaacctcctgtcnnncncaagaagggggatgaagnccagcgtgagagtgaagaactaggggccagcagcaacaaggtggtgggaaggcaccggcacaggcccagcacataggatgagggcaacagctcccacncagcccagcccaaaaaaaggcccagtgacaggtgtggacaggngccagcccngcaagccgcctcttcncggtagaagggagaaggacagagctctcttcaagaaattcgncaggncaaagcagcaaaaa

SEQ ID NO: 545841 - DNA, 175 bp, Homo sapiens
attcatcaaatgggtcagcagtttttccctcatttcacagcgtaggctgtggcgggggctcacgcctgtaatcccagcacttcgggaggctgaggcgggcagatcacctaaggtcaggagtttgagaccagcctggttgacatggtgaaaccctgtctctactagcaatacaaca

SEQ ID NO: 545842 - DNA, 294 bp, Homo sapiens
agtgcttggggacagtcctgtgcgagctgaaaccgtcactggggaggtgccggcaacacctgtgaagagagaacgcagtggcacagagtagcagtgatgacttgatttgaagagctctaagagcactgaaaacttatatgaagtagccttgggaactacttttactactactttactacaggtttctactcactggacgtcagtaggcacgtggactacccctacaaagggacatactattgctgtgccatataccagaattccgtttgctattgacaacttctaaaactacgg

SEQ ID NO: 545843 - DNA, 758 bp, Homo sapiens
  misc_feature (640)..(640): n is a, c, g, or t
gactagttctagtcgcgagcgccgccctttttttttatttgtccatggctgattccttaatttttagtagttcggacctgtgggacaggagaccaagaacacgatgaactgaaagtaagagaaagaaggacacagccaaggagcaattaaaagaaacagcaagcggcaagaagagagacacgcggagaaaaaacccaaaagcgaccagcgaaaacaagacaccaaagacacagagaaaccgcacgagaacgcagccgcacacaccgagcaccacagcacaccagccgagacgagcaccgcagagcaaagaagcatccacaacaagacagcacacgcaccacaggaccaagcaagcgaaaacaaagcaagaagataaagcaaaagcacgacgcgagcgaacagggagacgaagaagagcgaaaagtagcagaacagaaataccagaagcagcgactcgaagcacaacaagcgagcgagctagacaagacgagagacaccagcacacagaacaacgtagacagagacacgagcgagcaaagcaaagaaaagagcagacgagcagagcagcaaatgagccagagacagaagagcaagagacaagaacacagacaagagagcaaaactaccggagcaccagcanatacaccacaagaagcacagacaagaatcaagcacacaagcacagacgagagacgacaaagacaggacgccagccacaaggagcgacggagcacagctacatatcgaactagcgaaac

SEQ ID NO: 545844 - DNA, 608 bp, Homo sapiens
ggggctcttctatttctaattgctccttccatggccgcttatcgcccttgttcgcggtgttatgtctgtgtatggaaattatctagggtcatcatttgtccttgcgcactgtgccctttgtgtttaattgtcttctcttgttgcctttgaagattattccagtaagagatcagcattccgtgactattgttcgcaccaggcatggtcctttgaactaattggcctcaagcagtcctctcgatcctcccgccttggcctccctatagtgctgagattacaggtgtgagccactgcatctggcttactgtacttattgtctacttgtcatgtctccactagataatgtaaagtcttagagagcaacgaatttttgtttaatttctgttctcttcctcctttcctttcttcctgctgtttacttcgttcagcctactgtattccacatataaatatattatggcatatagtaggtgttcaatatgttgaaggaatcgatagaatttatagacttgagttgcaatatacaatgtatttattatctctactgtgagttatggcaaaaaaagttttgcaagccgcttcataactaactgcggatgtccagtgct

SEQ ID NO: 545845 - DNA, 370 bp, Homo sapiens
gacctccatctcaagaaaaaaaagaaacataaaaaaagaaaaagaatgtaatatttaaagatgattttactgtgtaaaaagtggtgttccatttattatcttagcgctttgtgttatcatctcaatgaattactgttagttacaaatttgattagccctatagaaatcaaatgcacccacctgaccaacaccgtaaaaccccgtctctactacaaatacaaaaattagccgggcatggtggcaggcacctgtaatcccagctactcaggaggctgaggcaggagaatcacttgaacccaggagatggaggttgcggtgagcaagatcgtgccattgcatctagcctaggtgacagaacaagactcgtcga

SEQ ID NO: 545846 - DNA, 682 bp, Homo sapiens
taacatagttaagtaacagaactggattgagcaacaaatgagatgcactaaggtctgtaaacattataaccctaggtatgtaggtgagtagaagggtgacctaagagcatgctaaagtaagtgatatgtcatatttatggggctattcaagaccacagtcaaagaataagaacccaagccgtgagtaacatggcaaaatcccatctgtacagaaaacacaaaaattagccaggcgtggtggtgcacacctgtagtcccagctgctatggaagctgatgtgagaggattgtttcagctcaggaggcagaaggtacagtgagccgagatcatgccactgcactcgagcctggacagcagagtgagaccctggcttaaaaataaagacaagaaggagagagacccatatcgatgaaatcttagtactaaaccctgatatcaaatacctaggtgacaaggcaaaaaggtcaaatgtgctagctacttggcctagttattcccaaggtcccaggtgtcagaacacgatttgagatacagataagccataaaattgtccatagcaattatctctaggcacgcagagacttgcaaggacttggccacgatgaccgtaatcacggggacagggccttagcctactgtgctgcatgtgtgccgtgagctgagataatgtgtggtgatgcgg

SEQ ID NO: 545847 - DNA, 284 bp, Homo sapiens
  misc_feature (97)..(97): n is a, c, g, or t
aacgggcagtgaatcgagctcgtgtaccaggcgttgcttgtgttggcaggtgaaacagcgctcacacaccacagaacaaaacagcaaaagtgtagantaacgacatgtgtttccagagcaataaatagaaatgggggaaattacaactgttttggaacagtaaagatagtcagacaacataaccaagaagcaactaaggctcagagccagtagctgttgcccaagggtcataagagaactcagagccaggccgggcacagtggctcacgcctgtaatctcaaca

SEQ ID NO: 545848 - DNA, 458 bp, Homo sapiens
ctagctacaagctcaagtgtagacgtgccatcataagactcttaccacgaagaggcaattcatgaagatcaaaagaggaacaaaatacacagcagctagaaagtaaagacgtgtctgaatcaatggaatctgtgctgctgtcaaaagttatggaacaaggagtaccagaaaaggcagagacaccacctcctgttgaaccagaagacgaagacgatactgaggactgctggactaggaggacgggcagggaacacttcattgcacgaccttttaccacgctattaaaccacggatactactttcacaaacagtctttatattaaatactgagtacatattataccctgtcccggacacgagacttaggcagacagatagtaggtaatgtgggactcagaagcagcttatggtttacgataggagagagttgacagattctttcacgttgacaggaagga

SEQ ID NO: 545849 - DNA, 85 bp, Homo sapiens
tggtgtaaacatatagggtctgggtcttcgcagtcccactggatgcctgagccccgaagcatcactccactaaaaccatagttaa

SEQ ID NO: 545850 - DNA, 475 bp, Homo sapiens
ccgttgctgagaacatgatcagagtacagaccaactggatgtgttgaggaagagacgctaatgctatggtgtgagttccaatgtgccatcagactgtcatgagtaaatgttgcacgtcgatgtatactgtttcaggggcatttgattcactatgtgcatgaaatgttccatcctcccctggcttggactcacgcttctgttgtcggcagttttcatatccttcttggctctcttgccagaagctgcatacctactgacgctgttgtcttcaggtattgcggtgatttcattacgtggaaaagccatggcaataatctgtgatagctaggttatacactttttcaaaatgttctggtttctctcctctcttggctctgtttcagacaaacttaagctggtgattttccaacataatcagatttctccttgcacttccttttaatccaatcattaacaagccattcaagcccactga

SEQ ID NO: 545851 - DNA, 738 bp, Homo sapiens
cgcacggcgagccgcggggggttcggatgctgttgataagagtaatgaatggtgaataactaccaggaaagtaatagatccaacagacagtataacagctaattcacaagtaaaacaaatacagtcagagcctgaaagtatccgtaaatggagagaagaacaaatggaacgcttggaacccttaaaccaatacacaaaacaagaagcagagtggaaagaaaaggcaataaaggagctagaaagaatagaatatgaagacaggacagagcagcaacaagaaaacaaaagcaaacaacaagaagcacaaaaaaaaggccgaagaaaaaaaagcaatagacgaaacggccccaaactactaaagaagaacaaagaaaccgaagaaatagagaaaacctcgcaaggacaagcaattcgaatgcatagaatagaaacacccgtgaagcgcgactggaccacaaacagggcctagaaacgaaaccccgactaggaacagcgaaatgagaggcatgccaagtggaagacaggaagcagacgaacgggaaaactgaaagaccgaatgcatggaaaagcactaacacagacaatgaatgaaaatgtaaaagaatggaacaatgaaaacctgaaccataggaacaatagaggaaatatcattgtttgtgattgcatgtttccttccttcaactgtgttctccctggcattcagagaggagggagaggaggaagaggaaggggagggaa

SEQ ID NO: 545852 - DNA, 201 bp, Homo sapiens
ccggtttgagcggtctcattgaggcgcagtggttaacgaatccactgagaaccatgaggttgtgggtttgatccctgcccttgctcagtgggttaaggatccagcgttgccatgaactgtggtgtaggttgcagacacggctcggatctggcatggctgtggctctggcgtaggctggcagctacagctcctattagaccc

SEQ ID NO: 545853 - DNA, 153 bp, Homo sapiens
cacaaacttcaggaaaggattatgcactcgagcagaccgggcgagcagagcaagaagcagtctcactgtgtcgcccaggctggagtgcaagaggcatgaactgggctcacaactgcaacctccgtctagagtgctcaagcgacacatctgtcg

SEQ ID NO: 545854 - DNA, 187 bp, Homo sapiens
tttttagtcacaaccatgttctgaacagaaagttgatgtttccattctccctagaagtaaactttgccggctctgtggccggttttcttttttactcttgagtcaaatcatcaaggctggaaaagctggtgacagagttttatctacagcaggctcagctttggtttgagcagcaagtacaccaaga

SEQ ID NO: 545855 - DNA, 84 bp, Homo sapiens
agctgtacgattacttcatctaacggtcccgtggtggctacacatcctgggcaccctgacttctggggccttccctctgtcttc

SEQ ID NO: 545856 - DNA, 119 bp, Homo sapiens
agatctctccgactggcagagcgtggtctgtggaagggtctcccttctcgggctcggggatgtcaggaggggagcgtgctggagggcagcgcgagggcgcgctcatagcacttgcagag

SEQ ID NO: 545857 - DNA, 913 bp, Homo sapiens
ggaggttttgactctcgtggcgccccagggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgt

SEQ ID NO: 545858 - DNA, 476 bp, Homo sapiens
  misc_feature (417)..(417): n is a, c, g, or t
  misc_feature (449)..(449): n is a, c, g, or t
  misc_feature (473)..(473): n is a, c, g, or t
cattgtcaaaagtgaaaaggcatacatccttgtttctttaccttgagggtgcagccctgaagagtgaagacagtgacgagtgatagagcacaggaaacactctaatagtgaagtatggtccccattatgatgttaagaagaaggaagtaaacaatatggatttaaggagcataaaaaggggatggtaaatataaagtaataatgacaaaaactatctgtgaacaaaaatgaatgctacaattaatcttagaagggaagttcaggaaaagctaaaggaaattgatagtttaataaggaaaaatggggcagagatgtttggatgggtcagaagttctgggggttcccagagcttagtttaacacatccaggtttaggaggattccttaaaggtttaggatggagcctttttttaggaanttccttcctttaaaaaaggaaagttttttccncttgccccctttcctttccccccntgg

SEQ ID NO: 545859 - DNA, 1255 bp, Homo sapiens
  misc_feature (132)..(132): n is a, c, g, or t
  misc_feature (561)..(561): n is a, c, g, or t
cgctcgttgactgtagtgtgggggggggagtgttccagatcacggttggggccacctgtgtttttgtttttgagccgggagatatatatctctaaccgtttctctcttcgtgaacagcccctgttcgggggngttgatagtttcacataaatttttttggggtgtttttgccccgcccataatggggctccgtgtggctcctataagagcctcaccggggttcatccacctctgatgtgtggtcccccctcggggtggttgcccccgtaatatgctcggttaaaaatttggggtgcccccaattgtaagcaagccttacactcgttcaccttggggttttacacccacctttcgaggatgtttcacatgtcgctgtcgctgttcccctgggctctccgagacacacctctttcgggtgacacacacatttgccaaagggcacacttcacagagggtcaccaccgaggttctcgcgggcacagaatcggtcaccgcacacctctgcacattggggagagccccacaggggccccgggcacacacagacacacacaggggctnttcacacagtggagagggcacacccgcacaggggccccttgggggctcgagagccaccgcttcttccgtgttgtgttcacaggcacagctgatatcgcacacttgtgctgtcttgtcctcttgtgtgttatcgtgtgtgtggtgtttgtgggtgtcttttagtgtgtgttaaataattgtaatgtctgtgtgtgtatagagagacacacaggcgctctcttgctgtctctgtgtcgcctcggggtcttggagagaacacacactgggcgcacaccacttcactaggctgtcacactgcacgctctcccaagactctcctcggggctacaaaagacagagtcctctccccgcgctcacagcctctctctcgaggttaagctcgggagactacacacaggtggtggcacaccacaccaccacacccacagccacaaatcacgccacttccttcccctctgagagttcattcagagaaaatacacttaggagaaatgtgtttagaaatataaagcacacaaggcacgggcacgtggcttcaacgccctcgtgtcattcccacgcacacttttgggaggccgcagacgggaggatccgcttgaggtcacggagatttgagacccacctcggccacctggccaaattttgtctcttttttttggtattataaaaaatcataaaaattaaagaaataaat

SEQ ID NO: 545860 - DNA, 981 bp, Homo sapiens
ggaggttttgactctcgtggcgccccagggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgt

SEQ ID NO: 545861 - DNA, 133 bp, Homo sapiens
tatgagcagcagcaggatactgctgacattgccattgtggtcccagccaccatgcccattgtgagcccgttgcctctaggaggggggattggagcagggtacaccgttgcaggcatgccgttgggctgcagga

SEQ ID NO: 545862 - DNA, 223 bp, Homo sapiens
  misc_feature (91)..(91): n is a, c, g, or t
tctaaggatcctggcgcggatctcagagagacagcgatggggagagatgagacgagctgtcccagccaccatcacttgggagcggtgaccnagaagattcctctaaggataggtgcagggtgctgagagatgagctgacctggtacgtgggcagagagagtcagcacgagtcgacgcaggagaaggggggaggagagcgttgatgacaggaatccggcggcga

SEQ ID NO: 545863 - DNA, 1417 bp, Homo sapiens
ggaggttttgactctcgtggcgccccagggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggtacacgggctgcccatggggtggtgctggagagatgggggaagggctgacttgtgcttggaactaaggagccatggatctggtcctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaaggtaaaagggttgggaggccatggtgggtatcagagaagggctgggagctgggcagggctcctccccactcccttctctgagccttccttgtctgcagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgt

SEQ ID NO: 545864 - DNA, 280 bp, Homo sapiens
tggaaggataaaccataaaattaaaaaaaaaaaagatttcatctgaaagagtgagtagggtagaagagtcaggaatatgaacaagaatcctctgtagaatgacttcaaaattctacataattctgtcacacaattatagataaatttaaaaagcagtaattcttaaacaataaaattttttttaaaaaccaaatgagctgttggtgtaattacacacagaagtgagtgtaataatttaaaaacacagtaatttgactgtcatccctactatggtataacc

SEQ ID NO: 545865 - DNA, 179 bp, Homo sapiens
gtatgtaataccagaataagggccagatatacaggcactaggcggtggaggcatatacctgggcccaggtcacgtagccaaccatctacctgtacctagactatcacggacaaggcgaatactatgaagcccaggcagcaggggtacatagaacagggcgtagaaaacgggacccagac

SEQ ID NO: 545866 - DNA, 984 bp, Homo sapiens
cggacaccaatagggctaggtactgaggccctgggtttttgtgctggagtgagtgcaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgaccgtggatgcttgcacaccccgccagcatatcctgtggtctcacctcgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgt

SEQ ID NO: 545867 - DNA, 257 bp, Homo sapiens
  misc_feature (49)..(49): n is a, c, g, or t
gccgtataaatagccgacgcaaatggtatgttgaattcttaaatagtangacttgaaagtcaaattactccttgatgcatgggcttcagaatggattatgtgttagcagacataaaaacaacactaatttcattgcacatctccatcagagctctttgggtgaccaggtagattgtcaatgagcaataatcccaggctaggggtcaaattagagctacagctgccggcttataccacagccacagtaactcgggatc

SEQ ID NO: 545868 - DNA, 1117 bp, Homo sapiens
  misc_feature (1057)..(1057): n is a, c, g, or t
ggaggttttgactctcgtggcgccccagggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggtacacgggctgcccatggggtggtgctggagagatgggggaagggctgacttgtgcttggaactaaggagccatggatctggtcctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaggtaaaaggataggaggacatggtggtatcanaaatggctggagctggcaggctctcccactctttttgagcttcttgttgagagtgatata

SEQ ID NO: 545869 - DNA, 687 bp, Homo sapiens
ggaggttttgactctcgtggcgccccagggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccaaaaattagccgggcgcggtggcgggtgcctgtagtcccatctactcgggaggctgaggtaggagaatggcttgaacccaggag

SEQ ID NO: 545870 - DNA, 315 bp, Homo sapiens
  misc_feature (15)..(15): n is a, c, g, or t
  misc_feature (98)..(98): n is a, c, g, or t
  misc_feature (150)..(150): n is a, c, g, or t
aaaaccccccccggnggtggtttttttccccccaaattgggggggggggtttttccccttcttccccccccaaggcctttaaaaaaagggccctctcnccccacaaaagttatgtgggtcccccccccccccccctttttaattcacggnccggtcaacaggaattaaaattttggaaatttttcccccccccccaagaatgtaaactccatgaaggcccagacttttttttgttttttttttctatcccaaaagtaagaccacacttgaacctggcaaaaaggagctgcttaataaaaacttgtttgtcaatga

SEQ ID NO: 545871 - DNA, 597 bp, Homo sapiens
ggaggttttgactctcgtggcgccccagggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagcttaaggaagcttggcttccggaaggttggaggtaaaaagccggcccccaattgaggttgggggaaattttaatccgcccagggagcgttgttgggatt

SEQ ID NO: 545872 - DNA, 159 bp, Homo sapiens
tgcggacccctatcccttcttatatagttttaagcggggagaagacagaaaaagactcgattttcttcccttccactaccataacaggctaaacacaccgcaacacttagcttagcatttcttttcttttcttttttttttgagaaagagtctccctct

SEQ ID NO: 545873 - DNA, 332 bp, Homo sapiens
cacatatataggtaaagctctaagactcctgagacaacttttatgtaactggcttacctaggggggggcttgaactaagtaaagaagccaaggagtccagatctagatagcagagaagtacgtctcatactaaaacattgcaactactgttagagtccaccccttgaagctgtaacagatggtgtatcttagactgaattctataagtatatatggtaccagcactaaaacaaatgttgctcagctaaggtgggctgtcgcttgctcagtaggaaatagacagactccagcttacaccctctgggaagcacttggacctacagtgccaaatg

SEQ ID NO: 545874 - DNA, 957 bp, Homo sapiens
gctaggccgtgttggggaaatgtaattccgttgttgaccatgggtccatgagtgccgtcggccttcgatcattatgaacgcccttgcgtcatcatcaaggatcatggaccgcaagtgcagtatggcactgtgaggcgccatcaagtctcttattcagtgggtgcacttagggtggtactgcaaataccttgtgcggatccaatcagcgttggcccaaaatgagcttgatacagatgtgagttggaaaagaagctggcgcaattgtagactggtaagctagttgatgggctggccaccgatcattagtgcattgatggatgtagttcattcagattgccaggctagatggtggaacttgtcgaagtcctccagcagattcgtggcatcgttcccgggccatgggaaaccaaccagggagggtgggtttgtcgatgataaaagatcgcttagcttgagcaatgaagggggaaccagtgtgttaacagcggaggagattgcatctcaaattcgagaaataacgcctgatggctttattaaggcaggagtggtccggagtccgtttttaggtagcaacctggagccagaggatcgagaagaatacgttgacgttttttcgacgataaaaagagcgaacaacgcgaacctgcttgtttttcaagaacaacggtaaacaccagagctggggttcacaaactgtgcttccacgccgtgcttgtctgccgtcacgggatggttgagagatcggcgcggtgaaaatggccagccattcagtggtgaccaaattatggagcgggaagaaacacatgtctctgtgaagcttttccaatgtagacaaggccaatgtggggagacgcctgtgggaaacagtacaaagtggttaagggggctgtgtggtgagaccacggattcactttccccacgcgatgttcgaaagacgtgggatcctcagaatggcgc

SEQ ID NO: 545875 - DNA, 909 bp, Homo sapiens
  misc_feature (909)..(909): n is a, c, g, or t
gcaaaggtcgtgcgtgagattggaggccgcgcggggtcccatggatctggagccatgtctggctgtgatgctcgggagggagactgtgttcccggagatgcggggcgcaagacaaggagcatcgaggatacctgatccgagaactgtgcaaagagttatagctcatttaggctgggtcactggggactggaggaggaatgaagtcttgagagcatgtgagatgaaatactacatttgtgctttgtcaggagtgcaaatggaatgaattcatgcggaagacatgtagtgagtgatgtatatgggaaggacataagtggagcttcgccatcgaagaagctactaaacatgccaggagtgactcctctgttcatgaactgctttagctcaggtgagaggtagcaggttgcagtgaattcataaccattgtaaagtctgtgtgatggccaaattctctttccaggaacgggagttagaaaattacacagtcaggagatgattgccggatttaagaactgtcgtgcggagggggattggtagagtatgagtgatatgttagtggttacgccattttgagaatcttgaggagaaggagctggaagatagaatggctcatgcaggaatgacgaccaggactcctgtggcggactgaccagacgtctgcagtatatgtgggggggaacatggagaaggcacaccatgtggtgaggtctgccaccatgacacgccgatcacgaaccgcggatgacctccagcccatgaaaggatgcacccaaaagctaaattacgggaaggacgaaaatcacgacagctagcgaagtgagggccaaggcaagaggccgacacaccgagggaacacaaggcggaaaactcgaacgaagggttagaaagggtaaaaacgcggcacggacn

SEQ ID NO: 545876 - DNA, 501 bp, Homo sapiens
tgagacagagtcttgctctgtcacccaggctggagtacagtggcatgatctcaactcaccacaacctctgcctcctggttctcctaaatcgctgaagcgattctcctgcttcagtctcccgagtagctggggttacaggcacaagctaccacgcctggctagttttttgcatttttagtagagttggggtttcaccatgttggccaggctggtctcaaactcctgacctcaagtgatccgcccacctcagcctcccaaagtgctgggattacaggtgtgagccactgcgctcagcctagaaatctttaaggtgcaataaggtttttttgtttgtttgtttgttttaacttcttgaaaaaaaatagagacagtgtctcactatgttgcccaggctggtctcaaactcctggcttcaagagatcctcctgcctcagccttccaaagcgctgggattacaggcgtgagccaccatgcctggccatgctgtcgacgcggccgcga

SEQ ID NO: 545877 - DNA, 560 bp, Homo sapiens
ggggctccttccgcgagttagtgtatcaaagagtgggtggggccagggccttttggactggcccggggggggtgtgggggcccattggggttggaagccaatggcttggcccctttactggggggcgggttgtgttccaggtttcccgaatttgttcagggggttaacccgttccgctccagccctttttgttcgggggtgtcagctgttcttttgcttttttaagggaaggcttggccccggcctgaagctttgggcttttgccctttttcatccgggccttgccatagtcagccacggtttggaggcttcttgaaacccggcttttcaccacgggtttttttgtcttgtttccccccaagttctttctaggtttgaaactgttgggtgcctcccatttgttgtcgcgtcgttttttgtttcccctccgggtggcggcgcctcttccccgcgtttttgtctttgttgctctcgcccccccccgcttattcggcccactctccgggcccccaccactggtcggtcttcctcgaacaaaacaacagcctctccccgtcccg

SEQ ID NO: 545878 - DNA, 148 bp, Homo sapiens
ccctggatctcgctgttgctgctgtcgctgccattgccattctctgaacagcccctgggctggtgcactgtgagtgtccgaccctcggaccccgctttcagcggagtgaggggtgctgagtcggtcacttggtgatgcgtgggacgaa

SEQ ID NO: 545879 - DNA, 156 bp, Homo sapiens
aaaaggcataactgaccaagctgtgcttcctcgagagctctttgccctgctgcaggtctgcgtgggcaggagggcaaatcacagtgtgcgaaggaacgcgcggggtaggggattaattcgccccacatgaggaaccccattctcctgttgttgccc

SEQ ID NO: 545880 - DNA, 127 bp, Homo sapiens
caatagcgtttgtggtcatgtcctttcgatgtttctccaagtgttcttcataactgcggatcttgacagacaaggcaataattcgagcctccaggatctggtgtcctctgggtttgcaacaatcttc

SEQ ID NO: 545881 - DNA, 721 bp, Homo sapiens
cagtcatggcggcggcagagctactacgccggcctgatggctgaggagcccgccccggagtgctgagtgctctggccgcagcccgggagcggagcagctgcttcttgagctggctggagctggtgaagcagtggtgccgaggcgcgcgtgttccgtggcctgcttccagtggccgctgcggcggtgatcaatgcacctgcttccccaaggtgctacctggcaccctggctgcttgtggaggcgctggttggcagactggctggacgtgtgcaagtgatggccctgggctgctcctccgctgtcgccgcgctggtaaggaatatcttgccccagtttgtcttttttgtggactatgcttccaactgcttatatatggaagaacaattgaaggctcagtgactgttcgagattatattcagtccactatggagactgaaaaaactccccaggtctctccaacttagccaagacaaattgggcaggttttggctcgaatgcacgatgaagaacctcattcatggtgatctcaccagctccaacatgctcctgaagacccccctggaacaagctgaaacatttgtgctcataggactttgggctgagttacatttcagcacttccagaggaatacgggagtagacctctatgtcctggaggaaggcttcctcaggtacccaatcccaaaactgaaacctggtgtttgaaggcctttctgaagaag

SEQ ID NO: 545882 - DNA, 509 bp, Homo sapiens
ctgctgatcttgagatcccataaatctggaaatcgcagtcgtcattgcttaaaggtgtctaggacatgaagtccttgccccgcctatctcctgaatagggaatgcctaggtttgcttactagggtttccatggttttaggtttaacgtttaaatctttaatccatcttgaattgatttttgtataaggggtaaggaagggatccagtgtcagctttctacatatggctagccagttttcccagcaccatttattaaatagggaatcctttccccattgcttgtgtatctcaggtttgtcaaagatcagatagttgtagatatgcggcattatttctgagaggctctgttctgttccattgatctatatctctgttttggtaccagtaccatgctgtgttggttactatagccttgtagtatagtttgaagtcaggtagtgtgatgcctccagctttgttcttttggcttaggattgacttggcaatgcgggcactcttttggtgccata

SEQ ID NO: 545883 - DNA, 464 bp, Homo sapiens
  misc_feature (42)..(42): n is a, c, g, or t
  misc_feature (53)..(53): n is a, c, g, or t
  misc_feature (71)..(71): n is a, c, g, or t
tttttgtatgttaattttggtcacccttattgaaaccttatnttaattatganagtttttcaattgattcntctttggttttccttctctatccattggcaaatagtgatggtttacccttacccttctgatatagtttggctgtgtccccacccaaatctcatcttgaactgtagttcccataatccccacgagtcatggaagggacctggtgggaggtaattgaatcacggggtagttacctccatgctgttcttgtgatggtgagtgagttctcatgagatctgatggttttataaggggcattcctccttttaattggcacttctccttcctgccgtcatgtgaaaacggacgtgtttccttccccttccgccatgactgtaagtttcctgaggcctccccagccatgctaaactgtgagtcaattaaacctctttcctttataaactaaaaaaaaaaaa

SEQ ID NO: 545884 - DNA, 114 bp, Homo sapiens
  misc_feature (77)..(77): n is a, c, g, or t
gggatcccctagagacgtgtgcaatgagacgagatcacgccacttgaatccagcctgggcacagagagaggctccantctcaggaaaaaaaagaaagcgagagacgacagcacg

SEQ ID NO: 545885 - DNA, 603 bp, Homo sapiens
  misc_feature (16)..(16): n is a, c, g, or t
  misc_feature (24)..(24): n is a, c, g, or t
  misc_feature (150)..(150): n is a, c, g, or t
aacagagggtgccatnaaagattngttcaccggtggaaatgcttccgctgaaggtccggagggcgaaggtaccgaaagcacagtagtcaccggtgttgacattgtcatgaaccatcacttacaagaaaccagcttcacaaaagaggcttncaaaaagtacatcaaagactacatgaaatcactcaaaggcaaacttgaagagcagaaaccagaaagagtaaagccttttatgactggagctgcagagcagattaagcacatccttgctaatttcaataactaccagttttttattggtgaaaacatgaatccagatggtatggttgctctcctggactaccgtgaagatggtgtgactccattcatgattttctttaaggatggcttagagatggagaaatgttaacaaattggatctatcacctgtcaccataattggctgctgcttaccatccatacaacaccaggacttaggacaaatgggactgatgtcatcttgagcttttattttgaccgtgatttatttggagtggtggcattgtttttttaaggaaaaaaaacatgtcatgtgggttgtctaaaaataaagtgcatttaaatcca

SEQ ID NO: 545886 - DNA, 408 bp, Homo sapiens
taatccataatgtgtgccagtgaagactataagtcaggaggacattctagtctgcacatgataacaaaaagatgggcgttcctgcagatcatatgggggtaaaaagaaaaaaaaaaaagggtgggcccggaccaattggtgtgaggaatgcaaaatgaacgcagttgaccagtaagtgtacaaggtgaaagcctagccacaaaggagaagaaggttcatttaggtgagagccagggagaagacccaggatttctgataaaacaccattgggatccctagtctaatcgcctgagtgccatctctaagtgaaccttatgcacagcagggaacagtgacgaaagaaactacagccaagttggttccccaaaggtcagagaggttaagcagaaaggggcacactttatggag

SEQ ID NO: 545887 - DNA, 330 bp, Homo sapiens
  misc_feature (246)..(246): n is a, c, g, or t
gtaacaaccaacgccccctggacccacgccaatactaaccgcccctcaggagtactaaacataaacacactttcagtgcaccatctgcaaaaaagcttttctgcagagtccagactttgggaagcatcagagacctcaaacaggagagcagctctacaaacaaaattactgcagaaaaactttagtgactcctcaggactgggataccacaagaaaatccacacagaagagaaaccctataaatgnctatctccgagaaaagtctcatccaaagatccaactacagcagacatcacagggctcgcactgaagagaaactttatgcaagtc

SEQ ID NO: 545888 - DNA, 719 bp, Homo sapiens
agcggctggtctcgaactccttacctcaggtgatctgcttgcctcagcctctcaaagtgctgggattacaggtgtgccaccgtgcccggccaagatgggagtatttctatggccatttcacatatgggagaacagtctcactcacaattgagcagcttgcccagctaggagcagtaacaacacggataccctccagctttggagagccacaccctacaactggtccaacggctggtcaggaccgtgtcctccttcctccatccttgtcttggtgggcccatggatatgtggcagtatctagcttcaccctcaggagtggcccgaaccctgtctggagtccagctcccttctcaccatcctgaatatcgactttgctgagcctctggccctgccgagatttcatgataagttaacctccaggccctgaagccccagtcgttgcctctggctcgtgtgcctgcctcaggtgctccatggtagcatgtcttgtcgtccacctggagtcgtgggacctggctccagcacacacgttaccgctgggaccatgtatgtgcccttccagcctgaaagatctgtgggcacagatatagccatatagaaccccagagtgttgtcctgaactgaggcctgggtggtggaatatgtgagatgggataacttaagaccctgtttggaggcccttctctgatggggtgaccttaatcccttctcctgggaat

SEQ ID NO: 545889 - DNA, 750 bp, Homo sapiens
tgaacattccttgtgaccaggtgtgtattagcaggacccttccctcagtaatgagtatggtcatatctgttaagaacaccagtcaatgttaatgcttgctgcttaaaatgcattctgccagataccttaaatcatctcaagtcaaaatttcacatgatctctaagagcaggggaaaaatgctgttagtctgttagcataaagcacagcaagagtgaccttagcgtccagttcccaataagttcatcatccatctgagagcatctcaacctggacttcattgccccatcactatcagcattttggtcaaaactattcaacacatttctaggaagttccaaagtttcccacctcttcctgtcttcttctgagctctccaaactgtaccaacctctgcccattacccagtttcaaagttgcttccacattttcaggtatctttacagcagtgacccaaactcctggtaccaattttctttattaggtcatatatacattataatgaactacgtgagactgggtaacttgataacagaaaagaggtttaacttgactcacagtttcacaaggcttaggaggcctcaggaaacttacaatcatggtggaaggccaaggggaagcaaggcacgatcttacatggtggaacggagtgcgggactgtcacacttttacaaccatcatatctcgtgagagctcactatcctgtgaaccagcaaggggggaaactgtctccaggaatcaaacctccccac

SEQ ID NO: 545890 - DNA, 443 bp, Homo sapiens
  misc_feature (247)..(247): n is a, c, g, or t
  misc_feature (386)..(386): n is a, c, g, or t
  misc_feature (403)..(403): n is a, c, g, or t
  misc_feature (434)..(434): n is a, c, g, or t
gctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggaatacatctattttatatatattaaatttgaatgtgtctatcaaaatgcttgggttaacttaagcgcacctttattaaaacgcagaatgttaatttgatattaaattnttccagatttatataggcttgcgttgtatggatgactccctcaatttgaatgatgggtgttacgatccccaataacaccttattttcattgtgcctcttgcttatgttggattaaaaaaaaactttctgtttaaaaaanccatcttagaattgaanaatacattttaatacaccctgcatactaaanaaaaaaaaa

SEQ ID NO: 545891 - DNA, 196 bp, Homo sapiens
  misc_feature (36)..(37): n is a, c, g, or t
ggaggttttggaaggcagcgattaccagagccaccnncggaacgccgctgtgcagttgacgtcgtgcggccgggctgcccttcgctgccaggacacctgcctctcagcggttggccgccatccgggacgcttccagaccacctgccagccatcacaaggggaatgcagaggcggaaaccttgcagcatttttattt

SEQ ID NO: 545892 - DNA, 343 bp, Homo sapiens
attttcatggcagaaaaagccctggtgtttccttggagctggggataaaggccagtgaaccagcctgtgatgaaagctgcccctggccctatttgagtggaaaggtcattggggcagccatgcaggtatcagagccggctgaagccctgtcccttacccctcaggcacctgatggttaacttgcctcctgggaaataatgatttagcctttacttgggacaatgattaatcatgttttttaataattgctgacatttgtattttaagctggataccaatgtttggatttggcattgattttttaacccttagagatatttaattaaaacttgaaaaaaaaaaa

SEQ ID NO: 545893 - DNA, 320 bp, Homo sapiens
  misc_feature (47)..(47): n is a, c, g, or t
  misc_feature (55)..(55): n is a, c, g, or t
  misc_feature (189)..(189): n is a, c, g, or t
agccaatggtcaagaagactccaaggccccagatgggtccacacttnaggccctnggcctgcctcagccagacttccacagcctcatcctggacctgggtgccctctcctttgtggacactgtgtgcctcaagagcctgaagaatattttccatgacttccgggagattgaggtggaggtgtacatggnggcctgccacagccctgtggtcagccagcttgagactggcacttcttcgatgcatgccatcaccaagaagcatgctgctttgcctgtatccatgggcttcatgttgttgggataactaagcaccgcagcac

SEQ ID NO: 545894 - DNA, 100 bp, Homo sapiens
ggatacgaacatctatggtggatatcacatatatgatattttcgcgacatacgatgatgttgataaaggggaaacacacacatttggtaaacacgacacg

SEQ ID NO: 545895 - DNA, 338 bp, Homo sapiens
tatcctctgacatacttcaacatgcctctaaaacactaaacagatgacaacggtcctctcacatctcttgctagtgaagtgctatgagatatgtgaggcaggccaggatccagaaagtaggcctaattgctaggcaatgatggtcacgtggccacattcaggtgtattcctgagaggtggaatctctatgaccatgtgccagactcactcatcgtgaaaggaggaactgtggaggaatgtgctaatatagcaaaagccgcatattgaaccagtggcttgcacttagtaggaatggaattggcactgacttgattaatgcatcttgacgagtactgggt

SEQ ID NO: 545896 - DNA, 677 bp, Homo sapiens
ccagtcaaggaaagtcaagtagcaatgaaggaaatgtctaaaagagatggcaatggagaaaaaagacatgagtgagtgacgaggtttcatgtgaaaatgccatgtgaatgggaaggcccctgcagaagacgtctttaagaatgcccctgcctcctactgtgaagaagtgaagagagtccccctccacctaaatgtgtgtaaacccactgatcgtgcctcttgtggtgaatatgtgagtgatgacagtgactatgagtgagtgaatgcaagatgtgatgtgaacatgacccctcccccacagcccctgcacgagcgacagccccagaagcgagagtgagcaaaccaatgaaggatgaattgacagaagacaaactcgactgactggaataaacttgtgcttgtcttgctttggcacgaaggcatgtttcccaagtaaacgaagttcttgatcaaacaccagcatgctgtcagacctgcacaagcacaaacctggaaatccaccggaaatgataaaacagtcttgagcaggagctagcctatctggaacagtgagagaacgagagtggaaagtttaaaggaagagtgaaatgatcgcagggaaaagctccagtcttttgactctccattaaaggaaacggattatgtactccaacggaaactgacagtgatcgtaaaca

SEQ ID NO: 545897 - DNA, 157 bp, Homo sapiens
  misc_feature (22)..(22): n is a, c, g, or t
attgggctgagacagcaaaggncaagttatgaaaagaaagtgcgtctcaatgagatttatacaaagacagaagaagcaattcatgaggatgaagagtggcagatgttgccaagaagatttgaaacgaagagcttgacgtgatggagtgtgttctgaa

SEQ ID NO: 545898 - DNA, 240 bp, Homo sapiens
  misc_feature (18)..(18): n is a, c, g, or t
  misc_feature (46)..(46): n is a, c, g, or t
  misc_feature (49)..(49): n is a, c, g, or t
  misc_feature (124)..(124): n is a, c, g, or t
tgatagctgactgctgtnattctgctgagaaatgattattttggtntanataaaataaataccacattatgaattttgtttaatcaaattagtagtggaagtggactttggtaagtgcaggatnatgtagtaccttagcataacttgacagtttttaatgtgtatccctatggagatttattaagtaattagaatttagtttgattgtgacctcggaattatgtattgtctttttttgtt

SEQ ID NO: 545899 - DNA, 288 bp, Homo sapiens
agtaaagctttcttcggaaaacattttatcaaagccaaattgttaataaagactttccttttgtaaaactggataagagaagacatatcaggtgtgttcatctctagagatgatcagtaagttcagcatcttaaaaactgcagcaggaaactgaaagcttatgttccagatcatctcttccgttgttcaccatatatttcttagcatttggtcatcatcagcgaagcatttgtacattaataaacattctccactgaatttcttgtgcccactgttcaaggtgtaccg

SEQ ID NO: 545900 - DNA, 461 bp, Homo sapiens
ccgggtcaacccgccggtagtccttccttggggcagccccgtcggtgtctctgctcttggcggctcccttccatagcggctttagcacagacctcgggtgttcgatatcatacggcgttgctgcttcagccaaggcagccctggccacagcactgctggtccgcactttctgctgctcatccacaagaccatgttccatgatttcaactaaacttctaagatgtggcaagatagcacagcccataagaatagctatctgtagtacaatcttaataccagagtgtctcgcttgccaggacttcttgcttaagaacacagcttaaaagaagggcactaaagaaggaatgcccagggcaaaggctacaacagcaaaagctctagctgttgtgtaacggacatactcatccatgtaatctatatcaggtctcatggtagagatcatagtagccagaccaggagcc

SEQ ID NO: 545901 - DNA, 87 bp, Homo sapiens
tcaatcttacatttctttaatagatccctaaccaaaaccagtcaaaagaaggtaatttatccctcccagccttaggtttagcatctt

SEQ ID NO: 545902 - DNA, 580 bp, Homo sapiens
atgcaggagcaaggtgggttacagtgggtctgggcactgtgtgctaggagcgagtaccaaggtttctgagtcagacccggtcagagaccctgcgctgataggtggactaatgtcttaacactgccagctgctttctcctcacagctggctcacactcgcaaggcatatcttcaacagtaaatcatttcagacgatgttaagggaacagacgtaaaagaaatggaatgctgagtcctggtgcgcctcagcagttgcagctttatgagtcataatagcatgtgaacagagagtataatagattttccagtaacaatgagccacagagtcgataaagtctgtgtctatctccctcagatagcctactcatgacctgtttactatcatacctgacttcccatctttcagctgtgtatcctgatgtagagtctcatgcatacaagaaaagttacccgatgacaaagtttctgcttcctagcattcccatcaacagcattgtctgcagttgatgatattcaagcactggtctctggatggttactctctgtgaagaagagccattcacccctgtaccagtgtctaa

SEQ ID NO: 545903 - DNA, 83 bp, Homo sapiens
ggggggtccgattccttcctttcttgtctagattttatgtatacgggttcttcgaatgtgtggtaggggggggggcatccata

SEQ ID NO: 545904 - DNA, 405 bp, Homo sapiens
actactgttattgaccaatgaatgacttctaataaaatctagtggtgatgcaaaaaaaaaaaaaaaaaaaaaaaaaaaaaaattggggggggccgcgccctctaaaaaagtgttttataaagaacccaattcgcggtgggggcgcggggcggcgccaaggataggggataagtggagaactgtgtgccatacgcctgtgtccccaagaggaaacccggggccagtagacataggtcgcgtggggttcccacccaaataaaaaaccgcccggggcgggaaaccggagcggttggtctggaacaaaacctcaagaaggggcttctcagaagggcatcacggagtccatcaccacacgagagggcgtcagcggagcgcgcaatttataaaatataacggcccgcatgg

SEQ ID NO: 545905 - DNA, 233 bp, Homo sapiens
caagggccccggcccccctgggggggggggggttttttttagggggggggcccaaacccttgggggggggcccccccttggcctgttttggggggcccccctttgggcctttagggttagggccctgggggggggggccccccctgctcctttggggggggggccccccccccccccgggggcccggggtttggaccccccccggttggcccggaaaagcctttttgcggcca

SEQ ID NO: 545906 - DNA, 172 bp, Homo sapiens
tatctagcctgggctactgacgtaggagaacgaccggcaggctgaggccgagttcaaccgcatcatgagcctggtcgacccctaaccatagcggccttgtagaccttccaagccttcatacgacttcatagtcgcgggtagaccaccgtacacggtaccctacctacgccgt

SEQ ID NO: 545907 - DNA, 110 bp, Homo sapiens
ttttgccccccccccccccggggaaggggggtttttttgggggttttttccttttggtccccttggttttttttttgggattaaaggccccctggggggcctttttttta

SEQ ID NO: 545908 - DNA, 1444 bp, Homo sapiens
  misc_feature (1153)..(1153): n is a, c, g, or t
cgttagatgacttatgtattgtatcccgccggtgtgttccacttaaacaggggtttatgggctgtgaggggcgcccctctgtggggggttggtgcgcccgcgagtagttttttcttcgtggcccactacccgaagagggggcggtctttgatacgcacctctctgggggggcaagcttttcggggcgcctctggaaatagcgttccgctgttgatcttcctttccccatcttgggggtgtaaattagctgtctacactgcttcgtcgtcggttttgccccccgcaaccagcagtggtctggcccccacaccttgtttcgccccacaccctctgttgttggatgcatagatactcccccgcccacccacaggtggcggcggggtttttttggtgggccttgttttcccccatgggggttgtcacacaacacgccacacaccacactcgtggtccttcttcgctctgaagttgtttgtcgctctctgggaagagtaggagtgtctcccccctccgctcccctctctgtgtttgctcgccccgctctgttagggtgctccctcgtgtccccgcctctgcttctttggcacactttgcccccccgtcgtggagtgggcccacggcggttctccccctctcttgtctcttcgggtgtgtgatagtgcccccccctcatggtgttcacccccccctcgcgcggaaagagtggggataagagagtaaagagagagagtgcgaatagttgtgccccgctctctcccctcgtgtgttttctctaatatatccccacactgtttacacacgcctcttttaatacgcctcctccgcaaattgttgtctttgctggtgtgtcttctctttacataaacactacaaaaacatatatatatatatatatatatatatatattggtggtcttctttctgtgcggcgagacacacgcggtagaatattttgttttgttgtctctctcttgtgggtgttgtagatatacagatatatgcggaatattctgcgcgagatttgttgcagaatatgtctcatataaccccctctgggctctgtgcgcgcccctattgtggggccacgcctattttaaaggggagaggggaattgttctcccccgcggcctcgggggtgaagaatattcccccnccacccccacgcggagactccccctctcccctctcttggctccctctcccctcttttctaatgaggaaaatataagaatgctcgtaaactcttttggaacccccacgcttttttgaattttttaatttgggtaaggttttggggtcccacgcgccactctttttttaccccctctggaggaaaatataaggagtgagggagaaaggagaaagggaggaaacttctcccctccccccttcacccttagcttcttgaaaatgggcccctcccagaataaatctgccccttttt

SEQ ID NO: 545909 - DNA, 194 bp, Homo sapiens
tcgcagtaactcatctgttacgaagcaaagggggattattccagtggggcagcaggagcaaggggcatgatattcatgactatgtctgctgggcatgtttcaaagtgtccttgaattcactcagcaaacaaagctttcgggagaatctctcaaaacttaggccctgctcccatttggccaagatttactcatcg

SEQ ID NO: 545910 - DNA, 207 bp, Homo sapiens
ttcatactgtggtgttactgtgggacacgacccttctcttcccctctgcggtcacaaatagacagaagcctctgcaccttactatcagcctgagatggatgctctaagcaccacctcagctccggatttccgccccacctgctggaccacaggtcccagcacggtgtttgtgggaaaggtctaggtcattccaaacaccacagtacg

SEQ ID NO: 545911 - DNA, 421 bp, Homo sapiens
acgacctcgcccaaagattctgtgcaagaataagcgctaccacaattggatgactagattgtctccaaaacactgttcgcgctcgacaagatgtgatatagagaaacatttgcgagacctctcgtccctgctaattttacaattctctccggtgagagtaggctgtacgcctccattgagtagtcttgtcgggggaggagggaggaccctccgcgctttataccctcgggatatacttaaacttctctagcaaccctcccgcgagcgtcgggggaacacaacacccgagcagttcgtgttgacaatattggtccacgccacgcagcttgcgcacagtctttctatgatgccttgtaacacatctactgggccaaccccccggcccggggcaaaaacccccattttcccaaaaaaaaataac

SEQ ID NO: 545912 - DNA, 562 bp, Homo sapiens
ggggatttagggccactgaagatagaagatacaatacagtctgagatgctggggcccaggatgatcagtaagctgggtggttcatggatgttttgcagacaagaactacgatagcatgagactgaggtactggtgacccaggagatatctggggatttagggccactgaagatagaagatacaatacagtctgagatgctgggaaacaggagacagaggtggaagcttctagggtaccagagtcagaggctgaggggacagaagcttccacctctgtctcctgggtccccagcagacagaggtggaagcttctagggtaccagagtcagaggctgaggggacagaagctaaaatattagggacccaggagataacagctagggattcaggggtcagagagatagaagcagagatagcagagtctgacatattggtagcccaggagatagaggtgggacttttgggggttctgggaatagagactggggcagcagaaggtgcgatattggggacccaagagatagcatctagggattcaggggtcccagggttagaagctgat

SEQ ID NO: 545913 - DNA, 1132 bp, Homo sapiens
gtggtggacccaatagggaaggcgaggagtgggggatttgcgttggggaggaaaaggcaaaaaagcagactcctgccctaggtgcactcgtggacaatgcgtagaggagctggaagccgagcggggtgggagtgatgtggctggctgcgggcgagggacgcgcgcgcctccgctcgccctccagcgcggagcgggcaggacgatgcgccgtgggagcggcggttacgcggggccccgatcgctgttgggcaccaatcaacggttgccatagcagcgtatgacgtcatcagtgctgtgtggtgcccctgctgacggggcttggtgattggaggaaaccccgtgtctgcggagcgggtgtagcctgtgagcagtcgagatccagggacagagtctcgagtctcgctggctgctgccgcctgccggcggccagagactgctgagccctgatcgtccgccgtcgaccaaccagtccggacacagaacgtccagtcatggcataaaaattgacgctggttcagaaggccaaagtggacgagcaggctgagcgagatgatgacattggcagcctgcatgaagtctgtgactgagcaaggcagctgaattatccaatgaggagaggaatcttctctcagtttgattataaaagtgttgtaggagcccgtagggtcatcttggagggtcgtctcagatatttgaacaaaagacaggagagtgctgtagaaatgaaaggtagaatgagtcggggaaaaagagtagaaaatgagagggagataaaagagatgatgacagagactcaagaaaataggaagaagattagggacaccagagtgttaaccacgcaaaacaacaagactttagatgtacaataagcgaaatatccagagaacagccaaacactacattctatcttctacacaacgacaaaagattaaaaaacgcagaggataccaaaaaatgagaaaatacaaaaataaagactaaacatgattcactaccgaatgtacacaaaaaatcacataaataatctaacccactaaactctgcatgccaactgataatacaatacaatactaaaaatcgatcacaatgatccaaacgaactcaacacgacagtcgatcataaatgaagaac

SEQ ID NO: 545914 - DNA, 385 bp, Homo sapiens
cctcatacaggatccccaggctgctagttgtgtgtagtatgaataaagatcaaagaccgcatgggaacttgaggaggagtgcatgatgcatggttggaacgtcatcctaataagtcgaaagcaattttctagcttgtatccagctgatacttgtatttccatcttacccccatggtcagagtaaccgagatcagaatggggggtcaaatggcatatctcacacccagtgggcctggcttgagggttgcgtccatttctggttctagatttccctgatggctaaatgtcttaatgtacatttctctttgggggtttttcttcatccacttttgccatctgctacctctgtactactgaatgtgtcccttcctctcgctgtgccctc

SEQ ID NO: 545915 - DNA, 282 bp, Homo sapiens
attggattagaaataaaaaatattaaaaaatataagatcatgccactgcacaccagcccgggcagcatattgagaccttgtctctatattttaaaaacaaaaaaagaaaatgaagactttaattctggccaggcgcagtggctcacgcctataatcccagcactttgggaggccgaggcgggcagatcacccgaggtcaggagttcgagaccagcctggccagcgtggtgaaaccctgtcactgctaaaaatacaaaaattagccaggcgtggtaacacacg

SEQ ID NO: 545916 - DNA, 476 bp, Homo sapiens
accctgttaactcagctatggcagttacgacaccgccggtatggcgttcggccttaaccatgcgctgaccgaacccggcgccgaggtgcagcactacgcccggctggatgtgagccgcaacaccaatcacagctacatcgaccgcgaccagcgcgatgcctggagcgtggcgttttccctgctcagcgacctcaccccgaacctgtcccacaccctggccttggagtatcaggacgaacatgaagacagcccgtactggggcacgccggtgctcaaccccaaggccggtgagctgaagatcgacaagcacaaccgcttcaataactacaacgtagccgacggccgttatgagcaacgcacgatctgggcacgctcgatcatcgactaccggatcaacgacaacaccacactgaaccccctttcctacagcaatatgttcactatgttaccaatttgcaacttgtgcttcaatagtg

SEQ ID NO: 545917 - DNA, 944 bp, Homo sapiens
  misc_feature (402)..(402): n is a, c, g, or t
gtgcctttccttcagctgtcgtcaagggtgctcggtccttccgaggacgctaatgggtgcgttcggggtgaggccctcacttcatctcgggcgacttagtcaaccgctgtccggtctagcgccgagtccgttagaatccgtgccgagaccaatggccgtcttgtctctcgagcatcagtcctgccatctactcagagcaaacttctattcttgcaactgaatgattactgatgaatagtcaatggtagaggataagaaatcaaaatgaccctctattaatagttcagagcggatgctaagaatgttcgagcctgtatttggtcttgtgcttttgtttgctaaggcacctggcggaaaaagtcgaacattgagagatgtcatcatttagcaatgtagtagtgngcctagttgagagccgtgttctatgcaggcttagtgttggcatgtaggacattgatgtgaaggtcgatgccgcctcttccgatcatgggattgtctggatccgagactttgatgggattagatgagaagtagggtgaaggccatatatgtagggcagcatagatagattcgacgtgaggcaaggtccattggaactgattgtaagcttgtgggattaatgagtgttacttatttggacttaataaagcgttactatttatatggtaggtattgctattggacaattctaccaaagagagctttggaatctggtttaaaaaaaaaaatatacttaatcacaaaactgagggtgtaccgaagcacttttatgccagtgagttaaccccaatttaagcgcgtgagttggtcttgcaagggtcctttgatgtgataacaccaggttttaacgacatacttttctgtaaatgggtcggggattcttccgtaacacttccttagagaaggttcctggtgaaccaatttggggaaaaggcagatttggg

SEQ ID NO: 545918 - DNA, 356 bp, Homo sapiens
  misc_feature (91)..(91): n is a, c, g, or t
gacaaggaccgtgtcatccccttcgtcaggtcagatcagtttatccccagctcaggcaccgtcctcgtttctccttcttctgcaaccccangctgtgtcctgacacccccaaccaacttaaaattaacgcactcccacccgcttccagatctctaaccaacgttacagcataccccgccaagaatttggcccagcccaggactctcaaatatgatctggggagaactcacagcccctgcaaaattccctagaagccgttttgagtgtgtaatggggggggtgttcctgagagaagtggggaacacagttttggcccttggaatacccggcggctgctgatggggggggatggacac

SEQ ID NO: 545919 - DNA, 168 bp, Homo sapiens
gtccgtcactcttcagttctgctaccttagaatgtccacttcctgtttggtgaccatggcaaccagaagactatggcagtgcagagcgtgtgggatgggggagctccatcttccttgggtacatggggacgagacttcagcgaccatgagaagcggcgagagccatgg

SEQ ID NO: 545920 - DNA, 327 bp, Homo sapiens
  misc_feature (182)..(182): n is a, c, g, or t
gtcggagaaaaacatgaaagcattatttttggccggccattggcggcaaggccggggggcggttgcgcgcagcatttttccagcagacggtagcgtgaatgccgagttttctaccgccagcttggaagatgtgcaagaggccgttcaagccgcgcaccgggcctggcaagagccctcctggngcaatagcttgcccgtggagcgggctcgggtgctctataaagtggccgatctgatcgagcaaaatgtggccgagctggcagctttgcaaacaagagacaacggcaagccgctggcagaaacgcggtcgacgcggccgcgaattta

SEQ ID NO: 545921 - DNA, 1392 bp, Homo sapiens
taagaagcacgcacatcaccactgagaagagacaactcatgggttgattctgaccacatgggtgagtagtatacacaacagcctgttacaaagagccgcgtcgcgctgctcagcgaggttccaacaaagagggggataggtacttgtgcacgtcgtcctaggtagagccgggtgtaaacaagcccccggggggggggccacacggggcgccacagtgaaggggtaacccccgggagataaaatgtcgcggagaaaggccccccatagaacgcctttagtgggcaaagccctctctttcccgggggggcacaaaaattgtgggggcttttcaacaaaggtgacaaggagaaatgcgcctcccttttacaagaggaaatgtttcccatgtcggggggggaaaaaacattctctgggggtgaccacggccacaaaaaaggggaccgcccgcccccaccgggggaaaagacacctgggggttaacacaagggatacacagggtggatttacacccctggggagcccatcccccggggcctcaaattaaggccgcccggtttatataggccccctcgttaattaggggatttgcccaacacggggtttcaccacttgccaacacgcaaagttttggcttggaggcctcgaaagggatataagcatttgattcgccccttttctggggtgaaaaaaagctcggggaagagatgggcccctctgaaaatatgtcttggaaaattctcgggtgtatagctgaccccatttgcttgtataatgggatcttcctcgtggcgaaagaccccactaggtgttgtctttgtgagagaagctctttttcgagaaactttatacccgaccgctctctggggttacgcctattgcctggttccgtgataataggagaacacagaaccagattgccggtgtggtgttcaataccacaagactcagctggcaccaaagtaagagctgccttgggtgagactggccaaagggtccaccacaagatcttgcgcctcagaaaaaggctcaagaaaggggtatagaatgagagataattaatcccctataatacactgccacaccccacacttttaaatcacgtgggtggaaagaaccggtttcaagagaactgtttgtttcacaattggccacatttaaagtttaagtagtaaaagagctgggtaaatgaataacacaatgcactcgtaaaacctctcacgagaaggagaaaggaggaaatgttttgtggaaccacctcttgggtttacttattttgcgtgtggcacgttttaaagttaattaagtttttaaaatcagtactttttaatgggaacaacttggcccaaaatttgtcacagaattttgagaccccattaaaaaagttaaatgaga

SEQ ID NO: 545922 - DNA, 804 bp, Homo sapiens
ctgaccccttaatatcatctagtccaccatggatatcgcgcatctaccaaccctgtataccgatgtccgtttgtatgattttccaggctccctcgctggctgtcttgaccggtctctctcggatcagcccccatggtacggatgtccttgagtcctttgcccgactgctcctcacgtatcgcctgcagatccgctctcttatccattcaggtccgacccatcactttccttgcaggagcgtcacaatgcatggttggactcatgggctctctgtcgatgcgcctggggccaacggataggcttctctgtgactctggctgtgaatcgagtttgttccccctgaagtaactgaatacattacggtgtgttggagagaatgtgattaggatgctgcatgggtcaatcactgatggggcgccagtgatgaaacgtggtttcatagcgtcctaaggtcagtttcccgtgagggaccctaatcatcatccctggacgtgggtgtaagaatccatcttccaaaatttacttatatcgcctgtcatctgaagtgggtcatcacctggtgtatcaggggccatgtggagcaggtaactgagtcacgagaagtgcacacattcccatcgaatccgttggaccagaaaccctgatgttgccgctgcactataagcaagatactatgcgtttccctgcctcgattctgacacgaaagggggttaaccaacacgtgaatgatagctcgcaacagagagaacatcatcatgtaaggaaagccaaaaatcatcgattaattctcttcatcttaagcta

SEQ ID NO: 545923 - DNA, 178 bp, Homo sapiens
ggagtcgcaagcgatgaagaacgagtagacgaacgagtcgtagaatggtacaccacgcataatcggtagagaagatggcgcgacatagtcaaggaagtacaccactacacgaggcactcgagacacacctagccattgacactaccacacggcaaggctattcctgcagatatttgcc

SEQ ID NO: 545924 - DNA, 716 bp, Homo sapiens
catcctttagctgaatttacgaggattttggctaccctgagtatactgcatacttcatgtcctctgttctccttcttttgatctagacctaatcttcgaatacctgaactaatgtgaacagctagggaagcaagggcccaatatgcactaagtttctttgcacctgtttgcacttacttaagtacattactaaaatgttgtttcaaagcgttttgtactatgtgtctttatgacggtaacatcctaatgtggtaggtattaggtaaatgtgctgtcatgagatcaaattgagacttccacagaattatctggacaccacggtgagggcttggttctggatgactgcgaataggtgtagctgcctcttccttgaatatcacagtgtgtagagatggctgagtgcaatggctcacacttgtaatcccaacactttggaaggctgaggcgggaggatcagtatatcggtacgtctgagcccaagagttcaagatcagcctgggcagtatagctagaccccatctccattttttttttaatgattttttaattaaaaaaaagaacaacaggatagagctgttggcggtggcacagtggcccaaagagcagcttcagagataattccttggttctatgatacctgtgtaactccaaattacagtcggacttggatacatcatttgtaacattgtagtacagccgaggtcttggttcgtcga

SEQ ID NO: 545925 - DNA, 1204 bp, Homo sapiens
  misc_feature (1018)..(1018): n is a, c, g, or t
cttggcgctacaagataaagctgttctcattcctgtacttacttacacaagagctggagcccggtgccctagccacacactctgtaggaagagtgcccagagagtttgagctcagggcccttagatactttgcgatagcacgctgctagcgtagcctctattgagagtagatacagttcgcgagggcgctcacgttcgtgccttactctaaagtcatccagatgaccacaagcacaggtacctagatccaagtatcctcttggacttttactttaacgtgtccatacactgttgtcagacactaacagacgacaagactgacaataacacaagacacaagaaagacaaacaagagggccgagaccagcacaccttaatacaagaacaaaaccaaacacaacaacacagccaacatggcaacaagccggagagacacacgacgctcacacaaacgggcacacggcggcaacgagaagcaggaagtgacgcgaacacaccagggtggccaaaggtagcgaacaccacaaacgacggaccaacacacaacaacgagcatacaaccgcggtgcccacacagggggacacacagacaaaaacaccctacacaccaaaagacgagcagcacacgcgccgcgagacacaaacacaacgacgagcataatacaaacacaccaaccacaccaacacaaacaagtaggagaccatgtatcacagcaccaatgcaggcgacgctgcgacaccaacggcgggacacagagcggacagaaacaacacacgggcgcgcccagaccacatcatacaccccacaacggcaccaccaacagaggagaaacgcacccaccacatccagagagtcacaccgagggacaacccaccgatacggccacaacaccacccgctgcagcccaccaacaaaaaaacaacatcccaccaacacagccatgtcacacctccgaagcaacagagcaggagaacccacacacacacgacagacccacaacgaccaaacacacagagnaacatacaccagcagagctgcaaccgactataacccacccccgaaggcaaacacaacaagaaacagatccaacacaagcaagccaacgaaacaacaacggtgcgatcaacacaggcgcaggaagccatacgaacacaacaaccaaaaaaaacccaacaacaagaaacaaaacgaagaccataacaa

SEQ ID NO: 545926 - DNA, 231 bp, Homo sapiens
ccaacaccgtctcacggtggccaggttgacgtacgcattgagctcgcccgtttcacggacggcgattgcggcccctactggagtgtcgtcgatatacgccaacgacaccgcaaattgatcaggtttctccaaggcctcttcgaacaggtacttcattgtcccatcgaaagcgaagaggccattgtcgagtgcgatctttgccagtcggtccgcattgccagcgcagacgtg

SEQ ID NO: 545927 - DNA, 231 bp, Homo sapiens
gatcttcaaaataggaaatttttagataatagtggttctagatatattttgaaaccacatttcttaagacagagtaaatcatactttaacccaagtaacataaaacagggtatgccaattacacttacaataaggctcatcagtcgtatccagttgcctcttactcattcatcatctaacaaaggtgcattcattagtaattatagaagttttttgtcgttccaaatgatc

SEQ ID NO: 545928 - DNA, 243 bp, Homo sapiens
atgtgaattaggtggtggatggctgcgctcatgagttgagaacagcctgggtaacatggtgataccctgtctctacagaataatacaaaaattagccaggtgtggcagtacatgcctgtagtcccagctacttggggagctggggcaggaggattgctcgagcctgggaggtgtttacagtgagccgtgtttgtatcagtacactccagcctggcatgacaaagcgagaccctctctttgggg

SEQ ID NO: 545929 - DNA, 362 bp, Homo sapiens
aggcagtaagggggatcccaggcacccatttcaaggagtgggtgggagttttttccctaacttgtggggacccccccagttgtcaagctattaggcagtagggtttgaggggtcaggcctccacctgagaggttataacctgagagacagctttccccttcctcccagtaaaaagggaaggggggggggcacctgaaaaattaagaatattttcccagtcccactaccagcacccccgatccctgagattgaggggtttagggggtgggaatggaccttcagccctgccccccctccctcccccctggtggtgagtttgtttgatgttttggttgggtgaataaaaataattcccctttgga

SEQ ID NO: 545930 - DNA, 193 bp, Homo sapiens
ccagtttttccccaccctccttaccccggtggggtaggtttccgccaggggtggcctcagtttttcctcaacagggctgggggcagccctttccctgcctagtccccgcctgagggccagcccccccccccgcctgccgccccctgttcaggttccctccccgccccagtgaaataaagcatccccccctgca

SEQ ID NO: 545931 - DNA, 1000 bp, Homo sapiens
tctagactaattaagaaacggttgagtaagacagagctggaagatccccgcctaagcaagcagcttccttccagactagtgctacaggagctagaccagacccgccctaggcacctccaggcgctttagcccggccgcaccctcttccctgttcctcgatggggggagggtagaggccggataaggcgggaccctgagacttagagctggctgccagcggaaagaaagcgatgccacgtgatctcagcaccatccagttaaaaggaggtgcagggccctgtgagcgctagtacggattccacgtttgagtcccaacatctccagtatgtgtgctgctcggctctccgcggcggcacagtccaccgtgtatgccttctccgcgcgcccgctgacgggggaagcctgtgagcctgggctccctgcgggcaaggtgctgctcattgagaatgtcgcgtctctctgaggcaccacgatccgggactacaccgagatgaacgatctgcagaagcgtctgggacctcgtggactggtggtgctcggtttcccgtgcaatcagttcggacaccaggtatatggggcgagatgggtggccttgggctctaggctcccacgggcgggacaccgcttactttctcctctggtactacagctggaatgcaggcctatcctcggttatacaaggagggcaacttcctggtgactcatcgggaaacctctgttttacagttaaaaagtacattctttccgaaatcctagcacataaataaatgcctttgtcttccctaggagaatggcaagaatgaagagattctgaattccctcaagtacgtccgacctggtggcgggttcgagcccaattttacattgtttgagaagtgcgaagtgaatggtgagaaggctcacccgctctttaccttcctgcggaatgccttgccaacacccagtgacgaccccactgcgctcatgaccgaccccaagtacatcattttggtctccggtg

SEQ ID NO: 545932 - DNA, 782 bp, Homo sapiens
tctagactaattaagaaacggttgagtaagacagagctggaagatccccgcctaagcaagcagcttccttccagactagtgctacaggagctagaccagacccgccctaggcacctccaggcgctttagcccggccgcaccctcttccctgttcctcgatggggggagggtagaggccggataaggcgggaccctgagacttagagctggctgccagcggaaagaaagcgatgccacgtgatctcagcaccatccagttaaaaggaggtgcagggccctgtgagcgctagtacggattccacgtttgagtcccaacatctccagtatgtgtgctgctcggctctccgcggcggcacagtccaccgtgtatgccttctccgcgcgcccgctgacgggggaagcctgtgagcctgggctccctgcgggcaaggtgctgctcattgagaatgtcgcgtctctctgaggcaccacgatccgggactacaccgagatgaacgatctgcagaagcgtctgggacctcgtggactggtggtgctcggtttcccgtgcaatcagttcggacaccaggagaatggcaagaatgaagagattctgaattccctcaagtacgtccgacctggtggcgggttcgagcccaattttacattgtttgagaagtgcgaagtgaatggtgagaaggctcacccgctctttaccttcctgcggaatgccttgccaacacccagtgacgaccccactgcgctcatgaccgaccccaagtacatcattttggtctccggtg

SEQ ID NO: 545933 - DNA, 92 bp, Homo sapiens
gcttcgatgcgtacttgctttgtcactgcccccctattacatgagggggggtttaatttggtttctgaggcgcattaagctcaggaggggat

SEQ ID NO: 545934 - DNA, 166 bp, Homo sapiens
tccacagagatgtttgtacagttgatgacgtttctgtgtttccacgatgggcttatttaccttggaaaagcccagatgcaatgagagtccactttcctatttccttccacctcccagatcacagagcatcttgttttacagtattggagattgtgatttactatct

SEQ ID NO: 545935 - DNA, 429 bp, Homo sapiens
ggtgggtgtctcaaaagacagaagtaacactgatgatgcagagaaggtgaactctttctaactcttgtgttagaagtgtctcagtgttgatgagaatgtacattaatgcagccattacggaaaacggtgtggaggtttctcaaaaaaactaaaagggccaggcgtggtggctcacgcctgtaatcccagcactttgggaggccaaggcgggtggatcacaaggtcaggagatcgagaccatcctggctaacacggtgaaactccttctttactaaaaatccaaaaattcagccaggcatggtggcgggtgcctgtagtcccagctactcgggaggctgaggcaggagaatggcgtgaacccgggaggcagagctggcagtgagccgagatcgcaccaccgcacttcagcctgggtgacagaacgaccca

SEQ ID NO: 545936 - DNA, 553 bp, Homo sapiens
  misc_feature (14)..(14): n is a, c, g, or t
  misc_feature (34)..(34): n is a, c, g, or t
ggtcattaattatntgtattgtagaggtgttatntgctttaaactctgagctatgtttagaaagcaacatgtttttcatttcaaatttggataggaatttgctttgcgcagatttaatggataatgggtgaaattttgacatgttgaggtattctatattgctgtagtacagaatatggtcatattcgaaacattttctaagacatttttgtatcaggtgaaaggtttatgagagatgaaaggaaatcagagtatgtagattggcaagggctgatggtgtatctatatcattgtgatagtaacatcaagagattacaaaaattgttgatatttgatagcaggtatctataaaggacttaagaccttcagaaggtctaattttcaactgcattttctttatttctcttaaagaacaagttaaaagaaatagtttgtatctcttaagtactttatattgcctctgagtattttcaaagaaactcacttatcttgatgattgtgtttcttaacttgacaaagagcatcttcataatataaattccatttattatta

SEQ ID NO: 545937 - DNA, 592 bp, Homo sapiens
  misc_feature (183)..(183): n is a, c, g, or t
tcattggctgctcacgggcgctaaaccagttattgccttccaaggatctgtgcatctgtgacaccgtctaagttgagaactgtttggatagtacctcgagtgacctgagtcactgtgacaggctaactagggtaagtagagtgtcctcctggagtctgaacaggcatctgtcctccagacaangcgccaggtagtgaaccctgtggtggaccaccgcgtcatgcctgtcagtgtggctgtggatacccaaatagcatgctccacttggtgaacatacacatcgttgccctgtaggagctccgcagtagcatggagctcacgctgtctgtggggcaccaggatagcctccagggcatggataacctccaggtgcagggtagcctcgagctcctgggtgtccccatcgtggcacttgtgggtaggcacctcctgccattggagcatagccactaggataaggattctgaccagtagtggcaatagatggctcctgacctgcaggagtatatccaggcaaaggtgggtagcctgctgtcggatagatctgggtacagcattgtgacaccagcagcagtgtcacggcccaacaggg

SEQ ID NO: 545938 - DNA, 1690 bp, Homo sapiens
gcacaggctgagtcaccaggtcagcgctcgctggcactggggctgcgactgcgccatacactgctggtgttgaagagccgaagcgtgtgcgatgcgacccaagggcaggcgcccatggtatcgtcagacggcatgcatccgtggacgggtctgatgtgtatatgaggacctatgtggccaagctgcgcgagcagccatacaggcaggagtgtccgtggcatgtgacatcgcactccaagtatagtcaacgtcgagcgttcacacatgaagaagatgatcgcatcgcgccatgtccgaagtgtcttgctggataccttcctgcttcgaactatctgtacgtggaactacgaggaatgctatcctaggtaccactgtggacctaaccacaccagtggtgcatactaggactattggcgacataggaactgctgcgcagatagtcgtcactatgtacacccgatgcgcgataaggcccgcgtggtaaattggcatagacccagggtcggacctagcgtgtgccactttcattggtgctccggagaaacagcttgcgtttcatgggcgccgagcgctgggcggtggtgtagcttggagaccaaatactctcggggtataaacgtgacgtgcgctctacatctatttggttgaacttagttacgcctgtacgaggctatggctctgtgaccattggggcgtcaccgcctaattgtaattagcctccataataccatcttaaagaattccaatcttgacgcaaaacatctggaagtcgcagtggcaccgaggcggggagccaaagaggcattggtggatcggttgtggctcgtgattaaatagggcttggcaacccgaggcgaaccgaggtagaaacggtgccaggagggcatttcgccttgcgccgtcaaggacggtaaggagcaggggaacaatcggagggggcgcgaggaacaaataccggtcggggttaaccatttggaacacccaccgcgggggattgcgcgcaatcggaactcgttggcgacaagtttcccacgggctcggccaccgggtcctcgttgtgcgagcgcttgggttggggcaagcggagtgaaatgcaataacaggccattgcttggggaagtcctcgtccagagtttgtggccatacaaggttgccatcttagtgacgtgtataagggccaaggtgccccaggatacagttaaacaacgtgactcctgaatggagtttagcccctatagccacagagggccaaacttggtgtacccatgggtagcctagggcccaatgggcccgatggaaacagggcctggacatgctgccttgcaagttaacctgacacaccggcaggggcgagcaactactcagggacccctgagagcggagaaaccgcgcatgggagtagaaacccaggagaggagcacaccagtctgaggagcaggtcccacaccagagagccccatagagttgcccccagcaagcgctccccagggcgacttgaaaagaagagataaagacgtggccacaaggaccactgcaggccagagacgaaatagcctgcgataaacaggccgagaacgatgagacacacagcaacgaggagcgattcaactgtccacaaacagcgcactgatcccccagctctgcatactctctctttacacctttcactacgcactgagcgtcgggggca

SEQ ID NO: 545939 - DNA, 454 bp, Homo sapiens
  misc_feature (110)..(110): n is a, c, g, or t
  misc_feature (121)..(122): n is a, c, g, or t
cccagggtggactggccccccctttgtgggctggggtttgccccctccctttccttgggggggggggcagaacccccccctgtttacaccagcccggttttttccccctnggggttttccnntaggtttttgttttccctgggaaacctggggcaaccccctttaaccttgggccccccttagggttaggccctttttcctgggggggggtcccccccccccccagggggggggtgggtttaccccccctttttttcttttgggggcaaaacccctcccccccttgggggtgggtttccccgggaaaacagccttttttccccaaatgggggggccccccccttttgggggttgggttcccgggggttttttttttcagtgtggggagggggggggcccccccccttcttttggtttttaaatttacttattttaaatttcctgggtgggggga

SEQ ID NO: 545940 - DNA, 388 bp, Homo sapiens
cactgcacgccagccttaccacatcatatttccgacaggctatattttagagtagagggaatagagtaataggatattccgtagaaagtatccatgcctattaaccataggatataagagtagatagagtagtagccaaacataccagctcacttctgagggtttgaaatactctactatttgcctttgttgtcacaggctggttaaattatattataatggagcttatgttacctattgacataaacattgagcccttaaaatcaaaattggagacaagtataccaaagttctgaaatcatccatgaaaggatattcatacattcattccattattaaaatcaaaatcataactagttatttcttctataaaagaaataaattctgc

SEQ ID NO: 545941 - DNA, 119 bp, Homo sapiens
acgctactgggtcgctgggtctcacgacggtgatcggcgctcacgagggcgatgacgttctagatccattgagacacgctctacgacagtagcatgcagatccacccatcggacgtgtg

SEQ ID NO: 545942 - DNA, 363 bp, Homo sapiens
  misc_feature (243)..(244): n is a, c, g, or t
  misc_feature (247)..(248): n is a, c, g, or t
catctcatctgcctgtgtcagctctcagacaccagcagcttagctgacgttggctttgcttggtcaccgctgccatgccgcagatgatgcgcctagctgtgctggagccacacgactattatgttggccttgaactggtactgcagatccctcattttgtctcccttgttcctctgtggctgaggtgggagggtgagggtggggtagttcccccatcattaaattttttcattatcaccccanncannaccaataggtgtgtaggctgtggtggttgtgtggggggttggtgagttcacagatgtcgccccagagcccatcgctgtcataatgtattcttctcctggctttgcttctgcggct

SEQ ID NO: 545943 - DNA, 737 bp, Homo sapiens
cgcatacctgtagtcccagctgcttggggggctgaggcaggaggatcgcttgagacctggaggctgaagctatagtgaatacagatggcaccacctcagcccatccttggcaacagagtcagaccatgttcctttaaagaagaagaatatgtcatacaaaagaccttcgcacagccgggaagagacagtctccagcttatgccaaaagtgctctcttcccagagggaaaagggcagattgcgttttatgcctcacagggcctgtatcacacaatagagtaaaacatattcagcagttttgggagaaaagttatacatatctatgagggaagatgaacacacgtgcaatggataaacatatgtaacacacattccacgctcactttggggtaggcctctacattaaaaaaaagcggaacttgtcccttcatgtcacaaggtgaactattggacacaaagattgcatgcaggctctataaactcgctgacactggctcagggcttcggttgctatcaagaaagatttttgaaggctggtccttgttcaatagagctatagtggtttggttgaaaacacgttgggaagggtctgccaatttccaatacccctattttagccaattaacagaatgtggtttttttgaccctaggaattcggaggtcccagcaacaaaccctgaccttcaccaaagaaacttcgttcttaaatagggtctctatgggggatccttgggtttc

SEQ ID NO: 545944 - DNA, 493 bp, Homo sapiens
attcgcggccgcgtcgactgtagagatagcgtcagaagcattggaacgagagcaactccatgttgaataggggctgggtaaaagtgtcagaggtatttgaaccagagcgactccattttgagtgagggctgggaaaatgaggctgagacttactggcctgcattctcagaaagttaggcattcctaccctctaggattgaattgggacccctttcctgtaacatatttctggtgaccacagaagggactatagtgcagaaacgttgacccaacggctacctttgcgtaagtgttggggtcctgtaacatatttctggcaaaccacagaaaggatgatactgaagaaatccccccaaccccaaagaaatagactgcagcactgattggacgactttgggtaagtgatggggtacccgagtaacaaatgggattgggttagaggcccaacttagggggagttggagtttctcctaagacagagtgagttagaggc

SEQ ID NO: 545945 - DNA, 170 bp, Homo sapiens
atggtagagactagggagcaggacggagtggataacagaggcaagcggtcaagggcatctgggcagcagctcccatcgccttcccggtactggagaccagactggatgtagtaagcagaccagtaatgtatagcagagcagcactggcaggagcaccaacgaattgcctg

SEQ ID NO: 545946 - DNA, 179 bp, Homo sapiens
caggagagatggctatgagtcgttagtcgtagtatctaatcgtattgccccgccggatgacaaaaaggccagcgccggtggccttgccgtggggattatgggggcattaaaagcagccggaggactgtggttcggctggagtggggaaatcggtgacgaccagcagccgttaaaaaaag

SEQ ID NO: 545947 - DNA, 132 bp, Homo sapiens
tcgctcactgcagcatgatgtccttcaggttctcctgcaggatggtgtctttcacagcatggaacacttcctcatccgtctggttcgtatcgtgttccatctcctgggattgggctatcaaggtaccgagct

SEQ ID NO: 545948 - DNA, 204 bp, Homo sapiens
ctcaccctatatccctacactttattaggaggccaaaccagacagataacaagaggttgggagttcgagaccagcctggccaatagggtgaaaccccatctctactaaaaatacaaaaatgagctgggcgtggtggtgtgcacctgtaatcccatctactcgggaggctgaggcaagagaatcccttgatgtgagcagcgttgg

SEQ ID NO: 545949 - DNA, 440 bp, Homo sapiens
ctcttgattctaggctgttccaggaagaaaataattagggattaatacctaaaataattctccttctcaataatgtcactttgggactgatagcattatttgcattttaaaacaaaggctgggtgcagtggcttatgcctgtactctcagcactttgggaggctgaggtgggaggatcgcttgagctcaggagtttgaggccagcctggggaacatagtgagaccctgtctttacatttaaaaaaaaaaaaaaagaataaaaatgggaagttagcagtcaaaataaaattaggtcccttttaggggcattacctcttgtaaagggtaggtttcaggaccgggtgctatggcttatgcctgaaacaccaacactttgggaggccatgatacgaggatcacttgaggccagtccaggcaacagagtgaaaccctgtctctac

SEQ ID NO: 545950 - DNA, 158 bp, Homo sapiens
tcgctcactgcagcatgatgtccttcaggttctcctgcaggatggtgtctttcacagcatggaacacgaagcggacgttctcgtgtcgatgcggtgtgaagtgatgaagagtgctgctgcgttactctctcctgtcgaagcactgacaaacctctaag

SEQ ID NO: 545951 - DNA, 851 bp, Homo sapiens
  misc_feature (65)..(65): n is a, c, g, or t
  misc_feature (84)..(84): n is a, c, g, or t
  misc_feature (92)..(92): n is a, c, g, or t
  misc_feature (101)..(101): n is a, c, g, or t
  misc_feature (117)..(117): n is a, c, g, or t
  misc_feature (121)..(121): n is a, c, g, or t
  misc_feature (126)..(127): n is a, c, g, or t
  misc_feature (136)..(136): n is a, c, g, or t
  misc_feature (139)..(139): n is a, c, g, or t
  misc_feature (145)..(145): n is a, c, g, or t
  misc_feature (148)..(148): n is a, c, g, or t
  misc_feature (150)..(150): n is a, c, g, or t
  misc_feature (159)..(159): n is a, c, g, or t
  misc_feature (163)..(163): n is a, c, g, or t
  misc_feature (171)..(171): n is a, c, g, or t
  misc_feature (174)..(174): n is a, c, g, or t
  misc_feature (185)..(185): n is a, c, g, or t
  misc_feature (202)..(202): n is a, c, g, or t
  misc_feature (206)..(206): n is a, c, g, or t
  misc_feature (208)..(208): n is a, c, g, or t
  misc_feature (214)..(214): n is a, c, g, or t
  misc_feature (217)..(217): n is a, c, g, or t
  misc_feature (219)..(220): n is a, c, g, or t
  misc_feature (244)..(244): n is a, c, g, or t
  misc_feature (254)..(254): n is a, c, g, or t
  misc_feature (280)..(280): n is a, c, g, or t
  misc_feature (284)..(285): n is a, c, g, or t
  misc_feature (288)..(288): n is a, c, g, or t
  misc_feature (322)..(322): n is a, c, g, or t
  misc_feature (329)..(329): n is a, c, g, or t
  misc_feature (343)..(343): n is a, c, g, or t
  misc_feature (345)..(345): n is a, c, g, or t
  misc_feature (351)..(351): n is a, c, g, or t
  misc_feature (358)..(358): n is a, c, g, or t
  misc_feature (371)..(371): n is a, c, g, or t
  misc_feature (392)..(392): n is a, c, g, or t
  misc_feature (406)..(406): n is a, c, g, or t
  misc_feature (415)..(415): n is a, c, g, or t
  misc_feature (417)..(417): n is a, c, g, or t
  misc_feature (468)..(468): n is a, c, g, or t
  misc_feature (470)..(470): n is a, c, g, or t
  misc_feature (473)..(474): n is a, c, g, or t
  misc_feature (478)..(478): n is a, c, g, or t
  misc_feature (483)..(483): n is a, c, g, or t
  misc_feature (503)..(503): n is a, c, g, or t
  misc_feature (510)..(510): n is a, c, g, or t
  misc_feature (526)..(526): n is a, c, g, or t
  misc_feature (636)..(636): n is a, c, g, or t
  misc_feature (730)..(730): n is a, c, g, or t
  misc_feature (851)..(851): n is a, c, g, or t
agctctcagtgtgcctctgtcctttgccacaaacatgaggttcacattccctctcaaggctaaantcctggaaaatgccaagantgttttanttggattanttgttgagtatgaaanggancaaanngttctcgancanctcaanaanancaaaccaanaaanaagggcanaanctttgagttanaacctctgttccaaaangtanangttatntananntgttgggtttggcttcctcatgancttcctgaanaaaaaaggcttcagcagtgtgggtancaanntantcgttgctgctttgggcctccagtggggcactantgtacanggaaacctgcaaancnaagganaaaaaantaaaattggaaanaaaaaaaaaaaaaaagcaaanatcagtgcagccanaattctganancttttggagctgtcctgggaaaaacaagccccacaccaaatgctgatcatnanaannttanaaaangttttctttgcccacaatgnatacctngttagtgaaatatttnaggcctctgacattggagcatcaatgacgatccatgcctttggggcctactttggcttggctgtagcaggcatcttgtatcgatctggactgagaaaggggcatgaaaangaagagtccgcatactactcagacttgtttgcaatgattgggactctctttctgtggatgttttggcccagctttaactcggccattgctgaanctggagacaaacagtgcagggccattgtaaacacgtacttctctctcgctgcctgtgtgctcacagcctttgccttctccagcctagtggagcaccgaggcaagctcaacatgattcacan

SEQ ID NO: 545952 - DNA, 294 bp, Homo sapiens
  misc_feature (7)..(7): n is a, c, g, or t
ccggagngcagcacggaatctagaaatgatttaaagtatatgtgaggatgtgtgtaggttacatgcaaatatagtcatacactattaggcaatttcctcactgtaggaacttcatagcatgtacttacacaaacctagcttacaaacccgtacagtatttactgtactttatactgtagataattgtaacacaaagtatttacgtatctgaacaaagaaagaggtatagtaaaaacacagtcttacggtcttatatgagaccactgtcatatatacattccatcattttttgtt

SEQ ID NO: 545953 - DNA, 127 bp, Homo sapiens
atgtagtaactaagagatagatgtatatggtatactacgcagtgacagactgacagacgagggtacagtgcaacaaacataagatcacaatcacacaatgaccagaatcgcctgacacctgaacaaa

SEQ ID NO: 545954 - DNA, 160 bp, Homo sapiens
atccacctgtcttggcctcccaaagtgctgggattacaggtgtgagccaccacgcccagccaaaccttctgttattagtgaactatcaattaactagaacttacttgtcacccagcaaataggcttgccggcctaaaggtttaactgattgccatatact

SEQ ID NO: 545955 - DNA, 591 bp, Homo sapiens
  misc_feature (481)..(481): n is a, c, g, or t
ctgtttccattcaaaccggcgctcctgtgcatcatgaaaccctttctagaaagcccaaagcctcatctgggagtttcttcttgagccacggcagaccttgaatgatgttgatgagaacggctcgggcgtgagcttgtacctgcttttgacccttccggaatttgcctcatacactagttcccaactgattacacctgcttgaatgaaaccgacttatttgagacacgtccaggggccgtcagattaacgcttgaaagatttgtcgggggtatagggactgactactccacaccagaggtaacccggggcgaccagctgtgagaatgacccgacatagtcatgatctgaggcatagagagcatctctgtgacagctgcctttattgtccccagtgtttacgcagacctcctttcgagacagatgtctctcctactaccacacaaacagagctgtgcattactgcgcagggagcagacggtancctatgtcgttgggagcggcaccttgaggaaacctcgaagctctagtttgtttctccgggcaggggagacaaatcagtcctggaagtgtgggcatatttcagggtatctt

SEQ ID NO: 545956 - DNA, 178 bp, Homo sapiens
  misc_feature (38)..(38): n is a, c, g, or t
  misc_feature (161)..(161): n is a, c, g, or t
  misc_feature (168)..(168): n is a, c, g, or t
ggcaacatagtgagacctcatctctacaagaataaaanactagccaggcattgtggtgcatttctgtagtcgtacctactggagaggctgaggcaagcggatcttgagcccaggagatcaaggatacagtgaactatgattgtaccactggcgttcccagnataggcnacacagccag

SEQ ID NO: 545957 - DNA, 919 bp, Homo sapiens
tgatcagatgcaatgtccttgatacccccatggtgccaccccaatcacagtcttggccaccagttctcctacctgccccggatgctgcctccagtacccatccctgtccccagtcccagctccatgcctcagatgaggaggagggcgatcggcagagccccccactggagctgtctgtacggcgagacgtatggcctggagccccgggccatgggctcctgcctggcggagacaggcagcaagaagaagatccgcctgtaccagttcctgttggacctgctccgcacgcggctgacatgaatggaacagcatctggtgtgcgctggacaaggatcaatgggcaccttctcagttctctgtccaagcacaaggaggcgctggcgctccgctggggcatccagaagggcatccgcaagaagatgacctaccagaagataggtcgcgcgcgctgcgcaacctacggcaacgcacgggccgaggtcaagaaggttgaagtaagaagctcacctaccagttcagcggcgaagtgctggaccgccgggggacctggccgagcggctgccacccgccccacatgagcccgcagcccccgccgggccccgccaaggcctccaccgactggccaatagcactctaagcccatcagccacggcccggaacacagggaggacgactcccggggcccagatggcaggacctgtggcgggccgaggcctcagctctcactccgccacgcctcgcgccccactccaggccccctccacatcccgcttcgcctccctccaggatctccaccccggctcacggacgccagctgggcgtcagaccccaccggggcaaccttagcagaggacgacccggggtactgaccttgggagtctcaagtccgtatgtaaataacatctcacgctctcaccca

SEQ ID NO: 545958 - DNA, 172 bp, Homo sapiens
attaggccacacacacatccgtaagcctactaccacactcattcacacccaccacacaactatcaataaacctgggtatagcaatccccctatgatcagcgaaccgtgtacacaggattccgccataaaaccaaaacatcactagcccactttctaccacaaggaacacccg

SEQ ID NO: 545959 - DNA, 320 bp, Homo sapiens
  misc_feature (125)..(125): n is a, c, g, or t
  misc_feature (137)..(138): n is a, c, g, or t
tttttttaatttttttttataaaaaaaatccataaattcttggggaagggggttataagctttaataattccctttagcggcccccccggggggggtccttaacaccacgtggggttaatatttnaggccccaaaannctttggcccttttggaataaaggggaaaaaaaaccccccccaagtaaaagggggttcgtgaattgtccccctaattttttgggggggcttatgggctttttttgaaaggggggctttcccattttttttttttaaaggggggggggcccctgggatttttccataaaattttttaaatttta

SEQ ID NO: 545960 - DNA, 1385 bp, Homo sapiens
catcatagtccagaactcttctgagtgaccattctagcaagatgccataatgcacattttcgaggttacaaggactgtcctctagtaatgctggcgagagatgaggagctagtcgaaatggttaaatttccattggggaacaaaccgcattgcttcagttgcatggtagtgccacgcgcctgagcactgctcgatcgagacatgtattccgcaggacctcagtatgcaaaacacgactcgacttctacacatcgtgtttcaacacgacggaacctaatcaggagtgcgatctgaactctcagtaggatgtaaggcaatcgcaggatttctaccaccgcgatagggacctgactcaacgaaagacagcacgcaccattcctctccaatttctattggattcgtatcgcgcctacgatcacgcaccacctccgtggatactcgatcccattttgtcgtggcgattcgaccgcggcggtcaggttcccctttacttgcaacacctttccggcgttctgagagcggcatcttactaactggggctcagacattcctagttgctcacaaagcagatctttaccgaagccacacttcgctacacagattaaggcttgtcttctgggcagagcatatgttcacatcgagcacccatttggaacagattctgatcccacgtggattgcacctccgctcacagccatacatgtgccatagctcttggcgacaaaatcttttgtggaacacacacgtgagccccttattgcctttctaagaagagccgcgttatatacactagtcttgtgcacttgcgcttcctcaacgcccactatcgacctgatcaggtaacccagcgtggctctcatttcccgcaaaaagaccacggcacttaccgtgggcaactacccactcacgggaaggatagtatatatcgaccccttggatcagcatcctttcactggacgtgagaaagaacatagcaaattcggcactccttgtcttaaacttgaaacaggccactttttcaccgtggaatgaagacaacctcttgaaaataaccatgaggtaacagtttaccgcatcaatcaactcacttttatggacatcttcgcgcaggtcactccttagttgccttgagtccatgcaccgctttccgttctgaaccactcggcacttctcaccgtcgagaagtcacgacatttctcatcttctgtggtccagctaacacacgacacggaaagcaaggcggaccaaaggaaccccgtccgacacggacacccgctcagcaggtccacaaaaccactcacacaaggtcaccctacgagcgcctgttcattgagtctcattccagcacagccgcaaagacacacactaaacaccagacaaaaacc

SEQ ID NO: 545961 - DNA, 143 bp, Homo sapiens
ttcaaggtttggaaactgcaaatgtccccttgatggggaatccgtgtgtgtgtgtgtgtgtgtgtgggggggggtgtgtgttttctcctaaacccgtgacctgaaatgtgtgatttttagtcattaaatggaagtgtttgcca

SEQ ID NO: 545962 - DNA, 420 bp, Homo sapiens
taggtggaccgcgacgtaagcaatagtatagttcctagggaggttgtgatgacgcagtgagtgaatgtgaaggcaacacttcagcgctggcacctaggaagtgctgcacgaagccttgtggacaggcagaagttgggtgtctttgagtttgaggctggggtgagttaatgtaagggcaagtactgcaaatgctccagaacccttaacaaagtggcagctacggccatggctaggataacactgcacaccatttgtgccactgagtcccggttaatacttaccaccttgaggaatcaccaagacctgtcaatctgacctcctaacttcctctcacatctgtaccttctcccaatcactggcacctctccaaatcaaagccctgttacttctcacctaaacaattacaagaccctcctacct

SEQ ID NO: 545963 - DNA, 169 bp, Homo sapiens
gtgtattcaccactgcggttcatgccttccctggacaagttccgtcgacacggtgagcaccgttgttgacctcccaagatatcggttcagctggagcctggtcgacgtgtattcaccactgggggcatgcctcccctgtacaagtccgtcgaacgtgagcccgtgctga

SEQ ID NO: 545964 - DNA, 233 bp, Homo sapiens
gacagtttgaacatacaaaacccaccaccgagaccacctcacacagtactcccagcttgacttcttcaaggaccgccaccaggcccagctaaattttttgtcgttctcttagagatgggatttcaccatgttggccaggctggtctcaaactcctgacctcaagtgatccgcccgcctcggcctctcaaagtgctgagattactggcgtgagccactgcacctggctactgga

SEQ ID NO: 545965 - DNA, 106 bp, Homo sapiens
tcaggactcccagctccatgcgccgcaataatagtgtatagatgttccacatgtcatttgtggttagtcagcagcaatcagtccaactggtctggctgcaaccatc

SEQ ID NO: 545966 - DNA, 1047 bp, Homo sapiens
agcgggaggtagtggcagcggcgccgcgtcgggagccgccgccgtcccggtcctcccgctcgccgtgaattggtgcctccttgattactggcttgcttggtgagcaagtgacaccggactacgtaaccagttgctactggaatgtcacatagcatatcagtcatgcagtcaatacacgcacttgtgcctcctgttgtcatacggtataaccgaggcggtgagcataagttgcttatgcttgtggaaccagaatactacgcatttactgtactctccaaaagtattggtacttgtgcgggtcagcctaggttatatgctaggctggtagagcctgtcagacacccgtgagaccaggtggttaccatttattagatacgcaagataccgaataagaccgaatgaacgctctcggagtggaccttctttgaacccatactcggaaaactttcccagtgcgtgacagcaggtcagttggggtgcagtagatacatgtggatacggacccttggggtttcacctgttttgtgcagtcaacgtcttatagcgtctggcacaaggtatttcataaacatgtctggatacacgtaagcttacgggcatgtgtaaaacaattcactgaaggggtggccttttcatttaggtacgtgtgcgcctcgaaccacatgggctccgcatgtttaacgcatttcgcggtgggtatgcatatgaggcacgagggggataaattggtcgcccctccctagtaaattttggaaaccccctagttgaattcgtatggctcgggtggcacgtggatttgcttattgcataccaccattggcaggaggggtctgttatgagctgtcccagtgggcctgtatgactgtgcccaccttatgggtaaaccggcacacgtagatagaagccaccctgagggttccttttagcacacttttcagcagcgaggcatcgagggggcgttatctacctttcgcaagggacctgattgtcctcacattgctactggatgcgcctattgtgcaatagcccattcggcatcccaaatta

SEQ ID NO: 545967 - DNA, 240 bp, Homo sapiens
  misc_feature (33)..(33): n is a, c, g, or t
  misc_feature (43)..(43): n is a, c, g, or t
  misc_feature (187)..(187): n is a, c, g, or t
ggtgggtggatccccgagatcaggagatcaagncccatagtgncccaacatggtgaaacccccatctctactgaaagtacaaaaattagctgggtgtgttggcacatgcctgtagtcccagctacttgagaggctgaggcaagagaattgtttgaacccgggaggcagaggttgcagtgtggtgagntcatgccactacactccagcctggcgacagagcgagacttggtttcaaaaaaa

SEQ ID NO: 545968 - DNA, 285 bp, Homo sapiens
  misc_feature (136)..(136): n is a, c, g, or t
  misc_feature (218)..(218): n is a, c, g, or t
  misc_feature (269)..(269): n is a, c, g, or t
cagtagcaaaacaaacaaaacaaaacaaacacctaccttcccccgacccagatagtccaattaaaaacaggccagagatctgaatagacatttctcaaaagaagaaatataaatggccaacaggtatatgaaaaantgtttaacatcattaatcaccagagaaatagacattaaaatctcaatgaggtatcacctcaccccagttaaaagtgcttttntcaaaaagatgatggagtaaaagatgctgacaaagatgtagagaaagaggnacactcatacactgtt

SEQ ID NO: 545969 - DNA, 939 bp, Homo sapiens
  misc_feature (292)..(292): n is a, c, g, or t
  misc_feature (326)..(326): n is a, c, g, or t
  misc_feature (337)..(337): n is a, c, g, or t
  misc_feature (342)..(342): n is a, c, g, or t
  misc_feature (351)..(351): n is a, c, g, or t
  misc_feature (356)..(356): n is a, c, g, or t
  misc_feature (700)..(700): n is a, c, g, or t
ggctgtcgccgcgggagcagacggtatctctgttgtgtccgcgtgtgcgccggtccccgcctgccgcaccatggagagctaccacagtgcctgaccagcagaagctgcaggatcttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgacccgcttgtgctcntccggccatgcagctcccatcctctacgcgtctnggctgaagctngtttnctggccgangcggngtgctgaactgaggaagatcagtccgacttggacggcacccggtcccgagacaagttttcaccgacgtgtggcattggtccctgggccagggcctcgggtgccgtgttgtgcgagatggctacaccggcaaatacttctgatcataggccatgcctaccgagtctattgcttgctgggagatggggagctgtcagagggctctgtatgggaggccatggccttcgcagatctataagctggacaaccttgtggccattctagacatcaatcgcctggggcagaagtgaacctggcccgtgcagcaccagatggacatctaccagaagcggtgcgaggcctcggntggcatgcatcatcgttggttggacacaagcgtggaggagcttgtgcaggctttggcacggcaagcaccagcaacagcattttgcagacctaagggcgaggagccgggacaaaaaggagctggtggagccccccaaacgtggtgataccaggattgcctcccgaagaatctgacctcaggagccggttgttgtccgccctggaaaacccggtgcggaggtccatcgggcactaaagggc

SEQ ID NO: 545970 - DNA, 231 bp, Homo sapiens
ccatttagcctggcagtgtggagggctgtgtacaaggccctgaggatgccctaccgaatcctgcctcggcagctgccccaaaaggggcgtcaggtggccacagctgtgcaatggaccaaggcgagaaggcagctatgggtcccactggggatcatcatcctgagccatcctgtttggcctcctgctcctgagtctactcatctacatcctctacaagcttggattcttcaa

SEQ ID NO: 545971 - DNA, 362 bp, Homo sapiens
cccggacgacgcatccttacacagcatagtacaccacgaaaaaatatgaatatggagatctccttcaccctcaacttaattgcccagttatacctcagtgtggtagcagtactgtgatcgcgggcacagtgcttggatcttacgatgccctcggtactgacctgaaggagacctacgagtcctttcccttttggagttggaatcatagccttgatgtggtctctggttttatgtcctgtgttcctaatgtaaaagtgcttaagggcttctgggtggtatggggtagattggggataagatttaaccggggtacttcttgaatggcttttacaagtaaaccaattttataatctttaaattta

SEQ ID NO: 545972 - DNA, 452 bp, Homo sapiens
  misc_feature (292)..(292): n is a, c, g, or t
  misc_feature (326)..(326): n is a, c, g, or t
  misc_feature (337)..(337): n is a, c, g, or t
  misc_feature (342)..(342): n is a, c, g, or t
  misc_feature (351)..(351): n is a, c, g, or t
  misc_feature (356)..(356): n is a, c, g, or t
  misc_feature (416)..(416): n is a, c, g, or t
  misc_feature (448)..(448): n is a, c, g, or t
ggctgtcgccgcgggagcagacggtatctctgttgtgtccgcgtgtgcgccggtccccgcctgccgcaccatggagagctaccacagtgcctgaccagcagaagctgcaggatcttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgacccgcttgtgctcntccggccatgcagctcccatcctctacgcgtctnggctgaagctngtttnctggccgangcggngtgctgaactgaggaagatcagtccgacttggacggcaccgttccgagtttcaacgagtngccaatggctcctgggcggctcgggcgctttnggtg

SEQ ID NO: 545973 - DNA, 261 bp, Homo sapiens
  misc_feature (40)..(40): n is a, c, g, or t
  misc_feature (140)..(140): n is a, c, g, or t
  misc_feature (147)..(147): n is a, c, g, or t
  misc_feature (193)..(193): n is a, c, g, or t
aaaatattaatggccaaatttttttaagtaatttactcanaatacatgtccttttcccttagtttttttctatcataatacacacaaagcttgaagatgaatcaacaattcttggatttaagtacttttatcctaaatanttaaatntctataaaaattaatccatctgagcacacaaactttacataagcanaaggatttatgaaacccaatgagacactgtaaacgaattgaagaagtaaagttaaacttataacagtc

SEQ ID NO: 545974 - DNA, 648 bp, Homo sapiens
  misc_feature (543)..(543): n is a, c, g, or t
ccgctaatgtgtgaaacgcagacttgcgggtactataacagaggttaggacttaactttactatcgccatagaataaccattaacacctagactactacatgtccaaggcaacatacatgtagcggcatattccctaccatacttgcgaaggcattctataccctaggttgccatgcacgattgctgaatgacaaatactagtttgcaaaaggccaaacctgctttaaatattggagcgttacttagaatcaacgaattttaaagctgtaaggcaattgaactcagggcattatcgatcatgttactaggacttactggtgacatactgagaacaatgtacatgcccctaatatgtaggtacttttagaccaaggttagaactatatgttcagatccattgagatgaaattaccctaactccttcgacggtaatgatacacctggctgttaaggatatcctttaaagttatgattttatgagcacttaatagcactaccagatttagcaaggaccactataagatatctacttcaattgattntcagatatacaaccattaaattgtatcagtagaagtatatcctttgcaattattgagagatcgcttaacattgtacgttggtcattctgacatttaccattgtcc

SEQ ID NO: 545975 - DNA, 149 bp, Homo sapiens
aataagcagtcagcttcatcctgctgtgactctagatgatccccccaccttttccgtggggggaggtgggcaggctgcagagaggtggtggccatgtggtgtgtggtctgtgataggcgggtcaggttgtgcccacgtgcataggtggg

SEQ ID NO: 545976 - DNA, 216 bp, Homo sapiens
  misc_feature (14)..(14): n is a, c, g, or t
  misc_feature (54)..(54): n is a, c, g, or t
  misc_feature (69)..(69): n is a, c, g, or t
  misc_feature (71)..(71): n is a, c, g, or t
gatgtctgcaaaanccagaaagcggcaaaagcaggtaaccttgtcacgccccgngactttcacatcaancntttttcaaagttgcttgcccctggcttgaaaggagaaaactcccaagattgagggaatttgggggttttttcttattaaagggggttttcccttgcttggaaccaggggttgttgggatttgaatttaaaacagctggcgacaac

SEQ ID NO: 545977 - DNA, 454 bp, Homo sapiens
gggtcaaaatattagttgtctcctagtgacacaagaggtgcaggatccccgagaacaacccacacccaaagagccagcgaacacaacccttgccaaagactgggggctgcgacagaataaaagagaacagccttcgccttcccatgcctatttgcagaggaggaaatgttcagaagtaataggaatccaccactgaaggagaatcaaagctcacagagacctcctttgagacgcaggcacaaaagaaaggctgaaatcagatggtgagaagacattgagggaaaagtctggcaaaactatcctcagcctaaacacactggaggcatttaaagtttgtgctgcactaagggtaacaggcgaatcaataacaataaaatgaacaatcccaaatcaggttctaaatggattggctcaacccccagactaaaggtttcaacagagaggggcggagcag

SEQ ID NO: 545978 - DNA, 1006 bp, Homo sapiens
  misc_feature (324)..(324): n is a, c, g, or t
gaaagtataggcgatagaaatggaaacctggggcaatagatataggtaccgcgaaggtgaaagatgatgaaattatagccaagcataatatagacaatggactaacccctataccttctgcaataatgaattaagctagaaataactttgcaaggagagccactacgctaatgacccccgaaaccagatcgagctacctaagaacagctaaaagagcacacccgtctatagtagtcaacaataggtgggaagatttcataggttagaagtgccgatccatagtctcatcctgagcctggggatgaactaggttgtccgacgatnagaatctctgagttacaagcatgtgtaaatagttgtagcgccgagcagtaacccgtctcaaatcactccttggtaaattttgatacttgtacagtccaacaagagggaacgaggtctttggacagctcagtgacataaaaatccttgtagcagagacgtacaaaccaatttaacagccatagtaggcctaaaagcggccaccgaagtgaagaaagggttcgaaagctgcgaaacatcctatctacctacaaaaatatcccaaacatattagtgaactccgttgacacccagaattggaccaatctatcaccctatagaagaacgaaatgtctagtataagtgacacatgagaaggcattctcctgcggatgagcctggcgtcggatgtgaacactgatctgacaacttaagagccaaatatctacaatgcaagcacaagtcattatgaccatcactgtcaacccagcccaggcatgctcataaggagaggctaaaaaaagtacagggaacccggaacatcttaacccgcgtgttgacaaaacatactttagcaatacagtgacaaggccgctgccagtgaacaagttaaaggcgagacctaatggaaaagtcgtaacaaagacctaaaggacgtataaaggcaaaagagaacattattaaagaagactcgaaaggaaaaaaa

SEQ ID NO: 545979 - DNA, 551 bp, Homo sapiens
gcatgtgttatcaatgtgttgtgggtgggtcagtgagctctctattcaggtaggagcggaaggttggctcagggctcatccagtccaattgtcccacaggtatagaagtgccctgattaaaactctcagagtctggctgtccagtcaaggattggcatacctccaagaaatggggctctaactaccccttcagagtagcccattctactgtggggcacctccaatggtcagcatttcctttccggcagcctctttcctgggctggggggtgggcggaaactgtcactccagcctaaccctcagaacaagagaggcagctggggtggaaacagaagcggaagaggtaataagtaaattccaagaatgaacagagacacggcagaatgggcagggacattcctggggtgccagcagtctctagcttgatccaggaggcactggggagaaggttgctgatggcaagattccaggcaggaggtgactcaaaaggccgggttgtcaatgcccctctgatccccggtatattcttcaggccttaagctgtaggggac

SEQ ID NO: 545980 - DNA, 533 bp, Homo sapiens
tctagaggatctcggtgagcagctggagagatagggccaagtgatgggctcatctaaactaattacatctgcatggactggtgtttcccaagtaaggtcacatttggaggtactagggcttggacttcaagatatggatttggcaggggggcataattcaacccataatacacaatttagaaaataaaatcatagagcgtggggccagacatggtggctcacgcctgtaatctcaacacttggggaggctgaggtggttggatcacttgaggtcaggagttcgagaacagcctggccaacataatgaaaccccgtctctactaaaaatacaaaaattagctgggctgggtggtgcatgcctgtagtccgaactactaaggagactgaggcaggagaatggcttgaacctgggaggtggaagtggcagtgagccaagatcacgccactgcactccagcctgggcgaccgagctagactctgtctcaaaaaaaaagggtgccaaggcagagtacgggagtggtgacccggagctt

SEQ ID NO: 545981 - DNA, 447 bp, Homo sapiens
atgtgcatgcatgtgcactgacaccacagattttatttaaccagtcatcaggttctctgaatggattttaatgaaagctactctgtttccctgatttcaacctaggatgatacatcagtatgcatacacatacacacttaacagaaacatttagagaaagtagctgaagttgaggaaggtaaaccacagcttaatacagcaatagaatattaaaagtttgtattaatttgggaagaatgtactttctaagagagttactcaactggtgatgtaaatcaatcatggcaggtgactgagaaagtcatgaaaagtgctggagcattggcagaagtgagggggtctcttttaggtaatgtgtgcttgacgatgtcatagtcattcagactattcatttaatggcatgtgtctaaggtttacaaaaaaaaaaaagtcgacgcggccgcgaat

SEQ ID NO: 545982 - DNA, 87 bp, Homo sapiens
aagcagtggtatcaacgcagagtgcccattacggccgggtcactcctgataaataacaaatttggagaaataaaaatatctaaaatt

SEQ ID NO: 545983 - DNA, 1231 bp, Homo sapiens
ggagagagagaactagtctcgagttatattttatttttttaaacaaaagggaccttgaaaaataaaatcaaggccggctatttaatggatgccgcccacagaagccacccacaattgtgaaaggcatgataatgtaaacaatacgagataatctcactcaccaaaagcaactttaaatactacaaagtctatattctgtgcaagcggctttggcgaggtgccagtgcagtgccctctacaataaatgttaggggacaacgtggcgcaacacgcgtagtcaccaggcggagactcaacaaatataaagggggtactctatatacaggagaaaaatatctttatccccccacatttctgttgtgaaaggagaggaggagggcctatatcagggaataatcgggggagacatgttggggaaatattccagagaaaaaaatcaaatactatactactcacatcaagacacacagagaggggagaaaggacaaacctagtggaggggcgccgaaaactgcgcggcgacgaaggaggagataaacacacagatacatgagcggaaggaaagaggcaccaccgccgttaataatagagcaaaacgaccacaaaaaagcagacggaagaagaggaaggcagcggaggacgtcgaggtagcaagcaaaaaaaaaagagaaataaagggaggcagacacgacaaaaaatacaacccacgcaggagaggaggacaaccacacagataggtggaaaaaagaaaatactaactaaaccaggcagagagaaacaacgaggcaagacaaaaaaaccaaaacaaatacagtcaacagaaagaacgaaagaacgaacaaacacaccgccacgataaacatgcccctacgaaatagagtagcataccaccacgaaaatctatatacaaatcgcaaacaaataggagagggaaagacaacgatattcccgcacgcaaaagacaacaagagcacacgaggggtagagacccaaaataaccaaaacaaaaggacggacacaccacaaaaagaaacaagacacgatgagagcaggtaggaaaggaaacccgcgccaccccaccccgacggcagggcacacaaacaacacttacaaccccgcgcgggccacccaacgaacatagaatggcgtgaaaagaaaacaaacacaaaaacggaacagagaaggagagatgaaggagaacgggccaacagcaaagcagaaagacaacaac

SEQ ID NO: 545984 - DNA, 1383 bp, Homo sapiens
  misc_feature (561)..(561): n is a, c, g, or t
  misc_feature (604)..(604): n is a, c, g, or t
tactccttacactattccttatcacccaagctaaaaatattagagacaaactaccagctacctcccgcacgcagagcccataaagagtaagacaaattagtaacagagagccctggagacaccgaaagatgacacgaaaatcatggtgtcgctgtcattcagttgcccccagcgatgtcctagcggccgtagcccgtccgcagctagcgtgtatcattctagtgtgtcccgccgtgcgtagttggagtcgcccaaccttcgcgagagtagcatcgtcagtccagagcgagagtccgggaccttatatttcgagccgagcgcgcgagaccacagtggagcgttagagtccaagacttagagcgcctcgaaacagagctaacaataggaattaagtcccactaaccagtcgagagcgagctatatatatgcgtaccggaaaaccgtggagttcgtcgtgtgagttagcgtaagggtacttcccgtgtgagcatcacatttgtctctcatgtggcccccaacaaagcatacagcgcgttccccttcggggaagcttccctggcncttctaacattccactattatgacgagccaaaaacgcgagcgnccatagcgtgagttcgtcataaaagccctgaggcgccatggtcgcagtcgcgccgtgtactgaggcgaggcggcaggtgcacttcactagggcctttcgactactaaggagttaaacgcaatggcccgtagcaccacattcgttaccatcaagggcacaccgtacaaccccctttaatccccagtactagttagttatcgaaaagccatcagcgcttactcattgcaagccaaattagccctgggcccgtactgcctaaaccggtaacatttactggcagggccaaccttacctcattgcaccctaaattgggaaagcgccaccctaagcaagtatcaaaccaattaaaccttcccctctaccactgtgattcatcttcacaaattcctaattctactgaatattctaaaaaatcgcttgtcgccttaaatccaagcccacgtttccccactttctagtaagactcttactgggacgaaaacattaagacacaagagaacctccggattatatttacgtggccggcgcagaaatgttacgaacaggggaccgggcaaatgagtggtctctgaccgcttcgttccaacgggaaacttacgggcccccaaaagagcgcgcataatcaacgagagaatagtgccgacaaaaccacataacctaaatgagtaatataggcaatatcgataaacacatacacaacaccaacacagcaatatatcacaacacatacactgatcaacacatacatagcaatacgctttctatctatctttctttgc

SEQ ID NO: 545985 - DNA, 402 bp, Homo sapiens
tccggttattgcaatcagcactctcgagtggacctgaggagctcttcacaagctcgaacgattggaaagggctcgtagggggaggtctacaagggcatcgataaccacacaaaggaggtggtggccatcaagatcatcgacctggaggaggccgaggatgagatcgaggacatccagcaggagatcactgtcctcagtcagtgcgaaagcccctacatcacccgctactttggctccgtacctaaagagcaccaagctatggatcatcatgtagtacctgggcggcggctcagcactggacttgcttaaaccaggtcccctgaaggagacatacatggccacgatcctgcgggagatcctgaagggcctggattatctgcactcccggcgggtaccgagctc

SEQ ID NO: 545986 - DNA, 440 bp, Homo sapiens
  misc_feature (154)..(155): n is a, c, g, or t
gtttctcatgggtaatatagggataattactggcacctgcctcccaggccattctgacgtgtaaccgcatataggagcccactggctgagtagctaccatcatcgctggtggggaaactggtggtaggggtgtgagggtagtgggggtgtcagnnctccaggtgttttagaacaaggtctggggcactcacaagtctgcctcttggctgacaccctcaaagcccatgttctgtgaggccacatagaacacatgcagtcttagcaaatgaactaatgactaccgtgggactgcctggaccacctgggcactctgatggctacaactaatacgtcctgtgggggcattggcagagttcccccatgatgagggccacgatagaatttggaccacttaggggtaccattccaacccctacagtaattgcacccggggccttggg

SEQ ID NO: 545987 - DNA, 115 bp, Homo sapiens
cctgtgtcaggttgtgctgttcgaattcatagaacaggcaggttagaagtagggtcttggtgacgaaatatgttgtgtagagttcaggctcttggtgaggagcacaagctgggac

SEQ ID NO: 545988 - DNA, 496 bp, Homo sapiens
  misc_feature (54)..(54): n is a, c, g, or t
  misc_feature (56)..(56): n is a, c, g, or t
  misc_feature (61)..(61): n is a, c, g, or t
  misc_feature (65)..(65): n is a, c, g, or t
  misc_feature (67)..(68): n is a, c, g, or t
  misc_feature (72)..(72): n is a, c, g, or t
  misc_feature (74)..(75): n is a, c, g, or t
  misc_feature (83)..(83): n is a, c, g, or t
agaaacttcggtcaactttcagtggatccaaatggacatcatttgtcttcctantntgacntatncnnaatngnngatgacanatgaatgtcataggatccatgaagtgacgaggttaccgtgtccagagtatctgcagtgtagttcatcatattcgacacagtgggtccatggtcgggaaagagctgacatctgtatgaggtcaacaacgaactctgcaccatcattatgtccgtctaggagtaatgagctctgcctctaccatcagagatactgtagcagagtctcttgcgcaaagggttcaagaagaagacttcttgatcgatctgtcgcatatgaggctcgagttgtgcaagaatggactcaggagaagaaggggtcgatcctcaaaaactgctgttcgagccatcctgaagcattcgtggctctgacgtaagcgagaggcgcgcagaacagcggaaaagcatgggaagaacgatgtcaaactctgcgcgtc

SEQ ID NO: 545989 - DNA, 1068 bp, Homo sapiens
cacagcgtcgcccacgcgtcgattctgatgtctcccagatgaatgatagactgggagaagatgaatccgttgctaatgaaatatatataggcttcctccgtaaacgattccccgtttgaatccactacttgccagtttcttcagcaaggtgctaagtatccttatcagcagaaaaccagaacagattgtggctttcttaaagaagaagcagtgattaggtagaccttatgtataaagcacataggaacttctgctatcatggatatcgtggctcaggctcctgagcgtgtactcgaaccgtccatcgagcccaaggctaatgattgtgcgtgaaagttgggttcaaaatgaggcgagaaaattgatccagaggcttgtggagagatacgattcgatccaatcgcaatgaagaagaatctgacattcagaatgctatctagcaaatcactgttgtttgaagatttgttcgacctgaagcaagagaccaagaatagtgacgaaaagttcatgacacatggtaacaagagaccctgacctccactggcgtatggcacagactctacagaacacacgcaacgacaacttcatacagaagccacgctatactaatcaagatatatgttcgcagcaaagggacgtaaaagagtgacgtcagcacataagtcagggtgcaaatcccaggaatattggcgtgaactgtatactttgaggaccacgaacgaacaaacaattttgaaaggggccgtattcggaggaatcgtggcccacccaggcggatgaggccaatacagcgtatggtaccaagataaacaagaagtgtgcatacgacaggccactccagccggcgaaccaacttgggagatcattatcccatagcaaccgtccatggcacaggaaggcgaagcccaaagaaaataacgtgctgactagaaaagaccccaccatgcggggagtagaggcacggggaaatccatcccaggctgggagaacataacacagggatcgcagagtgtccaacaacagagtagagacaaatccaaggcctaggcagcagagagaccaaaacac

SEQ ID NO: 545990 - DNA, 214 bp, Homo sapiens
cggttatagaggacatggaggcagcggcgcgtataggacaccctcaccgtatgctgacctggacatggtcacctcaaccggacccccaagcagccggccccaagcttgagccgtccttctcagagtacgccagcgtccaggtcccgcaggcagtgaactgggaccggtggttggcatctagcgggctaccggagcctcgaatttcgctacactc

SEQ ID NO: 545991 - DNA, 439 bp, Homo sapiens
tgaaggcagtgagcaagatcgcgccactacactcagtcgggcgacagagcaagagtcattcccccaccaccaaaaaaaaaaaaaaaaaaaaagaaagatgttgtgatacttttcacttttttcctaacacccccaaccaaacacttttttgcttttgcttaaagcaaacgagaaaaaattctaaataggctctgaattctcagttttctcttctctacaatgggggcagtgttggcttgcacctcccaggggctggtctgagattctgttgcctcccttggcactggtgagcttggcacagggacaggtgtcccaccccaggccttttgacctgggttgtcctttgggcctggaactttcctcccgcgattcctcctgagagggccccctcatttcctttcagggcacggcttcaaacagggggggttcctctagagtc

SEQ ID NO: 545992 - DNA, 4839 bp, Homo sapiens
gcgagaaccccgactgaccgcggccacggcggctccccgacctgccgcgtcctgcgggcggcgctgggctccgggcactcgggctgcgcccccatggcctcgcccgcggggaacctgagcgcgtggccgggctgggggtggccgccgccggccgcgctgaggaacctgacctcctccccggccccgaccgcgtccccgtccccggccccgtcgtggacgccctcgccgcgccccggccccgcgcacccgttcctgcagccgccctgggccgtggcgctctggtcgctggcctacggcgccgtggtggccgtggcggtgctcggcaacctcgtggtgatctggatcgtgctggcccacaagcgcatgcggacggtcaccaactccttcctcgtgaacctggccttcgccgacgccgccatggccgcgctcaacgcgctggtcaacttcatctacgcgctgcacggagagtggtacttcggcgccaactactgccgcttccagaacttcttccccatcaccgccgtgttcgccagcatctactccatgacggccatcgcggtggacagatacatggccattattgaccccctgaagcccaggctgtctgccacggccacccggatcgtcattggaagcatctggattctggcatttctacttgcatttcctcagtgtctgtattccaaaatcaaagtcatgccaggccgtactctttgctacgtgcagtggccagaaggttcaaggcaacatttcacgtaccacatgatcgtcatcgtcctggtgtactgctttcctttgctcatcatgggcatcacctacaccatagttggaatcacgctctggggaggggagatcccaggagacacctgcgacaagtaccaggagcagctgaaggccaagcggaaggttgtaaaaatgatgatcatcgttgtggtgacctttgccatctgctggctgccctatcacatctacttcatcctcaccgccatctatcagcagctgaacaggtggaaatacatccagcaggtctacctggccagcttctggctggccatgagctcgaccatgtacaaccccatcatctactgctgtctgaataagagatttcgtgctggcttcaagagggccttccgctggtgccctttcatccacgtctccagctacgacgagctggagctcaaagccaccaggctccacccaatgcgacagagcagcctatacacagtgacaagaatggagtccatgagcgtggtattcgactccaacgatggggacagtgccaggtccagtcaccagaagagagggacgaccagagacgtaggctccaatgtctgctcccgcaggaactccaagtccacctccaccacagccagcttcgtgagctcctcccacatgtcggtggaagaaggctcttgatttctctctggggtcaaggccactgcaggcaccccttctcctgtcactgctgctgtctctcactctctggaagctgaaggacagtttttagacagctacgcttacaataagacagattgcacataaatataacaaaaatactactaagatatgagctctccccccaaaaaaagaacaaaatgggctttaagagtatgccttgaaaactctaaattattaatatgatacaaacaaaaatatagatccgagaaatatttataaagtgtccagttttgcttatttaaaagtcactgtgcacatttgtgacactgatatggtagttttttcccaaaatattaaagtttaaaatttaatactgtcagtgaagagaagccatgttttccattacagagcatagaatggaaaagttaaatgactcattttcttacaatagtgatggaaatttaacctcaaaaactaacaattaacgaaatctcaagaaaacctattttgtaccataacaattttcaaagacatttaaatgaaaaggaaacctaaatcaaaccactaggcttatctaaatgcctttctcttatttttttctgagaaaatgatttcaaaggaaaaaaatgtagctttgattgttacatattttaaatgccaagttaatatgtagttaaacttaagaccttaaaaggacaaacaaaattcctatgatcctctatttttcagaattttgttctaagtaggtaagttgtaagacattaaatatactttctgagatggaaggaaagaatcccatttgtctctgtaactggctgctagcctttaggcaggaaccacccacagcctcacgtagccatgaaggtggacaggaacacctcccagctccaaggcagttgtttttcccctgtaccccagcaaaagttccagacatgcactttatcaaccatatcgtgtcctcctcctccttcatcaaagaaggagtgtgggcatgggggaaggatcagaatgcgtcttgtgaaaatcctgagaggaaaaagttgtaagaattatgaaagcaaatatagctgatgaagttaatatacatgttggaaaatcagacaggaagtagaaagttgagtcaactctttgaaagatgtaccatagtttgggtcacccgtcaggtgagtgacaatattaccctgctgttccacacagagacctgtacgctctgcataggtaacccttgtccctccagaaaggacgggaaagaggcatttgttttactacaatagtatattttttgagaaccatatttgtgagtgttttatgcctcaatcttgaagcatgaacctttccttaaattaggaatactgtcaatcctgctgaagaaatcacaacccttctggaaatctaaatgtgttatataaacttctgtaaaatattgttaggttttgaaaactgtctaaaataattatctctaacatttatttcattgctatgccttccttagtgtcagaaccaaataacttttcaaagatcagcataaaagcaattatccaatgacaagtgatggtctattgttaccctgatattaatctcccaatcctgctttggagccaaagtcagaaatatttagttgttagtctaaacagcttaacaacatgagtttgagttgaatttcttttaatgacaccaataaacacaaacaagtagatggcacaataaatttgcagacatatacaaccagccaatgaatgtaacaatatcaagaagtaaattaaaattaattctaaaacagtataagtggtctttccagggttcctagaaataacctaataaaatctgtgaaacatgtgtgcacttttttagataaacaaatgtatcataatttagaatctaattgtttgaatgttttaacatgtacgggagcttggtcttcaaatttcatatagtcagccactaacaaagtatatctgaaatacatactcttgaccttcacatgcattacgcaaattcatgctatggcgtttctaaagaaaaaatagtagcttaatcttgttttgttctgtttgtttggaattttttctttagtagatttgttgttgccttgcttaccgagcatcactccttctagtatggcagaaatactgaggtccaggtcacatctcttaaatagttaagaaaaactgacatcatttactcaatagtcatgacttttaaactaagatttattatatataattttcaagttcaagaaatgtaagcaataacagtaaaatgaatgaaaaaggctaaaggttagcccttgtgtctgaatttcgaagctaaaaagtatgaaatgatgcccatgcagagccgctttagtgggctctctgtgagtaaatctatgccagtgttttcacatttgccaaggcttagaagcatttgcctccaaatgcgctctaccccaatactaacgtccacgtccatcttcttcattatttgcagtcaaacactactcaggacactgagcagataggtacaacatcttagggtttattaaatttagatcagcagacaaaaatcctaaactatgttgagaaaaatatgggaaaaaaaagccttgccttgttttaaatattctcctttttgaaagaacatgctagtaaaacaaacaaacattgaatttctattattttgcacctggacaaagtgactgaagtggcctgccggggaaaagtttaaagcaaacgcggctttgtggagtccagtctagcttttttttagtggttcagtatgttgttgcatgattccacctcccaggtgacatttctgacccagaagccacatttacgttttcaggacgtaaatctgaaaatctcttgcaaaaagaaatctggccaacttcaaagttccgccgcccttagaaggcacacaaagcaccaagaagcttagtactaaacctaacaaacacaaaataaatgtaaaaaccaacactagttacctcagaatttggattggattttgttaatgcagaatttccccagaaacctgtaatcagtgtctgttaaattgctccattacatacaaagacaggaggattaaaacaattcaactaacagtaacaatctgagttccattttcctttgatggtgtgccagaagttaaggaaatcaagcataacattggccatgaagaaaaaaattgtaacaatctcactggaggccaaacaggaatggagaatcacatttaatggagctgtacaaagtcatttattgtgtgatttaatatacattactgaaatcctgcgagcaagaatttcatatatataaaatttgtaggcagtgcataaagtatttttcaagttgtggaaattatactgagtatgctaaaaattccatcttctgtatatgtgccagtattttggaaagtttaaatccaatgtttttatttaaatatattaaaaatcatatgaaaaat

SEQ ID NO: 545993 - DNA, 461 bp, Homo sapiens
  misc_feature (203)..(203): n is a, c, g, or t
ttaatgcgagaagtggtatacactctgtcatgagtcgacggtttaacaaaccaacgacaacagttgattatattcaacggccaaacttaatcagaaagttacaagacgccaatgtctggagtatggacatcacttatttaaagttaagcaatggtcagtgggtgtatagtgggtgtatttagcgtcagttttaaatctacgancacataagatattagcccatcaaatcagtgccacgatggataccaaattagtagttacaaaactacaaagagcgctatcaactcataaaaaggtgttgcagatcatccgaacaccgcatgttgctgaagactttgcgtggtgattgccagttgagtgttttcttggtctggcattaacccaatgattgatttgttctaattctttctgctgtggtttcattttgcgttcttttggataaacgccgcattcgatcagca

SEQ ID NO: 545994 - DNA, 373 bp, Homo sapiens
  misc_feature (340)..(340): n is a, c, g, or t
acctaaaggattttccgtggcacggagggcaacaagggccaaacggcgggctgactttgtcgccccggggaatttgcggggggggcgggggcaaggttttcccccgggtattttgggggccccttttttttttactaaaggtttttgggggggtttgtttttccaaaattcttttttttctaaattctggttcggcgggggcgttgcccaaaccctttgtaaattttttccctttctggtacttttctaggcgagggatttttgaaattatttgttttggcgggattttctggaattttctttttgggggaaagggagcgataattttttttttgggganaatttttgttatgttatcccccccattatgggg

SEQ ID NO: 545995 - DNA, 598 bp, Homo sapiens
  misc_feature (167)..(167): n is a, c, g, or t
cagtttctgagttacaccatccccaagcacacggaagtatttctcatcctgagcactgctctccgtgacccacactactttgaaaaaccagacgccttcaatcctgaccactttctggatgccaatgggccactgaaaaagaatgaagcttttatcccccttctccnttagggaagcggatttgtcttgctgaagcattgcccgtgcggaattgttcctcttcttcaccaccatcctccagaacttctcccgtggccagccccgtggctcctgaagacatcgatctgacaccccaggagtgtggtctgggcaaaatacccccaacataccagatctgcttcctcccccgttgaagggcctgagggcagggggtcaaaggattccaggctcattcagtgtccccacctctgtagataatggcttctgaccccccgaaacttcctgcctctgagagacctgctgcaagccagcttccttccctctccatggcaccagttgtctgaggtcgcagtgcaaatgagtggaggagtgagattattgaaaattataatatacaaaattatatatatatattttgagactgtgtctcaaaaaaaaa

SEQ ID NO: 545996 - DNA, 778 bp, Homo sapiens
  misc_feature (4)..(4): n is a, c, g, or t
  misc_feature (180)..(180): n is a, c, g, or t
  misc_feature (247)..(247): n is a, c, g, or t
  misc_feature (324)..(324): n is a, c, g, or t
  misc_feature (338)..(338): n is a, c, g, or t
  misc_feature (365)..(365): n is a, c, g, or t
  misc_feature (457)..(457): n is a, c, g, or t
  misc_feature (528)..(528): n is a, c, g, or t
  misc_feature (534)..(534): n is a, c, g, or t
  misc_feature (632)..(632): n is a, c, g, or t
  misc_feature (671)..(671): n is a, c, g, or t
  misc_feature (683)..(683): n is a, c, g, or t
  misc_feature (764)..(764): n is a, c, g, or t
ccgntccccaggaccagctgtgtgtcgtaagccaggaacagggtgaaacaaatggccccccagagcagcatagagcatgtggagccagtaaacgtattggtagtagagcacaatgctagtgacaatcccagtcaccaggagcacagttcccaggacacagaagaggcctgtgcacgaggngaagtccaccttggtctgaaagcagaagatggtgactgaaatggataccaccgcagtgatgatcatngcaatgatgacggctttggtttggtacatacgggaaatggtgcccgtcacgaagcccatggcaaaagaaaaaagggncagcagaaagaggncccaggggaaacggcgtcggggtcccnggcagcaggcaaggaccaggtaggtgacaacgaagacagcaaaggacacgaagaagacagccacaaccccccccacaaaggcgctgacaggncccacaaaggcgaagatagcaaggatggccacagagaagagcagccgcacggagaagaaggagaaaacccnccgganaaaagtgcgccgcaccccccggccatcccaccccccaggcccgaagccaccacccaccgccctcccccccccaccaaagccagggcccgggccgcagnccaggggcagcggggggggggggggcaggggcggggggnagccagcagggngaccgaagccaggcggcgggcagccagggaaggcaggaaacccccctggcaggacagacggccgcccatagcccccagggngcagagggccgggg

SEQ ID NO: 545997 - DNA, 308 bp, Homo sapiens
cttcgcccgcatgcacggtgatgcgcaggccggcgtcgcgcgcgcggttgaagtggttgaggaacaggctgccggggaagcccagctcatcgcccgccaaatccagcgcggtaatgccgtcgcggtgcgccagcaacccttccaattcctgcagacaggcggcctcgccaaaggtgcggctcatgatgccgatcaggcgaatgtcgatgtcgcgatcgcggcagcccgaacggatcccgtcgatcaccgcttccaccacgccggcgaccggcagctggtgcttcatcgccatgtagtaaggggagaaa

SEQ ID NO: 545998 - DNA, 567 bp, Homo sapiens
tgggcaggactccacgatgctgctggctgtggaatcgggcagcagctgcctaacaggccttcctcctggatgcacaagcagctaccagtgccaaaggtgatgctggcagccctgagactattatgatgcccagccttccagtccggttatcacaggctgccaggtcaggcttccctctcactgtacctggctgccagtttacctcttggcctctactgaactgcctgtctactgggccctgaaagcagcatgaaattcactgcctcacactccaggtcaccaaacaagtacccggtgagaaaagtactcctgtgtagagcaagcagggaaaggggaaaatgtagacaccaggatggagaccaggttctggagaggcagcaagcacatcctctcacctgcccacccaccttgttggtcactttgcccatttaaagatctgcccaagaagctgcagaaaagaaacgatgctgccatttcattgcatggcatttggacactcctctctgagctgctacagaggcaggcctttgcctaaagaagtcgaggtgacttaaaaagtgctttttt

SEQ ID NO: 545999 - DNA, 218 bp, Homo sapiens
  misc_feature (206)..(206): n is a, c, g, or t
atcctttagaggcacaggaggggcttgggcttacaagttataggctgatcatgcaggatgtggtcggataaataaaggggatgggctaaagggacgtaggagtcgggggcaggtttgggggataggagtcctcacctgttgtcataggcttaggccccaaaactctagagcagtggagcttgctactctagagggggtacccgagnctcgcaattcgg

SEQ ID NO: 546000 - DNA, 248 bp, Homo sapiens
tcatcgagtcggcccgcttaccgacggggtgggcagattgcttgagttcaggagttcgagaccagctggtgaaacctcgtctctaccaaaaatacaaaaaaaattagctgggcgtggtggcacacgcctgtgattgcagctactcaggaggctgaggtgggagaatcacttgagcctgggtgatggagattgcagtaagccgagattgtgccactttattccatcctaggtgactgacaccccgtcgg

SEQ ID NO: 546001 - DNA, 137 bp, Homo sapiens
tatatcatatatattggatatgtgatatatgtatatatagcatatgtatatatgggataccctatatatatgggtataccctatatatcctaatacattgatcctatatattgattatcttataaatcctatcatgc

SEQ ID NO: 546002 - DNA, 494 bp, Homo sapiens
gaagcttaatacacttaaggtgaagagtcatacaaatgacagcacagctaacttatgcaattactgtaggagacaacttagacattgatggacctacggatacccaaggagactaagctgaagcaggagaaggaggggacaattaaccggccttccaacttttgtctgtctcattctaaaatttacacagtaaaccatttgtcatccatgctggcccacaaatagtaatcagtttacgatttatgacaggtttatgttacttctatttgaatttctatatttcccatgtggtttgtatgtttattattagtgggagtagagccagttaacatttagggagttatctgtccccatcttgaggtggccaatatggggatgtgtaatttttatacaacttataagtgtttggcatattacttttggtacattgtggcttctaaagggcccggtgtaaaactgctttcatgtctaaagcaagaaaactgctacatact

SEQ ID NO: 546003 - DNA, 175 bp, Homo sapiens
attagtgcatttgtggatgcttgggattacaggcgatgaaggacgtagtagcctgcgaaaagctgcggggagctggcaacgagctttgatccgcagatatcgaatggggaaacccggcccgaatgggtcaagcgaataagtgcatgtggtggatgccttggcgattagggttagt

SEQ ID NO: 546004 - DNA, 296 bp, Homo sapiens
tttccctaaagaaaaaatttgtttttttcccccctttaaaattcccaacccattttaacccatataaactggcccttttgtgcccccgccctttcccaatttaatacctttttaacccaataattttttaatattttttcccgggccagatccttttaattttaaagttcccggatcctttttccttggctgggggccccttttagtttgttcccttttaaaacccccaacgagtgtttttttgtgctttccttttggtggggttttatcccctaaatgaatgtttttgggggcca

SEQ ID NO: 546005 - DNA, 100 bp, Homo sapiens
cgtgatgtctacaagaaggttctccgttcccggacatgggtccctcgtctccctgcctcggaggcacaggacaggaatcgtcggaaggttaaggcgtgcc

SEQ ID NO: 546006 - DNA, 305 bp, Homo sapiens
tttttttgagacggatctgggtttgttccccaggctggagtgcagtggtgcaatctcggctcactgcaagctctgcctcctgtgttcacgccattctcctgcctcagtctcccgagtagctgggactacaggcgcccgccaccatgcctggctaattttttgtatttttagtagagatggggtttcaccatgttagccaggatggtcttgatctcctgaccttgtgatccacccgcctcagcctcccaaagtgtttgtgacttctaaacattcatttaattgaagaattgtgtgtagagtcgacg

SEQ ID NO: 546007 - DNA, 110 bp, Homo sapiens
tacagtaaataaagccgtgcgtttccccttcccatgcccatctgcgtgtcaatatacgtctgtcattcatctgtgaaaaaatacagtgtctccccttctgtcgtcttctc

SEQ ID NO: 546008 - DNA, 832 bp, Homo sapiens
  misc_feature (1)..(1): n is a, c, g, or t
ncgggcccccccccgtcgttcttcctgcggaaatggttaaccaccggtgtaaagttctccaccaccgatcaggttgcgacacacctctgctgtaaggtaccccgccccggttttagtctggtgtcccccccgaatcgtatgcacccacgccggcgttgagggtctttcgtacctgagacaatatatatctttcagagtctgattcttatttggggaccacaaatcgcaacccaacggtcatatatcatggggagagacgagactgtgtgacacacctgtcagatacatatacacatagaaagaggtaattccccacgccatacgctttgttttaagaggcatagacacccacgtcagggacacacctctcagcctaccttcgctgcgataaattagcgcgcaataagaaatattccccccgtctccacttacgtttgtgactctcccctgttaacccacacagaaccagatatacccaccccgtgtagtggataccaaacactgtttactctttctttcctctcagcgagacatataatatacacacgcgaccactcatttttcaaactgtctaacactcttcataagaatatatccactatatttatatcttcttagatctgcccccgtaaactttacatgcgtgcctccatttatatcatccgagagtcaaatctataaagatcgatccatagacctttagcactctcccacgtgagaaaacaatacaccgggcaccacaaaagtgaatataatatagaagacaacacatttcttttcattaggcggtcaataaaatataagcccaaccatttccaccaatcataaacaa

SEQ ID NO: 546009 - DNA, 275 bp, Homo sapiens
  misc_feature (25)..(25): n is a, c, g, or t
ggggagaaccggtctccagaactgntttgtttccaattggcccaattaagattttagttagtaaagagacattggtttgatagataaaccaatagccatccgttaaaccttcagaaggaaaggaggatgttttgtggaccccttttggttttcttttttgcgtgtggccacttttaagttattagtttttataaatcagtactttttaatgggaaccacttgacccaaaatttgtcacaggattttgagaccccatttaaaaagtttaatgagga

SEQ ID NO: 546010 - DNA, 111 bp, Homo sapiens
aaagccatgtcatcatcagatcttcttggcttccactttcttctcctcagctggagcagcacgactctgcacaccagctgctggagcaggtccaccggcccctacattgca

SEQ ID NO: 546011 - DNA, 369 bp, Homo sapiens
tacacaaatctttattttctatatttaatatctgagtatgtttcactataagataatagcctccagttccacccacgttgctgcaaagccgtaatttcattctctttatatagctgagtaatatcccctggtatacatatacgacgttttctttatcccatcatctgctgatggatacttaggttgattccatatatttgctcttgtgaattgtgctgcaatagatatacaagtgcaggtatattttggatagaatgatttattttcctttaagtagatacccagtagtgggattgctgggtagaatggtagttctatttttagttccatgagaaatttccgtggctgtttttctaagaggttgtacta

SEQ ID NO: 546012 - DNA, 395 bp, Homo sapiens
tgatacccacggatgtgccgctccgagcatgtcggtccggtaaccgacatagagatttaaaatcggccgtggagcttcgcggtccacaccatatggacaagtcagcctgcgctctgcggcaagcggtcgcgagtgtccgcggcagatggtagtgcgcacagcatcttcaagacccaagccgttatgtcagatagcggacagacgctcgcgagatatcacgcataatttgtagcacaagatcttttggttgctggaccggaagcgtggcttgttcgttaccccatacgcagatcgcatcttgaaggcggacgttaccgcgagacggagtaatttgatccgacgtattttctgctggggacgaagacgcggacattttattcaccgaggtaatcaat

SEQ ID NO: 546013 - DNA, 160 bp, Homo sapiens
tttgattatcccggcttaaaattggttttaccccagttgcacaaaacaaaaatatttaaaatacctttggtattaaaaatgcttaaattttaaggaaatatccttaaacagtttccagaattttaatccatcaactttcctgtttaatagtaaaatattt

SEQ ID NO: 546014 - DNA, 347 bp, Homo sapiens
  misc_feature (44)..(44): n is a, c, g, or t
aaaaaaaaaaaaaagggtcaccacaagggcaaatgtgtgatttnatggggttgggactttcagccccatcccccaacctctggggaggagagagggactgaaggtcaagttgatcaccaatggccaatggtttaatcaatcatgcctacataatgaagcctccataaaaacccaagaggacaggcttcagagagcttcctgatagccagacatgctggggttcctagaaggtggtaggcccagggaggacgcagaagctctgcaccccttcccatacctcaccctatgcatctcttcatctgcagcctttgtaatagcctttataataaactggtgtgtttccctga

SEQ ID NO: 546015 - DNA, 534 bp, Homo sapiens
  misc_feature (113)..(113): n is a, c, g, or t
  misc_feature (295)..(295): n is a, c, g, or t
  misc_feature (485)..(485): n is a, c, g, or t
  misc_feature (496)..(496): n is a, c, g, or t
  misc_feature (513)..(514): n is a, c, g, or t
  misc_feature (526)..(526): n is a, c, g, or t
gagtattggttgttagaatttcagggaattccaccaagtggggaatgactctgtattaagggctgcaaagaaaagctcccaggccaagcattgagtgggaggtgctacctgcnctcagggatccacagggacttcaacagctgatgtgggtctcatcagcctcaaggtggccaagtttctatgctgagactatagcccacagttacaccagccatgatcctcagcagcagaggtagtgatgatgaagtctgatgcccaaagacaagcagaacaatatgcacagttccagccaatnccacgaggtagcctttgtacttccctatacctagctgggagggaggaaggaaggagagaggagactcctaggaagaggagaaaataattatcccaaagagactgacataacctggaaaagaccaagaactactaattagcaagataaagttcatttacctcttcctgtttcttaccaagatggtatgtancctttcagatnataaataaatttatgtnntcttgccctaanaaaaaaaa

SEQ ID NO: 546016 - DNA, 566 bp, Homo sapiens
gttacccaggtaaacagctatacacagtggtgcaaacactggagactcgtggtacataccatatgatgaagacttgtgtacaaagatgttcctgtgtaatgtaccaagcaaatatggatattgcctccaccaaaagacatagagattcttacctctatgctaagtttgtgtttgggtaccctctaggttggcatcagaggctcttgagctggtgtttgtttagggcattgcctctgtcctgaagataaaaggactctattaacagcattgacattgattttttaatgaaatgagatatatcttttcataaccagctgcgtttttttcccctaacatttgtttttggaggcttatcaagagttagagaacttagtgtagagcaaaacctgcatttctcctactgggccagctattccacttagcttgggtgacaaatagtgcttttggtatccattttttgctacttctgaccttgccttccaggcctaccaatagcagaatcaatccatctgtccctgagatactcatgttgtttcaaatgcctcctcccatttctggcatagtct

SEQ ID NO: 546017 - DNA, 378 bp, Homo sapiens
  misc_feature (10)..(10): n is a, c, g, or t
  misc_feature (41)..(41): n is a, c, g, or t
  misc_feature (55)..(55): n is a, c, g, or t
  misc_feature (68)..(68): n is a, c, g, or t
  misc_feature (117)..(117): n is a, c, g, or t
  misc_feature (269)..(269): n is a, c, g, or t
  misc_feature (284)..(284): n is a, c, g, or t
  misc_feature (298)..(298): n is a, c, g, or t
gcatccaaanatgtgaaaacatgaagatcaataaaaagaantgaaaagtctgctncattgataaacancatttatcttaataatgggtacttctctgaatttccaaagtgcccttcnaaatgccagtatcaaagccagtgcccacatgtgtgtagaaagttcaggagggttcaggggagttgaggcaggaacacaggctgctcagcccagggggtccaccgaggagaagacatcattctgggaccagtcacccactggaactggtttcnaaccaaggagatttnaagtcggggatttnccaagacatatttctggaatttcaaaacttaccagtgaaaataatatacaattgaccccttggaacaacaatgatttgaa

SEQ ID NO: 546018 - DNA, 482 bp, Homo sapiens
gggcttgagcagtctcaggggtgatggaccccagtcgatgtccacaatgttcccctggcactgaggggagatgggcatgagtgagttggtacaggaatcaggacctctcagcacttggcaggaggtgaactggataatttctcactaacaggtgcagggcaggggccaagcctgggtcatcctgatcatctgaaagagtctggggtcacactgagggactgtgagttgggactcattcatctcatgcatccctgaaatctgggcacccagcccatggcacccagctacgctgcttgtatttctttccagaaacgtactatgcagtcttacctccgggccacatggacttagctctctctcttcccaaaacacctttctcgcatgtcttcctatagcatggctcctttctgtcatacaagtccaatattcccccgagtcctcttcaacgtgtcctgccttccctcacctgcgaacctatgagg

SEQ ID NO: 546019 - DNA, 1543 bp, Homo sapiens
gctcatacactattattgcgcatttcgcaccttggtgaatgtcggtggctacattccacatttatactcccacttgctcagtgagggagatgaggtcagtgcaagggaggatggcacagaatacaaacacaaagattatgatgaaaacacttctataacgctgactcgggagaaggcctcgctgcaagatagtcatgattgctacaacatcagtgagtgatgaagaatgctatctcgtggagtatagccccattcttcatgtatgtcagtggcagcaatgtgacatgcgcgcatgtcactcggagtgcactttgaggctgagactcacagatgttctgtgcacgtgactcgttgcacccccagtcgaagatgatactaggctttgtgtctctttggatcataatcgcgttgggcgtctccaccgtgtcgactgtgcaatgtgcagtgggcggtgccttccacacgaacgtggtgctccctcgtgttgaaacgagccgcacggcatgagaggacctcctttgtcccaggaagatatcaccacgctcacacgactttcatggaaggacacatggtaagtaaggatagacgtagagtctagggttggttgaacattcgaaatacgaaacacacaacaaatggaaccacaacaagaaagaataccacttcgggaggaacaggacgttggttctcatcgaacactcgaccgaacttgaacttctaatcacaaagtgctggcaggaacacaggtgacggtctccttacaccaaaggataaacacaatgagcgaggaaatatacccctttaaccacaagagccattttggtttgaaaaacttaccttcaagagcacgtaccaaagaggggttatccttgtagtcgaacaccttccatattggactatttggacccaaaaggatttaataggacaaaagcgcctttcttgggaacaccccagttagaaggcaagggctgcccccattaggtgattattataccacacgtcggctgagcagtatcctacggaggacaatgccgcatattatcaccggagctgaaaagtgttatagaggatcacagtatcgcgccatatggaatatatccacttaaacgatactagcccacaccgagcgacagttttacccccagagtgaggcacatccaggccaccagagtagcgttaatcagaaacagattcacatagacagtaaacatgagggagagaaagaagaaccccagaacggaaacacgagcacctaggaaagttagcggaccaaaacacgggtgagcggacaacaggttggtacggcaccacaacataacaattcgagccgacccagacactgggtaactaaccgcaaatgggctaggcaaggcactaagcatcaaacacccacgagataaacacacagtcacatagacgagcacacagttcgcgatcggagcagcagacacgaacaccccaagagcatacaacgacagagcacacgagggaaactcaaacactcaggagtagcacccaagagacagagagactcatcagaagc

SEQ ID NO: 546020 - DNA, 952 bp, Homo sapiens
gtcaatagtcagatcccctgaatgcaggtatcgggtgttaaattgcctgcgcctgatttctgcttttcccggatgctgttgtaggaacctacgaagtagctataccttatggctttcaattccttgacccgagtggagcatcaggagatatgagtcgttccctcatttgatgtcatgggcttcccatctcgctgtctcatgggtgttttctgcctgaatatccacgcatgtaaggggcctaagtattggtacatggacttggggtcgtataaattcacgttctggatgttccccggagcgcactcttcatgccagaaatacaaaatgttgcgggtgtccgcttgtgaagggtcggtcacaggggacctccaagagcaagctgctgcttgtaactggtgtacccattttgaggccagcatggatcgtgtgatgatttgtggcagggggtctccatttgggtatttcttacccacgttggaccatcaaaaggcgggagtataaatcagaaaatgactgacctctcttcgtataaagaagacgcctgtactgtgggagtgtcaggtctcagcagatgaattgtttgccacgacattgtggcaggaaagtgccacccgaagattgaagctcgctataacaatccacgtggttgagagggcaattcatcccatggccgggaaccgagcggcgacaggatgagtgtcttcatcgaaatacataccccagatttggttttgtcatccagacattactgcaagtgccgagaacgtcattagttaaaagccatttttttgccgccgtctgctcattgaaaaagaagttggctcacatgtgaggaattcgccaatgaggtctaagggcctattgaacagtaagctcatagggtcacattgttaggacgcggtacacaggaaaggcgcgcctttcccgggaaacttttggagaaaagcgtgca

SEQ ID NO: 546021 - DNA, 149 bp, Homo sapiens
ttattcatacctctttttaaatggagtccacagactaaaggtcatgttccgagcactgaagctttcaaatgaccctcagttccaatatagcacgactttcttcagtttcatcagtagcttttcacaactctgaggcctgtggttaagca

SEQ ID NO: 546022 - DNA, 518 bp, Homo sapiens
tatgggtcggatgtactagaggtcccgagagagtaagagattagaactagcgtgtggtccgaagaccttaagcgcaaagctatctgtgaaagtccgtatagggattttgtaattctgtgtgtgcagaacacagttaaattattattattattattatttttgagacggagtttggctcttattgcccaggctgaagtgcaatggtgtgatctcggctcactgcaacctgcacctcccgggttcgggtgattctcctgcctcagcctcccaagtagctgggattataggcatgtgccgccatgcccggctgatttttgtatttttggtagagacggggtttcaccatgtttgccaggctggtctcaaactcctgacctcaggtgatgtggctgcctgggcctcccaaagtgttgggattacaggcgtgagccactgcgcctggtctcagggagcaatttctgattggcagctttggtttgctaaattatagaccaggtagagccgagggggatcctcta

SEQ ID NO: 546023 - DNA, 951 bp, Homo sapiens
  misc_feature (446)..(446): n is a, c, g, or t
ggaaacataggcagcactgaaaaaaaaaaaaaagctcattttaatttagactgacaattatggcctttgaggaagggctctccctttgttgggaacccaatttgccatggggccttggggtgctctgcgataacggggtgtgggtgggtttaggtttggcaaaatggcgccaaaaaaaaaaaacgggttccccggagaagttgcctttgaaattagggttgggcgcgcggagaggccacgccgtaaggaatttcaaaacccttaagttcacaaaacccttacttgggggggccattaacacgtgtgtttgtgaaattgccacatttccgaatttccagaattggaaccttgtgttcaagcggggcagttaaccgcgaaggggcctggaagttcccagccaatgtcccaacagcgtgtgtaacttttcccaactttgtgcacacaanttggggggcaactgtgacgagtgtgggtgattaatgtgcgacatctatttatttttttcaacgaaaacccgaggttttttcgaacaaaaaaaccttctctatggaaaagaatatactcatgtgttgagagcacccctgggggagaccgttggggggaggggggagtctcccacaaaaaactgtgtggtatctgtcgcaacaaaaaagtgtgtgtgacagtggcgttaaaccaagggtctctacgtggtgtcaaaaacgccttaaaggctcccttttatagaaaacccccctctttcagaagaggtttttccagggttcgtggacaccgccaagtttctcaccagtggcaacattgaagacttctgaatctatttaaggagacggtgcgaaacggttatgtgagagaaggttcagagagaacggccctttgcgagaaggcttaagattgtaaaataagttcctaccgttgggcaccctttgtgtcgaaaagaagtttacccaaggg

SEQ ID NO: 546024 - DNA, 228 bp, Homo sapiens
gatcattagcggcacatcaatgttcaatccagttcactgtatgaacatctccagtatattaatcactatggctattctattactctgttactatagctaacttaccctagattgatataaaacaagttaacactaagccttatgtactcaggactaaacccaattaagttttatatactactgctgatacacgtatgttaaattattatagatgggatttgattagaa

SEQ ID NO: 546025 - DNA, 482 bp, Homo sapiens
tgggggcatcaggacagttgccagggtgtggctgcttgggcacctacctgtgggactcccagacccacccaggggatggaagctagagaggaacctgacgtctcagctgaggacccagctcctgctctctgaacccacagccctgactttccctctgatctgctgtgagatgtgatgttggtggttctctgggcctctgtttgcctgcctgtatagtgggaggattgctaccgttggggatgatgagggtgtaattagactcctgagatttcagggttgaaaacagacctgatgggtaagggaggagaatagagtaggggtttgggcccctgagtcaggctgccttataacccctctgtgcccagttttcccatctgtaaagtggagccagtgatagtacttaccttgcagggtcgttgtcaggttatgtgagaaaatataagcagggcattgaattcactgccaggcacataataagtgtg

SEQ ID NO: 546026 - DNA, 286 bp, Homo sapiens
gagacggtatctctcacccagtctggagtgcaacagcgtggtctccgctcactgcaacctccacctcccagattcaaatgattcttgtgcctcagcctcctgagtagctgggactacaggcatgtgacactatgcctggctaatttttttgctatttttaagtagagacggggttttgccatgttggcccgaggcaggtggatcacttgaggccagaatttgagaccagcctggccaatatggtgaaaccctgtatcactcttttaggcccttctgtcgtcttctc

SEQ ID NO: 546027 - DNA, 733 bp, Homo sapiens
  misc_feature (550)..(550): n is a, c, g, or t
cacggtggctcacgctgtaatcccaatacttgggaggccgaggcaggcagatcacctgaggtcaggaattcgacaccagcctggccaacacgggaaaccccatctctactaaaaatacaaaaaaaaaaaaaaaatagcccaaggcgtgggtgggcagagtgccggttaatccccagcttaccggggaaaggcgtgagaacgggagaaatctcattggaaccccaggaaggcagaaaggttgtgcagtggagcccaagagattcggcgccactggcattccaaggcctggggttgaccaaccagtgttgaggacctccggatcttaatctcgtgacacccatttcacatgtcgcgtccctgtgtgttcaacaccaaaatattacccaaagagggcagacagggcaaggctacaaatctggcggcgatgggcaaggctcttcctataggaagagaacccacactaacgcttgtgacgtttgtgggacaccccagagcgcaagaggtgaaccgaggataaagattggtccccacaccccaaaagaggaggganacgggggggaggcccatattggcgagaatatattataatctttcccatgatattattttgggggacgccatttctcttactaatataacagattatttttgtcgtagaaatcctccattttcaaccatctcctgggggggaaacctctccccccgttgggggaagggcccctaataacgggaa

SEQ ID NO: 546028 - DNA, 657 bp, Homo sapiens
gttgacggatccctgagctgcaccggcatcccacgtgagcgcgccgccccccagatccagcgcgctgaacccgatcgccatggccctcttcggggaccctcttcctagcgctgcatggcgaggcgcatcatgcaggtgttcccagtgctgcaagatccgcgtcacctccaatggcgcatggagctggtgaagcaaggagcgggctgcgctattctggagcaagagctggagactatcagcattccggacctgcgagggcaaagaaggccacttctactacaacagtctctgagtgtgaaggtcacaggagctgcaactgacatcttccgagcatcgatttccagcacagcagcaggacgctgaatgcttcagaaatcacgcaatgcactccattgagggccatgcgcttcccggatgaccagctgtgtctaactggttcttctatgaatgggggctacatcagaggcctcagctgacgggtgtcgtaccatccagaactggtctggagactctcccgggatcccgactggaccggatgacaagtgtccaatgtctcctgccaggcctcttgtctcaagaatgcaaggcggacttcgagggaaaccttgcacagaagggtagtatgatgtctctcacaagtttcatcgatctcaggga

SEQ ID NO: 546029 - DNA, 289 bp, Homo sapiens
ctctaaacacgttgcacctatatgactcatcgggaatacacctctgtagagaagcagactcttcacctcccttcaacttttatcccatactatatctagacctatatatcttatcctgccaattcagtgtgattgaaaaccttttcgtttagtaccgcttagcagagggcctgggcttgcatagttgctatgcatgcagcagatatgagacagaggagggaatttttttagcaccataaaagcagctatgctgcagtacatctcactcgcagataccgaacctaggaaa

SEQ ID NO: 546030 - DNA, 372 bp, Homo sapiens
gcacaagagaactttcactcgagatttttcgataacaaacagatgttctcacattatgagcactacgcatgagactctaggtgagcacatgaggctcatactatggtgtatcttatgacaagttatgggcatatgagcacaggtgtggatatggagagttgacgagaataactcgatgcagtggaatataaggaccgttacatggtgaaagctgacctcgtggcattacatttagcatatgtgatgagccatgggtagccactacatattctatggttcctagagctctgtggtttaacttagcaggcttgtaccaggcctggttttatattttcgctcagggtattttctgtgaacagtttcctgctttcg

SEQ ID NO: 546031 - DNA, 291 bp, Homo sapiens
atctgtactacgcggttcgactctagactacgcggtatcgatctgactacgcggctctccagggacttagtatgcggcacactgaagggcttgttactgattgcgaggaggagcgtgcttgccccgttcagccccatgattcttgtcccagtactatgtcacggaatacggagaatcctaccatagaggagaaataatattattccatccaccaggtgcctgcaagagaggcagctgcgaacagggtacaccaagaggggacattccatctatccggactgttctatgctg

SEQ ID NO: 546032 - DNA, 560 bp, Homo sapiens
gagagagagagagagtgagtgagtcatagagagagcgtgtttgcgcagcattctttatacatgagcctttcctgctcatttaataatattttgattatattaaacaagactgctgattttgctactttttttaaggggtctttacgtaagctaaacatacatcgtagctagaaaaaaaatgtaccttagaattgcatcttccctctcatacccaagctgtaaacaattgaaatatgttgtcttaaatcactggggtcaatacatgcttatttgatttaaaacctgtatcatcaaactctctctctaaatttaaaatgctgatgaatatgatacttttgaggagagagtgtgctcagaacttaaacgggatttggaggccaagatgcctaagcgtacaatatttttttaattttcacctgaaacaagaaaggggtcactaaaataaaagttatatgacgaataatgtcctttgctttgcaaagtgttgctatagttccaaggattatgtcctctactttgaaagggtgcatttgtggcaatgtattgttcaaggcatttct

SEQ ID NO: 546033 - DNA, 268 bp, Homo sapiens
gatctagcaggacgtaacactgggttcgagttcagacactctggtagggccatgtaaagattcatcgttgcaacaaatcttttatatatactgctctctcccttacgatctagtgacaattgagcaagtgcaggaatagcatactattgtcttgggccctgtagggagtacacttcacctccacagttgtgacaatgttaaaagtcattggtggttggcatacgttgtcccatctcttttacaacagggtgcatcttttacgttctta

SEQ ID NO: 546034 - DNA, 171 bp, Homo sapiens
gagtgagagcttttagagaggggctgcaaagaagaaggtcgtccacatattgaagatgactgggagacaggtttaaggaagtgaggtttcgggctagagcttgtccaaagaaatgagggctatccctgaagccctgagggaggacagtccatgtgagttgttgtgactgga

SEQ ID NO: 546035 - DNA, 731 bp, Homo sapiens
cgacccccccccacctaccccaagcaaccacaacaccctcaagggattcttgtcaaacgctctagcagcctgatgctaaagtttttaaaaattacttaaaggtgttctttcagagagcaaggccctgaggactggatttccctgtgcctacttcatgatcatgaattccagttaatattataaagaggcgatttttgtgtgccattacacactggtctttttcacattgttttagagcttattgcagtatatgttttgggcatttttctagtaaacatgggtgtacattttcctaataccaggtatgtacacacacacaacagaagttgcctgcatgccggtccaacattgttctgtcatccacagcatgctctctaaaagacacacagcagttatcctcagcaaccttaattcttatttaatttgcaacattttacagtcaagtcctttataaagaccatagcagcggaacacacgtgtactttttacaaacttgctgcctatcacactctttgcaaattttctttatgtgtgaagacacaaagtatgggggacgacagaaatcaaaactaactttagtacgatagccatttcattacatatacaactgtattcaccgccactatgtattctacaacagacgaatggttttaggctccagtgttatacttataacatatatactatataaaactatatttctgtagtgaacaaacaaaacaaccacatgg

SEQ ID NO: 546036 - DNA, 525 bp, Homo sapiens
tatcatcctgtatcctataaactagttcatgtcatctgattgcagcaaatcttcatgagggccaagccctggatcagatacacaacattgcaccttatcaagtattgatgtagaataaaggaagaatatctctaaaagcctgtgtaaatactcttccatttcccaatttatatatgtgtatgatcaccagatttatattccatatacttcaatctaaacaacaattgaatgcaaaagcaaatcggagaatccagctgtcttctatcagctagacagcaaagcgatttgcaagaatggcacatcagccacttttctcactttacgttttgaaagatagctctattcgcaaaatgttataaagttggtatgtaaactgcatgtattattacatttatatgacttaagatatggaaacttattaagtcagctttaatgtccaatgtggtcaatatagatacatataacatataaacttaatatgaggttctcaataattgataagagtcaaatgttctctgactgcaa

SEQ ID NO: 546037 - DNA, 442 bp, Homo sapiens
ctcttacctggatcaaaactctccacacaaaaggccctgcaataaccactatagggcaagggctctcctacaacgagctctccatcccaggtaaacccaatctactgctgcctacacaagccacaggttttctccttcaggccttacttacaaatgtccactacgccaggcgcagtggctcacacctgtaatcccaccactttgggaggccaagctgggggagctcacaaggtacacgagatcgacgcaccactcctggccaacactgctgaaacctccgctgtctactaacaaatacactaacttagctaggcgctgctggggccatgcctatagtcccagcttactcaggcagactgagcgcaggagcaatcgccttgaacccactgaagcagcagatgcagtgagccgagatcgcaccactgcagcccagccctgacaa

SEQ ID NO: 546038 - DNA, 370 bp, Homo sapiens
ggccctggctctctagcactacacatttcacgttcaatcactgacagcccttccaaaacagaggctccttaaatctgtttcccacgcatgcactataagaaactggaaacggggcaaagtgccagctagaccgaggagtgaacaggtgagcagagctcagtctctggccccctccgagtccggggtagcctctgggcgttggccgctgccttggtgcgagatggagaggcagggcaggttaggtgtgcggagggacgtgtgggtatggtttgtatggtatagcagaggtctgcgcgcctgtttccggttcacgctctatcattctcctcagtctcaatactcattctatcgcaccctctggccttgtctt

SEQ ID NO: 546039 - DNA, 500 bp, Homo sapiens
  misc_feature (8)..(8): n is a, c, g, or t
  misc_feature (21)..(21): n is a, c, g, or t
  misc_feature (24)..(24): n is a, c, g, or t
  misc_feature (35)..(35): n is a, c, g, or t
  misc_feature (206)..(206): n is a, c, g, or t
  misc_feature (210)..(210): n is a, c, g, or t
  misc_feature (214)..(214): n is a, c, g, or t
  misc_feature (217)..(217): n is a, c, g, or t
  misc_feature (219)..(219): n is a, c, g, or t
  misc_feature (224)..(224): n is a, c, g, or t
  misc_feature (231)..(231): n is a, c, g, or t
  misc_feature (254)..(254): n is a, c, g, or t
  misc_feature (257)..(258): n is a, c, g, or t
  misc_feature (260)..(260): n is a, c, g, or t
  misc_feature (267)..(267): n is a, c, g, or t
  misc_feature (270)..(270): n is a, c, g, or t
  misc_feature (279)..(280): n is a, c, g, or t
  misc_feature (287)..(291): n is a, c, g, or t
  misc_feature (294)..(294): n is a, c, g, or t
  misc_feature (351)..(351): n is a, c, g, or t
  misc_feature (397)..(397): n is a, c, g, or t
  misc_feature (425)..(425): n is a, c, g, or t
  misc_feature (431)..(431): n is a, c, g, or t
  misc_feature (495)..(495): n is a, c, g, or t
tacaggcncggattttaaagnggnaatcccaaggnaaagccaaaacccttcccaggggaacccaaaaacggaaaacccacggggttggctcatgtctctatctcaaagacatggctggccccagaggtccatgtgtgttattttttcatctccttagttttccgggcccccccccgcccccacaccagccccaaatccacacgggnggcncccngcngnggatnggcgggngggaggtcccccccccaggggcnggnngncgccacncangggcaaagnnccccccnnnnnggnagggggaggccaggaaggggaaaaaagctaccatagcaattgggttgggaataaaanggtcaggtcctggggccattttttcccccctcttaaaacaaaaagnggaaaccacgggcccccaacaggcgggnggaggnttaagttcatagtgggccatttgcttcccgggggcctgttttgtgtgtagtccaaaaagtaggnaagag

SEQ ID NO: 546040 - DNA, 284 bp, Homo sapiens
gcacgagtaaaactggggatttcatttatggtaaaagtgatattttatgtcaatggaaaaaagaaggattatttgttacacagtttgatggcaaacagctgtttgggaaaattattatactttattttaactcattccttatgaacctccccaccaccacaaaattcaaggttgacagatttaaatgtaaaaaatgtaaaccataagaagtctattaaaagtctgggtgtatcttttagtgggaaatgccttcctaatcaagacacaaaacccaaaaatcatta

SEQ ID NO: 546041 - DNA, 304 bp, Homo sapiens
cccttcattcagccaattaacagagacagaacgaaagtagattttagctaccaggtgacaaggagaggagggaatggggagttacagcttaatgtgttagagttgtcttgttgtcttgtcttgtcttttctttttctttaggtggagtttcgctcttgttgctcaggctgggattacaggcgtgagccaccgcacccggccagaacttcatccctttttatggctgaatgatgacccattgtatggatatagtacatctggtttatccattcatttgttgatggacacttgagttgtttccacc

SEQ ID NO: 546042 - DNA, 102 bp, Homo sapiens
cagctccgctttgccggcagtgagtgcgctgtcttccatggcttcttctccatgcccgagtatgcgctgccagaagctggagctgctcctgatggccaccct

SEQ ID NO: 546043 - DNA, 1327 bp, Homo sapiens
  misc_feature (239)..(239): n is a, c, g, or t
agtctgcgaatgaccatatcagatagggccactggatcatgctagactcgtgtgagtcaactatgtgggcgaagaccctgttcatcagaaggttcaagacatgaatcctatgagaagcacctgcgtgctaattggatagctagcgtagtccatctatgctatcataatctctaacttgatctggacaaatagatgtacatggtggcatagcggactcagagctcgaggactagacgccnatgattaggacccatcgcaacattgagagcgaataggcacgagacggcaaggagacttcgcagtacaagcccatttaagtcgttcaacggtgtggcgtaccccgtaggaagcggcgagggcacattgaaggccaaaacccgattagggacaggagaaagcacggtactgactccttcctatcaatgaggcgggataactaacaacaggttacatctttaggacccacgtagagccatgggtgcgactgcgctgggccacctctgcgcatttgtcacctggcacacgagagctttggaaacctacagtgcgagcaatgtgacgttaggggcgagcttaggttgagatgcatattacggatatgtctgcatataggcatttaacgcgtaggaggcaagcctaaaggggttataacgccgacggaacaagaaccgttcaataagggaagaaatgttgggttatcgcaactatggcggatatccccacaagacccctaggtactccaaccaataatcaggctaaagcattgaatcaaaaccgttgcctcggaacttcatttcggactaggggcataacaacggaataccattatatctacacattccctataggacgggaagttcctcggtcgagcacccttacaaccaataaattagcgaaacttcgatccaagaaaatctataggttaggcgcaaggagcgagcccctcacaaggtaaaaacgataacaacaagccttatcatagtaacacacatacagataagaccgcagttacagcgtttaccaacgatgatgttggcgaacccattacggtatccaatggtgcccgttacaacaataatatatttccacccgcttctacacccccaagggataaacttcacttattctacttgtcgacggcgcgcaccaaatcattggagagtagacaaagcaagactccaaataatagaacgtatcacgaatccaacacttacctccccgacagtaggaaaaaccaagcgagtcaactacactacacgtttgttcggttctacattctccacacgttacttacaagctcgcggagactattctatgatccgattag

SEQ ID NO: 546044 - DNA, 1348 bp, Homo sapiens
  misc_feature (168)..(168): n is a, c, g, or t
aatccttagccaacagcgcatgttacccgaaattagaaagtatatgcgattaggaaattgaaacctggttgcaatagatatatgtaccgcaacgggaaagatgatacaattataagccatagcagtaactattagcaaggatctaacccctataccttcttgcttaantgaagttaactaggaaataaactttggcccggagtagccaaagactatagacccccgatacaccatgatcgtaggcttacctaatgaatcagcttactgtgatgcacacccgtcttattgtagcgaaaattagtagggcagatttgataggtactgagtgcgacgaagcttaccgagcactggtgatacgctgtttgtccaatgacttgacctcttatggtcaactttaatagtttgcgccacagaagccctcttaaatccccttgttgagatttaaacttgttaggtccaaaggaggaagcaggctctttgtgcacacgtaggtaaattaatcttgatatgcagtagatgtaccaagaattttaggcagccatacgtaggccttagggagcagccaccaattaagtaaagcgtacagagcttcaaacatcgacttatgcttaattaaaattccctacatcgagtatagcatgaaactacctcaggccccaaattcggcatccaatctattctaccctgatttggaagaacttcattgttcggtcatacaagtaaccagtgcacaaactatttctccttccagtatcaagcctgccggtccggatttagaactgatggaaaccttggggcaattaatacttgggccacataattcttgcaatcaaaccataacagatagatattaacccggactggtaaaaccactaaaaaaaggcatggatccataagggcaacaggttaaaaaaggtaataaagacacacggtggagaatatatgacacgacacggtgatttccaacaaaagataacacagatgtagttacccacgaagttttaatgagcacacacaggtaccgtaggaaaaaaggtattagtaatcagggaaggaaccactcaaccaagacaggagagtgaaaaaaaccagtcgagcgtaaaaaaagaagaagaagtatagtagtaacacgaaggaaaagagaaataaatttaacaaaagaaatgaatgcagagcatagaaagggaaggataaaaaaaacaacacaatagcatatatagatcagaaaaccaaaacaaaaagcaacaaaggaggagagaacaacgaacaaacaacaacatcattaaagaatacaccagcaccccccctccttctccatctatagacgaaaagacagaacgaaaaaaat

SEQ ID NO: 546045 - DNA, 412 bp, Homo sapiens
gtatccatgcgacctagagtacgaaccctgccgggccctactactcctgtcactagtatcaacaggtacacgcagagctgccgccaagttcctgtacgggggctgcgaaggaaaacgcaaacaattcctacacctggacacgcttgcgaaatgcttgctgaaggatagaacagagttcccaaagtatgccggctgcaaagtaagtgtggacgaccagtgtgaggggtccacagaaaagtataactataaatctaagttccatgacatgtgaaaaattctttaccggtaggtgtcaccggaaccggatagggaaccggttaccagataaagctactcgaatgggcttctgcgcaccaaagaaaattccatcaatcagatacagaccaaaagatgagggactgtgctctgccaa

SEQ ID NO: 546046 - DNA, 430 bp, Homo sapiens
  misc_feature (366)..(366): n is a, c, g, or t
gcaggacttttcttaagttacaaataagaccatcttaaactctttgctgtaatctgtaaggctagacttgacctggtcccagacattgtctctagcctcacctccttagctccctgtcctcattcttgccttctttgattccctctaaaacacaagcagcgattttccacttggattttttgcacccactgcacaatgcagcctggctctttccctcccttgttcctgtatctttttcctttaagtcttagaccggggcttctctggcttctctactaaaggagccccctctgagaagtgagcttccaaaaatattgtccctactgtcattcttcatcaacaatgggatatgagagcctatttttnccatatccctggcaacaagggagtatttccaaagttgttttcatcctggccagtttggattagg

SEQ ID NO: 546047 - DNA, 384 bp, Homo sapiens
taacattggatgatgatgagcgcgacagtggtttatttcagactgaaaagcctccagtaactgagctcagagttgattgattgatttattgactgattgactgattgattttttgagacagggtctcactctattgtccagactggagtgcagtggcacgatcatggctcactgcagtttcggcttcttgggctcaagtgattttcccaactcagcctcccaaataactgagactacaggcatgcaccaccatgcctggcttatttttgtattttttttttttttttttttggaaaaattgggttttgccattttgcccagggttttttccaaccccttggctccagttccttttttaaccttccaaaggtgttgaaattcagg

SEQ ID NO: 546048 - DNA, 533 bp, Homo sapiens
tcccttataccaggtaaggtgtactgggcaatgagaactgtgtatttatatgtatcctcagacacacacagatcgctagaagattttactatatgtatctctcaccagcacgtatttgcagatagatcagtatcactcactctcagctcatagatgtaccagactcagctcctataatttcttaaaatttgtgatctagacatcaaacatataggagctattttaagtaataaaaaaaaatgcaaaggtgatttacccagacaacctgcatgtggtgaaactctaagatgtaaagctacaggctgtccttggcctccatcttgaagatgcggctgtgctgccacacacctctgacttctaagccctctcacaaaatggctttcctaatagtgcatgtgtcacaaccagataagcacggtggctttcccacctcacctccagctacttccaagggcccgttctttttccggagttccaggacagcttccacaaactccttgccagctttcttctccagcgtgtatcctagacaa

SEQ ID NO: 546049 - DNA, 671 bp, Homo sapiens
  misc_feature (588)..(588): n is a, c, g, or t
aaagaacctttattactttatatgactgccacttatgctttcttgccaaatgcctatggagcaagtgctttctgagccggaactttttgacccttaccagctctaggagcaggcgcagaattctggcctgtggctttctgggcaggaaccgtctgggctggagcctttttactcgcggccgtgatcttttttgctggaactttagcagcggcagttgcatgagcagctgcatcagcaccatcacccttagtaccaggtgcttttatgcgaaaagctgtcaggagaactgcctttagaagctacataacttcattcttgattatactgggactcattggcttcgccttcataactgtaaaacgaacaaaatttgtcatcttggctttcctttatcagactccaatcttcttggcccatcgtgtggctgaccattatgcatagatgtctgccttctgccaggcttgtcggacatacttctagtgggcactgaaccgaaacttgaggatgaaatcactgatctgcatgcacttgaaaggcattgcctgtctcctgacttgagtgcaaaggccatggaccaaagccctgttntgatcttgacatctacaaccgcgaccaatttaacggatgatgtccaaatgagactaaggcaaccgggcaaccttacgagaggc

SEQ ID NO: 546050 - DNA, 296 bp, Homo sapiens
cacccccacccccacccccaccccccttattttccttttgtctcctggtgattaggccaaagtctgggagtaaggagaggattaggtacttaggagcaaagaaagaagtagcttggaacttttgtgatgctccatatcatcctgtacagcctgctttcacaatgtgttagcaggtccaggtgggttataatgtaaaataatgtgctttctgcccaagtggtaattcatcttggtttgctatgttcaccctgtaaatacaacagaacattaataaatataaaattgtgtaaaaaaaa

SEQ ID NO: 546051 - DNA, 607 bp, Homo sapiens
aacacgagctagatatactgcaagcatctctccttaagataaacagttgctgttaaaattatatatttttgatcaatatatttaaaaattaaaatttctaactttaaaaaaaaaaaaaaaaaaaaaaaaaaaaaaaaaaaaaaaaaaaaaaaaaaaacacccttatacaactggtgtgacaattaaaaccctctcgaaacccaactgattgcccaattaaaccatgtgacttccaatatcaatttgattaactaatatccccattccaaactctctaccaatcacgtttacaccctaactggcaactttgataaccaaacccaaattttgaatttaaaattcccattaaaattctctgaaattgcgtaaaaatttaactaatagtttaaccaaatcaccaaaatttttaaagtagatcaaaaaacccaaaaattcctcaaaatttattaattataaccaaaatttgctaaaataaatacccaatttcaaaacttgaacccgcaattgaaaaatctatcaaaccaaatgttcaaatcccaaaacccattatcttaatcaaagacctctaataacggatgtacctccaaaatttacattatttatcccc

SEQ ID NO: 546052 - DNA, 135 bp, Homo sapiens
gcacctgggagaaggcagaccgtgtgaagggggcctctgccacccgttgctgtggctttcggggagtgggaagtggaggcagagagccttccttacacttcggccatgagttttcctcatcgactccagccatca

SEQ ID NO: 546053 - DNA, 181 bp, Homo sapiens
gctcgaccagggtcttgctctgttctcccaggctgtaccactgtggcacaaccctggctcgttgcaacctccaactccctggctcaggcgactctctcgcctcagcatcccgagtagccgggaccataggtgcactagagtttgaggccagcttgggcaacatggtgaaacccgtctctac

SEQ ID NO: 546054 - DNA, 159 bp, Homo sapiens
gccaagcaatagccgcgggagggagccgttcaaccacacgttccctgtgggtcaacgtcctcctaacgtgctgtctacaagtctagctgtacggccaggtgttacgagtgctaggtcttcaaccaagccctctccaggtccccattcgaggaaaaccat

SEQ ID NO: 546055 - DNA, 476 bp, Homo sapiens
gcggagccttgggttccgggggcctgggaccctggtcgaacctctttcgtaccaagtggcgaaaggtcgggttcagggacgggtggcgcccgggtggcggaaggtggcgcgttcctatggggttggcccggggataaccggtttggcttgcgatcagactttcccattaggtgctttggaccagggggggaaattaccacggttaaaaacaccccaatttggagggaacactggggcccttccccattcccccttggcggggtgggcaggccttcgcaacccaacccttgggctataaacaaggtcgagttaattggcaacccacccgttcgacgccaagggggtcccgtatccgtcgccccaagcgcccaggtggcactacgatttccccaaccccctgggtcgcccaagcgtccaaccctggggggggttcccgggggggaaggccccagggtgggcgttccgcgcggccccgg

SEQ ID NO: 546056 - DNA, 729 bp, Homo sapiens
  misc_feature (121)..(121): n is a, c, g, or t
gacttccgtccgtggggggagctgcggcggtggcggtgcaggaggccgggcaggggtgcggagggaccgacggacgcacgggcgggcggccgggagccatggagcgcggccctggggcccngggtggaggcccggcctgtggcggctgcccagcatgaatgggctgtcgcttgagtgagcatgtgttgcctgtcgttctgcgtgttccgaccgtgccccgggcgcatcgctgccaatgcttgccgttccttgccgtcggaggccgaccatacttcccgtggtgccttgtagcccgatgccggggcactggtgggggccggggccgcccccattgggagagccctgagagcctcactcagggcgcacccggggcgcttggagagctgcaccgtgacggacgcgtgccagacttccagatacagccaagcgcgagcttggacacgcatcgagagtcttccccgaccagagagtcgcccgcggcgaatcgcggtctccgtgcattgtatgtcccgcttgcgtgcctggttgccagtgtacagcggtcctgcttctcgcacgggaatgccgtggacctgggccagatgagcagcttctacattggcctgggctcccgcatccagtgcaacatcttctcctacagaatactccggctacggtgcagctcgggcaggccttccgagaggaacctctatgccgacatcgacgccgctggcaggcctgcgcaccaag

SEQ ID NO: 546057 - DNA, 380 bp, Homo sapiens
  misc_feature (8)..(8): n is a, c, g, or t
aaaagacncaaagtgccagaatggctgcctttgagtgggggtgagaagaggtggatggcaggtaccacaaaagaagggaataaatatatgaaaaaattcaaccccctcgggcagaggctggggccccatcattatgcccagaaaaaaaagccccagttgcttacgttcccggcaacagggccgggaccagcgccggcttcttggtgaagaaggcccccctttcctcttaagggttttaagtatgcattcaagcacccggtgggcacccagcaccaagttgaccaggggccttcacctctgtgggggttccggccctggccttgaaaactgaataaaacctgcataattccttttgtaataaagccaacgcaaccccgaaa

SEQ ID NO: 546058 - DNA, 673 bp, Homo sapiens
  misc_feature (121)..(121): n is a, c, g, or t
gacttccgtccgtggggggagctgcggcggtggcggtgcaggaggccgggcaggggtgcggagggaccgacggacgcacgggcgggcggccgggagccatggagcgcggccctggggcccngggtgcgcggggccgggggtgggcttcccacaggaacagacatggagacctgtggttgcgaggctccctggggctctgggcgtatgggacccccgcggaattgggcgggcttgggggcacccttgagacactaccttttaaacgggggggccttgccattgatcctggggggcgccgggattatgcctttgggggtgttgtgggcagcatcatccccacccgttgcccaggcgaacgtccgggatgcagccacacatgacgcctacacccttgcacggagtgacaatgcgcccgtggccgggcggcggagtgagcgaggggaagccccaccgggaaggcgcagaggacccagggacaattggacggcagggggggaacagggacgaagagcaaatgggggcaatgacaggcatggacacctggaaggaacctggctaggaactacataactggacgggccacgcaactatggcccccgggaccacgaacacgcggatcgagaagaggtagcagacgaagactaggcagcaacgaagcgccaccgtaaaaccc

SEQ ID NO: 546059 - DNA, 81 bp, Homo sapiens
tacgtagcagagcagctccctcgctgcgatctattgaaagtcaaacccttgtgtcgagggtcgacgcggccgcgaatttag

SEQ ID NO: 546060 - DNA, 152 bp, Homo sapiens
tcctgcccttctgctcttgactcgtgtctgtcgtaccccgccttacggccatcacaggccttccatctgcggtagctttgttcgcactttccatcacggtctttcttactcaggagcgtccattcctcgctgggatgtggctggatctcgta

SEQ ID NO: 546061 - DNA, 105 bp, Homo sapiens
aaaacacgtatctgggcttggtagtgcgtgcctgtagtacagctactcagaaggctaaggtggaagattgctggtgccctggagattagaggttgcagtgactta

SEQ ID NO: 546062 - DNA, 352 bp, Homo sapiens
gaattcttatttggagaaagacacaaagttttgtagaaaataggggtgaggtgcgtggaccccaaagcctaatttcccagcagaaatcggccctggaactagaactccctgatccccagaattgcagctgcggatggaggtccggttcctgaagcctcgggtttggccgccgagtcgctgcctggtgggaggaaactggggttggcgcgggtaccagcctgagcgttcctctgacccggaaccggagggtgagcgcacgcagcccgcggccactgctcgggatccagcgttcccctctgatctctccagcgcattgctttgggctgaattctctcagccctggggagtggtg

SEQ ID NO: 546063 - DNA, 281 bp, Homo sapiens
cccccccccccccccccggggtgaaccttaaaagtccccaagcaatggattgggcagcctttattttacccccccctcccccggcccctttgggggggccccacccctaaatggcaggaatttggaaaaaatgcggtgtcacgtccccccctatgcccgcccacgcggtttgccccaactccaccaacacgtggggcccgtgaatttgggggtttgctctccccttaggtggttatgtgggtaaacttatatgattacttattaaaacccaattgggcgga

SEQ ID NO: 546064 - DNA, 181 bp, Homo sapiens
tgagacggcgatatctctgtcatcatcacatcaacatcatcagcatcaccatcagcactgtcatcacaccatcaccaccatcaacatcatcacagtcattatcaccatcatcagggtcatcaccatcaacattagtcacgcaccatcaccatcatcaccataatcgccggtcacgagatgt

SEQ ID NO: 546065 - DNA, 939 bp, Homo sapiens
gagagcagcaccccaccagcagccccgcacacctgctggcccgagactgtgctctcgacctgttcatccccttccctggagggagcaagcgccctctggacagacagaaccatctgaggctcacattgggttttgagacaagaaggggacgtgtgggtttctcttccttacactatttggctgcacatgtctttaacccaggagcccaggggtagacaaaggaggactgaggtaatcaatttgcacctttaaaatttttttcttttattttctttagtggtgacttccttcccaattatctttcttcatccatcccagtcctctgccctgacgtgtgtaactcttgggtacttgagcagatggaatattccagaggtgggaggtgggaggggaggggagaagtcccaaacaaagtgttcttgctctgacccatattaatcttgtatgcttggattatttaattttttcttttgcacatttttcttgtattaaggttgttcttcccaaaaagctggatttagtaacccagccaccagcatcgtctggaaatagaggctaatggggaggcccccatgagacaaagatccctccctccctctaacctatgcctaagacctctttagtttgggaggatccccctcatctcctggagcagtataccagtggagtggaccggaggggcagggctctcggacaggttctcctgtgtagtactggacctgtttcctaaccactcctaatgtggaccccactacattggttactgaaatgacctccagtgatgaacctgaatgggtggtttcccaacatcaaagggggggggctccctccgaggagatcgttgcttctcaccctttttacagcgggacagagcggacagaaaaaaacagacgaggaatatcgcacagaagtaacagacaggagacacagggcaagctt

SEQ ID NO: 546066 - DNA, 235 bp, Homo sapiens
agttgctacctcatcagacagagtgctactgcacaacagtgtatgtcagtggaatgtgtgtagtgtccagtgtgtgtggtgtgtggtgtgcagtgtgtggtgtatggtgtgcagtgctgtatgtagtgtgtgtgttgtgtacagtttggtgtgtggtgtgtgctttgtgttgtgcagtgtgcatgtgtagtgtgcagtgtgtgatgtgttgtgtgctgtttgtggtggtagcact

SEQ ID NO: 546067 - DNA, 257 bp, Homo sapiens
aaaagagggccagtgaggctgttgaatctaagtgagacagacaatggctccaaatgaggctagaaaaggcagcagggccagatgaccacggccacataggccatgatgaagcttttgaaattttttctaagcgcaacagggaactactggaggttatcctcatatttggaatcagctgttggcagatgatggaatgttgcaggaatggtgacgctgtattgagtaaaattataaagcttatgatggcagtgtaggga

SEQ ID NO: 546068 - DNA, 493 bp, Homo sapiens
  misc_feature (398)..(398): n is a, c, g, or t
  misc_feature (479)..(479): n is a, c, g, or t
ggcaatattagcctcattttacagatgtctgagaagatgagcattaatcaaaataataacttttgtagaccttgtcaggcaccttttagagaaactactaaaaacgtaccaacttgttttaataagaaaatctagagattttcatttctaaagccttagaataaaattatggaaaatattatcaaatcatctttgacaatgcataaagtttaaaaaaagaattttttcatatggaaacatactgttattttaggatgtagtgactgagtttgatacctcctttgtgaggtttgtttggtggagaaatgtgagaggaggttgtattgacccctaaggttttcccatgcaagagtaagacagtgatagtcctcttcaagaagaaaagggctttcttcttnataatatctgtggggcaaaagaagaattcccacacattcattggattaaggtaacatgggcgtcaaacatgtaattctgcngtttttgtgttggt

SEQ ID NO: 546069 - DNA, 454 bp, Homo sapiens
caatggggcagtctgcagaaactgcccagagctcacacatgctttaatcgcctgcacttacctccatatgacacctttgagcatttacgagagaaacccctcatggccgtggaacctgctcaaggatttgacggggtcgattacagaccctctgcctcgggcgtgcttgttcttcaagcacgttctgcttgcacttttgcatttgcctaccagacttttccgacggcgatccagcagagcagctgcaggcatgctccctggcgccgagccttcaccacgcactcgtccaagttcggacgcgcgaacctgcgtcccagcttgactccctgcctttcccaccacaaattctcacctggttgatctgtacactaatcacatttcaggcggacttcatgctatctatgttgtgcctccggcagcaaagcccttaataactattttacatccttaaaaa

SEQ ID NO: 546070 - DNA, 434 bp, Homo sapiens
  misc_feature (13)..(13): n is a, c, g, or t
cagaatacagggntccagtatgatgtcatcagctgcttaaatttgctggatcgctgtgatcagcccctgacattgttaaaagatatcagaagtgtcttggagcccacccaaggcagggtcatcctggcattggttttgccctttcatccctatgtagaaaacggtggcaagtgggagaaaccatcagaaattctggaaatcaagggacagaattgggaagagcaagtgaatagcctgcctgaggtgttcagaaaagccggctttgtcgtcgaagctttcactagactgccatacctgtgtgaaggcgacattgtacaatgactacttatgtttcttggacgatgctgtctttgttctccagaccagtataaacacgtggaggcccaagtcctcagagtcacccctgcaaccgaccctcccagaagaggagatgc

SEQ ID NO: 546071 - DNA, 324 bp, Homo sapiens
tgcgggtccttcctgaccttggagatagagctgcagtcccagctcagcatgaaagcatccctggagggcaacctggcggagacagcgaaccgctactggcgtgcagctgtcccagatccagggtgctgactgggcagcgctggaggagcagcttggcccatgcttcgctgcgagtctggagcagcagaaccagtgaatacaaaatccgtgctggattgtgaagcacgcggctggatgcaggagatttgccaccttacggccgcctgcttggagggagaggatgcccacctgtgactcagtacaagaaagaaccggtgaccaccc

SEQ ID NO: 546072 - DNA, 90 bp, Homo sapiens
ctagttctagatcgcccccggccccccatgtattacttttttttctgagacatgaatgtaagttgtaaacattgtgcccttttatccctg

SEQ ID NO: 546073 - DNA, 266 bp, Homo sapiens
tctctgagagtccagcacagaggagaagagcagctcacagccaagcagctgctgctctgatcccagcaatgctggggggaattgtttgagggctgccactgcagtctctggtctggagcagatgagaacagatctgccttgtgatgtcttgagtgggctgccctgtaggaacatgatttgagtctggataacttgttcagtgagtgagattgatgacttgtgacccatcttgtctgggtacctgagcgctgaacttctgtaactca

SEQ ID NO: 546074 - DNA, 171 bp, Homo sapiens
tctctgagagtccagcacagaggagaagagcagctcacagccaagcagctgctgctctgatcccagcaatgctggggggaatgctgagcttgtgtgtgcccccggatgcaagccctttccctcgcatgacgctacacacagtcgtagtctagggcagactgctgacacttg

SEQ ID NO: 546075 - DNA, 199 bp, Homo sapiens
ttaagtactcagagaactaacattctgcacgcttctatgctctggtacacgctggacagtagcccctgtaagcctggatactacaggccagtgcttcgtgaattaggagatgataccgggaccaccttccacccccagagcgaggagccgctggtactgatgtagtaggacccaacacccatatatccagtacaacctg

SEQ ID NO: 546076 - DNA, 361 bp, Homo sapiens
tatagatggatcccatacagctcctaccctcatatccagtccatcagagaaggcagagacagcctcctttcttccacaaaacaggccactgcagagcagtgtcgtggatgcagaggatgggcccacacaaggatgttcagagtatgcgtgcttgggaaaagatggtgacaaatgaagagtaaagtgacatggtgtatggacatggcaccagcttacagacttaggtctttgacaggatggtcaaggtttgaggttcaaagaagctatttccctaaacactcagagaaggcaaagggaatgttatttctattgctcccaacattgaatcattcagaagccgaaattggaagagatttcctca

SEQ ID NO: 546077 - DNA, 142 bp, Homo sapiens
cttggaatggcagaatcacattcttgggcccacacaatactccattaggatggtttttgtttttgttttaaaacggggtcttcctctgtcactcaggctggaatgcataagcgctattcttggtcactgcaactctgccttc

SEQ ID NO: 546078 - DNA, 109 bp, Homo sapiens
gccgaatatgcgctggatgcgatcctgggcgtctcctatttggatgccatggacaatattaccaggcagaaccaattctacgatacccatatgtcatcaaacaagaaaa

SEQ ID NO: 546079 - DNA, 91 bp, Homo sapiens
ggatttgctggtgcagtacaactaggcttaatagggatttgtggtgcagtacaactaggcttaatagggtcaagcttctaacgttagaagc

SEQ ID NO: 546080 - DNA, 184 bp, Homo sapiens
cctaagttgaatgctccgcgaggcagcactgaatgccaatgactacctgtgtgcctagttgcatgtccttgacgtgcgaccgtggagtctctgcgctggcacgaatgagtccctgtgagaggcagatgcgcgaccgggaggagcggcacgtgcggaaggcggccagttatcaggaggcgctggc

SEQ ID NO: 546081 - DNA, 124 bp, Homo sapiens
accacgattgtgatctgtgaggtcttctaaaaatttacaagaaacacgttctgtgtgggccctgtgagcacaggctggcctctgtatttaggcctgctttggatctcacagatcacccttcgtg

SEQ ID NO: 546082 - DNA, 419 bp, Homo sapiens
gccggggcggaggattttagcttctgttcggaaaaccaggcatatcggggggcttcgaaggctatatcaggacctcaggaccacgggcccaaacatgatgacacagagtgactcctagtcctgtaaacaagtaactacgcacttcggggccctttagtgcgtccaggacacctcaactacggaggaagcctagaaaacaacctcagtgccctaccagacgaagacggatgagcactccgatatcactcacatttctgtttatcggtgaatacagcgctaagatgccatcagcacaccacgctgggtaatagcttctgataatcgaagtctgcccatctagacaggctgccatttcattaagattcatgtagggcagatcaataccctaattggcctaatggcccgattgcatgggtcgc

SEQ ID NO: 546083 - DNA, 144 bp, Homo sapiens
tttctaacgagaacttttaaaatgatccgttccaaaaaagggtaggagccgcgagaccctccaactgcctcaagtgtctaagtacattagagtcaggaacggcgctttccagcgtccgccatttttgtggcgtcaccgcgtcgc

SEQ ID NO: 546084 - DNA, 344 bp, Homo sapiens
gatgactgacacctgtaatcccagcgacctatgcggccggtcacggctggcagatcacccgaggtcaggagctcacgaccagcctaaccaacatgagagaaaccctgtctctactaaaagaaaaatacaaaatatagccagacgtggtggtgcacgcctttaatcccagctactcgggaggctgaggcaggagaatcacatgaatccaggaggtggaggttgcagtgagctgagatcttcccactgcactccagcctggccaataagacctgtctccagcaagaccctgtctcaaaaacaaaaaaaaaatggcatattgactcctgaagaaattcaagccatgt

SEQ ID NO: 546085 - DNA, 110 bp, Homo sapiens
cagaatggtatcattcaccttgatgaggggatcgtcgtagcggatggtgcgggcattcatgagttcaccagatgagggattccttttgtgcccacaaggatctttctcac

SEQ ID NO: 546086 - DNA, 106 bp, Homo sapiens
tttgtcccggacaaatcctgtatgaaagagagatgtgggcttccttaatgagtctagtgttaggtgctgagacctttaacatgggcttatacagggagagagtctt

SEQ ID NO: 546087 - DNA, 655 bp, Homo sapiens
  misc_feature (30)..(30): n is a, c, g, or t
  misc_feature (38)..(38): n is a, c, g, or t
  misc_feature (58)..(58): n is a, c, g, or t
  misc_feature (61)..(61): n is a, c, g, or t
  misc_feature (117)..(117): n is a, c, g, or t
  misc_feature (119)..(119): n is a, c, g, or t
gttcactattcccctttcctgccctcactnagaagttnacgatgcagggtggagatgnggnttggatgagcctttctcaagcactgggagtttgatgctccaagccctctcccacanantacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctggatctattttcctctatttcctatcattttattatccccatgcaatgcctttggaataaaacaaacaggagtctgtttttgctatggaatgccccatggggcattttttgtggacttattgtttaaggtttcccccaactgtgatttttttgaacccaataaactattttgatgattttgggtggaaaaaaaa

SEQ ID NO: 546088 - DNA, 108 bp, Homo sapiens
atgggtcagataggactagtcaagtacatataagcctacccaatgtggttgtgactctaggaagatggcattattaggctgtatccatgcctcccacattctaggctg

SEQ ID NO: 546089 - DNA, 137 bp, Homo sapiens
  misc_feature (27)..(27): n is a, c, g, or t
  misc_feature (41)..(41): n is a, c, g, or t
  misc_feature (48)..(48): n is a, c, g, or t
  misc_feature (52)..(52): n is a, c, g, or t
  misc_feature (71)..(71): n is a, c, g, or t
  misc_feature (98)..(98): n is a, c, g, or t
  misc_feature (108)..(108): n is a, c, g, or t
  misc_feature (133)..(133): n is a, c, g, or t
gctttccatgaccatgggaggatgaangaaagcattctatngggaccnactngaagaaagaccgaattgcnaaaggtaagaaaggagcttatatgccnaggaaccagnattttagcaagttggtggggtctcnaata

SEQ ID NO: 546090 - DNA, 685 bp, Homo sapiens
  misc_feature (30)..(30): n is a, c, g, or t
  misc_feature (38)..(38): n is a, c, g, or t
  misc_feature (58)..(58): n is a, c, g, or t
  misc_feature (61)..(61): n is a, c, g, or t
  misc_feature (117)..(117): n is a, c, g, or t
  misc_feature (119)..(119): n is a, c, g, or t
  misc_feature (429)..(429): n is a, c, g, or t
gttcactattcccctttcctgccctcactnagaagttnacgatgcagggtggagatgnggnttggatgagcctttctcaagcactgggagtttgatgctccaagccctctcccacanantacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctccctttcctttctccggggagaatntggctcctcgattgctccgtactctaacatctagctggcttccctgtctattgccttttcctggatctattttcctctatttcctatcattttattatccccatgcaatgcctttggaataaaacaaacaggagtctgtttttgctatggaatgccccatggggcattttttgtggacttattgtttaaggtttcccccaactgtgatttttttgaacccaataaactattttgatgattttgggtggaaaaaaaa

SEQ ID NO: 546091 - DNA, 830 bp, Homo sapiens
  misc_feature (110)..(110): n is a, c, g, or t
  misc_feature (259)..(259): n is a, c, g, or t
  misc_feature (310)..(312): n is a, c, g, or t
  misc_feature (500)..(502): n is a, c, g, or t
  misc_feature (523)..(524): n is a, c, g, or t
  misc_feature (600)..(601): n is a, c, g, or t
gctttttctacctaataaatacgaagggctgtagaagctcagggcccttgctcactagaaggagccccctgaccccttcttccaaaaatactttttgtcttggtcttcgntttctgcattcatccccctttcgttcactccacataacaaccaaacaggcgacaactggcaccttaggacaggggactgtgatgtgacaggtcctgcgtggagccagaagagaactggacacgtgacaaggagagagagcgagaatgangaaaacccgtgcgagcgaagtcgtgcgtgacgaggtggatattagagtcgnnngcaaaattcagctgggaccccacccaaagcgggcaattgtggagaagtcgtgcacaaccttggcaattttaaccttttattttcaatttatatgggcaaaacaccaaaacttgggcggacgcatgtttacaggcgccggacaaggaagtgcaagtgtcggtgggaccaaacttcaggtatttaccacnnntgaagggcttattattgaagnncaaagcaggaaaactggttcttccagtgaaacgcagggattgtgtgggaacaacttaacaactggtgttcttgcgnncagaagggtttggctggagggcagtacatggccccaaaggcgcagtggttcctttgttggattatctatagttaaccatctgaagcctgtgtgtacacaggaagcaattatgtgtacctgtgataaatcaagcagtgaccaatgttactttcctcctggtcttttacctaataattgaagggtgtaaagctcaggggcctgccataagagagagttcctgacccttttc

SEQ ID NO: 546092 - DNA, 154 bp, Homo sapiens
ttttaaataatatacactggcatcagccaaagaaaaaatgcaaacagatgtacaagaagctcctaaaaagctgcatccatttccatactgcctgaccccgtgtgggtatgcccgccctcctacaccctatacagcagggtgttgccacagcttg

SEQ ID NO: 546093 - DNA, 654 bp, Homo sapiens
  misc_feature (30)..(30): n is a, c, g, or t
  misc_feature (38)..(38): n is a, c, g, or t
  misc_feature (58)..(58): n is a, c, g, or t
  misc_feature (61)..(61): n is a, c, g, or t
  misc_feature (117)..(117): n is a, c, g, or t
  misc_feature (119)..(119): n is a, c, g, or t
gttcactattcccctttcctgccctcactnagaagttnacgatgcagggtggagatgnggnttggatgagcctttctcaagcactgggagtttgatgctccaagccctctcccacanantacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctccaagattgctccgttctctaggataaaaatggcttcccggtcgaaagccccccccccccggggttttcgggttgcccaaaaatttgatgatcgccaccccatgcctatgtaatggggcacccaggagtctgtttttgctatggaatgccccatggggcattttttgtggacttattgtttaaggtttcccccaactgtgatttttttgaacccaataaactattttgatgattttgggtggaaaaaaaa

SEQ ID NO: 546094 - DNA, 129 bp, Homo sapiens
tgctgctgcaggttgatctagaggtcccctagcccacctggcagagcggtcgaggctggaagaggatcctgggcgccgcagtctttagcaccagttggtgtaggagttgagacctacttcacagtagtt

SEQ ID NO: 546095 - DNA, 1629 bp, Homo sapiens
gggttatttcactctttgcaataagtcttgctgctgctcactctttgggtccacattgcctttgtgagctgtaacactcactcgcgaaggtctgcacagctttactcctgaagccagcctagagaccacgaacccaccagaaggaagaaatagaagacaccgaacatcagaaggaacaaactcccgtcagctgcttttaagaaccgtaacactaccgtgaggtcccgcggttcgttcttgaagtcagtgagaccaagaacttaccaattccggagtggcgtaatcaccaggaaggattattaatacataaggttgggccagaacttaccaattccgagcagtgccgctaatgatcaactagaaggaactttattaataccataaggttggaactacgctggacagtccacttggttgaagatggatgagattttctttggtctgtttttggaaaagttttcaagagggtccaggcttgcacttcaggggcagagagtttctatgatgtggcagaaatgggctttggcttccactggctttgccttggagccgacggaaggcgctcccaggataagatcgggagaagtttctacccgctgaaggatgactggtactgatgagaagtcagggatggctgctgcttgccaggtgcgcccaaatggaaattgattcacacagggataacagcctgagtggaggaggacctcccctagtgcgggggaagtattgtcgggtacaggattctccagggcaacttgggaaaacaaagcccaagttttcaaactctgcctatcagttttactgcacattaccgttggtgcaaaagtaattgcaggttttgccattaaaaatgatgtaatagttactgtaaagatgttcatcacaggtcaactggtaaaagaacaaaaggccccaaaatgctttaggtggggagatgaattaacctaattatgctatatctgaataaaagaattgcagttggccaataaaaatggcatcattgtgttgtagaagaatattgggcctcatggaaagatgacaacggtgggtgctttctatgtgcaggccctgttctcgatccttcagacaatctgcagaggtgagtactattattagccccattttgctgttgaggaaacccaggatcacagagaggttaagctaagctgcccaaggtaatacagctgtaaagtggtggaactgagatttgaaactaaccagtctggcttcaagctctcaaagactttctcatgatggaaagcctgttttgttttgtttttcctttaataaaaaaagaggccaggtgtggtggcacacatccgtaatcccagctactcaggaagctgaggcgggaggatcacttgagccccaccagagctccccccaacctctggcaaccacttgtctttttactgtctccacagttctgcaattttctagaagtggtagagttgggatcatacagcgggtttttcagatggggttctttcacttagtaacaggaatttagcttcctccatgtctttttatggcttgatggctcatttctttttagtggtgaatactattttgttgtctgatgttcttgagttcaagaccacctgggcaacatagtgagcccccatctct

SEQ ID NO: 546096 - DNA, 463 bp, Homo sapiens
cagaggacccagttgagcccacctggacttaagatctacagaactgtgagataataaatgggtgttgttttaaggcattgagtttgtggtaatttgttgcattagcagtagaaaactaatacatttgtaagaaattatttttacatctataattattcttttgggataaaatccttgatataggccgggcatggtggctcacacctgtaatcccagcactttgggaggccaaggtgaacggatcacgaagtcagaagatggagaccatcctgactaacacggtgaatccccgtctctactaaaaatacaaaaaattagccagacgtggtggcacatgcctgtagtcacagctacttgggaggctgaggcaggagaattgcttgaacccaggaggcagatgttgcagttagctgagattgcaccactgcactctagcctgggtgacaaagcgatactccctctt

SEQ ID NO: 546097 - DNA, 471 bp, Homo sapiens
  misc_feature (30)..(30): n is a, c, g, or t
  misc_feature (38)..(38): n is a, c, g, or t
  misc_feature (58)..(58): n is a, c, g, or t
  misc_feature (61)..(61): n is a, c, g, or t
  misc_feature (117)..(117): n is a, c, g, or t
  misc_feature (119)..(119): n is a, c, g, or t
gttcactattcccctttcctgccctcactnagaagttnacgatgcagggtggagatgnggnttggatgagcctttctcaagcactgggagtttgatgctccaagccctctcccacanantacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaaaagaaagagatttattggacttacagttccatgtggctggggaggcctcacaatcatggctgaaggtgaacggcacatctcacatggcggcagacaagagaagagcgcttatgcagggaaaccccccttttaaaaccacc

SEQ ID NO: 546098 - DNA, 180 bp, Homo sapiens
ataggtttaggcctttgtcttcagatttaggagtagcatatttaaatttctgagtttgaattatgcagcctgtggttccctcctttgggacaaatgatggaagttgttgttgagtaatttgtaatttgtgtgctcaatttataaaaggaaaattgctgagacatcacataattccaactg

SEQ ID NO: 546099 - DNA, 906 bp, Homo sapiens
ttcacggccgagtcctgtcatgcattgagtcctgcctcctgtgtcatcatgactgatggcgtgtgtccattcgctctgaggacgttcccttggccatgtgtaggcatgtgtgtcgcgcagcacagtctcccaagaacagggagggtaagacagaccccaatcggtagccgtgtacaaagcttggcatgactagccaggggtctcaggctatagtcaaggggatagccatgactcatctgccagaatttagtcacactagcggaatgtgacttttattcagagcgtggcgtgaccctgttattcccatgggtgccgggagtgctgaccttcccatgtagtcgggggaacccatgttcccgcaatggattcgattcaaggcattacttttcctcacaaagccaatagcgctcttccatgtttccgtcccttgtcacccagtagtcaattactgccattgcgagcattccatatcacctagagagttgggttgctcgcaagctaaatgaatcaatcctcgagattttgtgcgaccgtccatacatgtatgttgcggttggaaatgcttgggaccgacttctggtgtggtgtgcccggcaaggggggtcgcaacatacccgcgtcgttgaattaggttgtatggcccgtgcttagtaagttagcgcccccgtgacccccgctcgttaaactaggcttgaatagctggggtaaaggcttgcacgcattaagactgaaatgtccgaacggcctccgcagtaacgtgccgaacttgagtaattccttactaattcagcactggaataaagcgtgtcctgtagctacaggattaaaccgctcgttcgtcccggtttgttctcctctaccgagccgtctaagtgcgtcattctatggcactcgcagggaacagtc

SEQ ID NO: 546100 - DNA, 578 bp, Homo sapiens
  misc_feature (16)..(16): n is a, c, g, or t
  misc_feature (62)..(62): n is a, c, g, or t
  misc_feature (77)..(77): n is a, c, g, or t
  misc_feature (87)..(87): n is a, c, g, or t
  misc_feature (91)..(92): n is a, c, g, or t
  misc_feature (99)..(99): n is a, c, g, or t
  misc_feature (105)..(105): n is a, c, g, or t
  misc_feature (132)..(132): n is a, c, g, or t
  misc_feature (139)..(139): n is a, c, g, or t
aacaaaaagaaaacgntgtggtgctgttgccccctggggccctgaaactgttggtgtcctgngtggtgccatccatntatctgtggncccnntccttcnatccantcaaagggaagatgccgacaaaaaganaaatganagaaagaaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctggatctattttcctctatttcctatcattttattatccccatgcaatgcctttggaataaaacaaacaggagtctgtttttgctatggaatgccccatggggcattttttgtggacttattgtttaaggtttcccccaactgtgatttttttgaacccaataaactattttgatgattttgggtggaaaaaaaa

SEQ ID NO: 546101 - DNA, 558 bp, Homo sapiens
  misc_feature (16)..(16): n is a, c, g, or t
  misc_feature (62)..(62): n is a, c, g, or t
  misc_feature (77)..(77): n is a, c, g, or t
  misc_feature (87)..(87): n is a, c, g, or t
  misc_feature (91)..(92): n is a, c, g, or t
  misc_feature (99)..(99): n is a, c, g, or t
  misc_feature (105)..(105): n is a, c, g, or t
  misc_feature (132)..(132): n is a, c, g, or t
  misc_feature (139)..(139): n is a, c, g, or t
aacaaaaagaaaacgntgtggtgctgttgccccctggggccctgaaactgttggtgtcctgngtggtgccatccatntatctgtggncccnntccttcnatccantcaaagggaagatgccgacaaaaaganaaatganagaaagaaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctggatctattttcctctatttcctatcattttattatccccatgcaatgcctttggaataaaacaaacaggagtctgtttttgctatggaatgccccatggggcatctcaggtgtacgaattgttaaaggatacctccacctgtgatgcttctgagcgcattccacagcttgaga

SEQ ID NO: 546102 - DNA, 398 bp, Homo sapiens
  misc_feature (65)..(65): n is a, c, g, or t
  misc_feature (67)..(67): n is a, c, g, or t
  misc_feature (74)..(74): n is a, c, g, or t
  misc_feature (77)..(77): n is a, c, g, or t
gactcctctcttttttggaacaagggcaataacccgctcctctgcaaccaagtcaaacctcgaananaatgagnagngaaaactttgtgaatctgtaatttggtgcgtgcgtattgaagcatgagatctttccaaactcatggcaactatacctcaaaattaaactctataattaaggaagaaaccctcattctccctgtaataactgaatacctaagcacattaaaatgcctaaataatctgggattttcccggatggtggggaaaggttttcttaagctatgcggcagttataccctttgcttcctttaaaacaccctgaatgagcattttaaagagataaatggaatttataagctatcaacttctcgtcattaaaaaataattaaagctgattt

SEQ ID NO: 546103 - DNA, 196 bp, Homo sapiens
gttttaggcccggtttccttttaaaaaaagaaatggtccctggtggggaaaaaaaggtggtattttttccttttaaaagccacctgtttaggtttttaaggaatcccggtggggttttttgttggtttcctggtaacaaagcaaaaattgttaaaaatttttatttaaaatttaggggcccttttgtcctttttta

SEQ ID NO: 546104 - DNA, 583 bp, Homo sapiens
  misc_feature (16)..(16): n is a, c, g, or t
  misc_feature (62)..(62): n is a, c, g, or t
  misc_feature (77)..(77): n is a, c, g, or t
  misc_feature (87)..(87): n is a, c, g, or t
  misc_feature (91)..(92): n is a, c, g, or t
  misc_feature (99)..(99): n is a, c, g, or t
  misc_feature (105)..(105): n is a, c, g, or t
  misc_feature (132)..(132): n is a, c, g, or t
  misc_feature (139)..(139): n is a, c, g, or t
aacaaaaagaaaacgntgtggtgctgttgccccctggggccctgaaactgttggtgtcctgngtggtgccatccatntatctgtggncccnntccttcnatccantcaaagggaagatgccgacaaaaaganaaatganagaaagaaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctggatctattttcctctatttcctatcattttattatccccatgcaatgcctttggaataaaacaaacaggagtctgtttttgctatggaatgccccatggggcatctcttctgcacttcttgtttaacgcttcctcaaaccgtgattttcccgacaacaatacactattttcacgacctctgggtcgaaaaaacacaac

SEQ ID NO: 546105 - DNA, 516 bp, Homo sapiens
  misc_feature (74)..(74): n is a, c, g, or t
  misc_feature (159)..(159): n is a, c, g, or t
  misc_feature (162)..(162): n is a, c, g, or t
  misc_feature (172)..(172): n is a, c, g, or t
aaatccgtgccctcaggtgtacttgggaattttccctggggcccaaagtgttgtattgtaaaacaggatcatcnatgtttgtccaatgcatctaaaacgagtggtttggtccaaaaccctggttaaaaattgcattgtgttcattcacagccccccgtnccnccagtggtgngagttcccctattggttgcccctgggccccaaaaagggagccaaattttctccttaggaaaaaaagttttttacccaaaaccgtttttaaaaaattccgaagaaattttttgaaaggaaaaaaaatgcccaaatcccccgtttcctggaggaacagttcccacagggcaaactttttgggggcattcttttaaggccgggacagtttggcccaacaaatggttttttgttaaagggcaaaaagttggggttttttttttggaaaaacaagggccccaaaggcaaaaaaatccttttttttttttcccccctgtaaaaaaggggttttttgttttgttcccccca

SEQ ID NO: 546106 - DNA, 381 bp, Homo sapiens
  misc_feature (348)..(348): n is a, c, g, or t
  misc_feature (355)..(355): n is a, c, g, or t
cacttattcctctgatgaatctcggaaaagtaaattgaaaaccttctggaaaggatttaccattttagatgccatgaagaacattcctgggaggaggtcaaaatatcagcattaagaggagtttggcaaacgttgattccagccctcaagaatgattttgaggggtttaagacttcagtggtgaaactggcagatgtgatataaatgggcaagagaacttggaattaggaagtgaaatctggaaaatgtgactgaattggctggcaatcttcatggattaaaatcttaaatgggatgagggaattgctttcttatgggctaagccaaattaaaggtgtttttttggangtggaantctactcctggaggaggctgtggaac

SEQ ID NO: 546107 - DNA, 548 bp, Homo sapiens
ggagacggggtctctagacttggcggataacagaacatcaagatacaaagcaggtaacagaaatggtttcatttcccctcgccatttcaaggactcacggagttacccggtcgcttacaagcatcacattgggccatcggatagaacaaaacggtatattgggacatgcattctcacaacagaactcttccacgttccctcctaaattattcggtaccaataggggagaggtcggtaaacaagtaacggcacatgtgacaggtgatttccccaggggtgtggccaaggtcaggtgtataaagcaatgggcaacctaaaaagtcgggaaagataaaattaacataaggtagaagtatcagtgttcggcaagtttaaagggcctaggacaggcccggggcaggggctcacaccggtaatcccaagacttggggaggcggaaagggaagaatcacttgagctcagtagttcaagaacagccggggcaacatagggagactctatctctacgaaaaataaaaaaatagggcgggggggggggtgaagacccg

SEQ ID NO: 546108 - DNA, 262 bp, Homo sapiens
cgggtcactctagaggaccggctccactggtgcacacaggtgataaagtatcctacttctgtgtagtacatattaagaaaattttaaattttcttttattcttattgtggtaaatacccacaatgtaaaatgtacttttaatcacttttaagtatagttcagtagggttaagtatattcacactgtacgtgcaccaatctctagaactttctgcaaaactgatactctccaactccccctttccccctctctccagctctgg

SEQ ID NO: 546109 - DNA, 953 bp, Homo sapiens
  misc_feature (21)..(21): n is a, c, g, or t
  misc_feature (23)..(23): n is a, c, g, or t
  misc_feature (730)..(730): n is a, c, g, or t
  misc_feature (733)..(733): n is a, c, g, or t
  misc_feature (735)..(735): n is a, c, g, or t
  misc_feature (737)..(737): n is a, c, g, or t
  misc_feature (743)..(743): n is a, c, g, or t
  misc_feature (750)..(750): n is a, c, g, or t
  misc_feature (753)..(753): n is a, c, g, or t
  misc_feature (757)..(757): n is a, c, g, or t
  misc_feature (764)..(764): n is a, c, g, or t
  misc_feature (770)..(770): n is a, c, g, or t
  misc_feature (775)..(775): n is a, c, g, or t
gtctagtacaggcctgggtgntngacccggctgcgcgggttgtgcgggcgctgtggcctggtgggtgctgccttggcctggaggctggtgaggccgccccagccgctgctacccacgcagagccgggctggcttcgcgggggcggcgggcggcccgagccccgtggctgcagctcgtaaggggagccctgcggctgctgggagctgcggcgctggccctggtgggggagccctggtgtgcttgtaccacacggcgcggtggcacctgcgcgcccaggacctccactgcagagcgctcagccgcgcagctctccctgtccagccgcctgcagcttgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccagacgacaggagagagattnagntngnggaagngggggangantggntggtganctgatntcccnaaggtgttcggaggccaccgaggactgggtctatgaatacgttgtccggaagggaagtaggaacgtgagtgtgcgtgcaagaaaatgataggggcaagacgtataagaagggataaacaggactgcaaggaatagcagagccttataggtgaaaagggggtaggaagacgcatgcgaa

SEQ ID NO: 546110 - DNA, 933 bp, Homo sapiens
  misc_feature (22)..(22): n is a, c, g, or t
  misc_feature (26)..(26): n is a, c, g, or t
  misc_feature (66)..(66): n is a, c, g, or t
  misc_feature (710)..(710): n is a, c, g, or t
  misc_feature (713)..(713): n is a, c, g, or t
  misc_feature (715)..(715): n is a, c, g, or t
  misc_feature (717)..(717): n is a, c, g, or t
  misc_feature (723)..(723): n is a, c, g, or t
  misc_feature (730)..(730): n is a, c, g, or t
  misc_feature (733)..(733): n is a, c, g, or t
  misc_feature (737)..(737): n is a, c, g, or t
  misc_feature (744)..(744): n is a, c, g, or t
  misc_feature (750)..(750): n is a, c, g, or t
  misc_feature (755)..(755): n is a, c, g, or t
gcggcgtcgacgacatgaccgntgcncgggtgtgcggcgctgtggctggtggtgcgcctggctgangctggaggcgccccagccgctgctacccacgcagagccgggctggcttcgcgggggcggcgggcggcccgagccccgtggctgcagctcgtaaggggagccctgcggctgctgggagctgcggcgctggccctggtgggggagccctggtgtgcttgtaccacacggcgcggtggcacctgcgcgcccaggacctccactgcagagcgctcagccgcgcagctctccctgtccagccgcctgcagcttgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccagacgacaggagagagattnagntngnggaagngggggangantggntggtganctgatntcccnaaggtgttcggaggccaccgaggactgggtctatgaatacgttgtccggaagggaagtaggaacgtgagtgtgcgtgcaagaaaatgataggggcaagacgtataagaagggataaacaggactgcaaggaatagcagagccttataggtgaaaagggggtaggaagacgcatgcgaa

SEQ ID NO: 546111 - DNA, 1148 bp, Homo sapiens
cgaagagcgtaagttcgctctgttcccctgtgatccggggtctttgtgtcaccggccgagccttgggcactctccaggggctatccaggcggggcttaacttctaaagggcgccttggggaacaagaccttttgttcccccagcctgtataccccctgtcggtacaactttgcgttctggaaaggtggcgcatatccaggtcttctacacctggagtctgggttgaccatattactggctacagcgtggcttgaaagccctctccagtgccactgtggaagatgcccctccagtgcttcctaaaggctgaagaactacagcccagggatttttccaaagcaggaagggtatatatttccaagtggctacagagaactagggaaaaactctgaagctagatggctggatgaagttggccctggagctgccagatgtcacgaaggaggatttggctagtccagaaggacctggaagaactggaagtcattctacgagactaaccacgtttcactggccggtcatgactgtgatgccactatgttaaggtggggggccggggaggcttttttcctgtagaccttgctgagatcaggaaaccacacaaatctgtctcctgggtctgactggctacgccacgtaccactccccattagttaatggattgctaacctctaacctgaatgctagaattggggcagtactcatgggcttgccgtttctcgttgttctctcgccttgaggtaagtcatctgtgaaatacaagtcaagattcacagcatgccccaggattacacatgggtagagcctgcaagacctgagaccttccaattgctggtgaggtggatgaacgtcaaagctataggaacaaagcacattacttgtcacagtaatctgtatcactgactaataggactcagtacatagtagtcattgaagatcactacccttacttacgcaaggtaaacaagagggatcagagtggctccagcagagcattgctttcttatcacctatcagtgtgaattgcacctgtaattacatgggagtggaccaaccttgagtaacttctcagtcgtccgggcagcttgaggatgactagcagcgctatggggtactatgatgatatacaacaagggtctgaaaagtgg

SEQ ID NO: 546112 - DNA, 284 bp, Homo sapiens
  misc_feature (117)..(117): n is a, c, g, or t
aaaataataaaaataagagcagaaagcaataaaataactagaataagtaagtttagcaaagttggttgatataagatcggtatacaaaaacgaattgaattggcaacaagcgatctnacaatgaataagatatttacggataaatttgacaagagagattcaggtctatacactgagagacataagacattgttgggagaagtgcagagatctaatagagggagatactggtacatcagttggagacattatgtgaggtagtggtgctgctttggcagcctaga

SEQ ID NO: 546113 - DNA, 473 bp, Homo sapiens
  misc_feature (45)..(45): n is a, c, g, or t
  misc_feature (61)..(61): n is a, c, g, or t
  misc_feature (72)..(72): n is a, c, g, or t
  misc_feature (119)..(120): n is a, c, g, or t
  misc_feature (125)..(126): n is a, c, g, or t
  misc_feature (136)..(136): n is a, c, g, or t
  misc_feature (138)..(138): n is a, c, g, or t
  misc_feature (140)..(140): n is a, c, g, or t
  misc_feature (143)..(145): n is a, c, g, or t
  misc_feature (167)..(167): n is a, c, g, or t
  misc_feature (171)..(171): n is a, c, g, or t
  misc_feature (216)..(216): n is a, c, g, or t
  misc_feature (246)..(246): n is a, c, g, or t
  misc_feature (256)..(256): n is a, c, g, or t
  misc_feature (261)..(261): n is a, c, g, or t
  misc_feature (266)..(266): n is a, c, g, or t
  misc_feature (277)..(277): n is a, c, g, or t
  misc_feature (290)..(290): n is a, c, g, or t
  misc_feature (299)..(299): n is a, c, g, or t
  misc_feature (314)..(314): n is a, c, g, or t
  misc_feature (321)..(321): n is a, c, g, or t
  misc_feature (324)..(324): n is a, c, g, or t
  misc_feature (342)..(342): n is a, c, g, or t
  misc_feature (358)..(358): n is a, c, g, or t
  misc_feature (362)..(363): n is a, c, g, or t
  misc_feature (411)..(411): n is a, c, g, or t
  misc_feature (469)..(469): n is a, c, g, or t
actttttcatcttttatcgtccttccttatctatttttttccttncccattcatatgtttncattcctttcngtttacatttttctctataacaccaagctttatggtgtcctatttcnnaccanncatctgaatncntnttnnnccttcacgggctaatggtactnctcnccagggatggcgtcgggttcttcgtgttcccttctgcgccctttncttctctcagcgccatctggggtttttctntccttttttnttttnccctncccccgccttnccgctttgtaccncttcgggcnttccccttgcccccngccccgnccnccccccacccgacagggncagggggagtgcgganaccnnccgtcggcgggcacgagggcgtgggcaccaatggttgtaactgggccncgctgggggggtggaggggagcgcgcgacgcgctgcgggcgcgtcccgcccagcccgnctta

SEQ ID NO: 546114 - DNA, 356 bp, Homo sapiens
aatcgggcaaggtgtgggttgtcatctttgtgtcgcaagaagcattcatttctctcaggttcctgttatgcacagcagtcagccatttcaccataggtttcacgaacagttgcaactgtgcataatctgtctccaaaaagggtatgaagtgatttgtcacaatgttcacctgactcatcagcaccacatgtttctgcaaactcagttacttcatccactaattagacatgctcttcatgtgcatctcccaattctttaaaccgatgagcaacctcactcttgtgtgcatctcgacgacacacacccctggactgagccgagctagagagaaaaagaaggcaaataaaggttaccct

SEQ ID NO: 546115 - DNA, 345 bp, Homo sapiens
gagagagagagagagagagagagagagagagagagagagagagagagagatatggtggcgcagagagctctgttgcagacgcgcgcgcgcccttcctctggtctgttgtgtgcctgtcgcgtagtatagagcgggcgcgcggcagggggggggtatctactgttgcgtgctatgtcgtcggctgcgcgggaggggctggtgtgtatctctcgggcggaggagcagggcgaggacgacatactacgcatactatcgtcgaggagagagacagcatgcttcggagcaggaggaacgtggcggctaggatgagaaaggcgagcaaaccggtgcggtgacgagcagcgg

SEQ ID NO: 546116 - DNA, 434 bp, Homo sapiens
ctacaccattatcttggaaagaaacaacgttggaaacataacattacagggagctgggacacttaacagatgcaatgtgctactgattgtttccattgcgaatcttttttagcataaaattttctactccttttagtgtttcgtggttctagtgtcttgtaaagtccaggtccacatttgtcacacaacaccaggcattcgctttactgacaattcagggcgcccaattaatacatcagccaagcaatttgcatcgttccagttccccacttggcaggcctttccatccctcgggtggtgcctatggcatggctatctaacaacaaactacaccatatgtattcctggatcgccaaccttttcccccaccagctaaggacatttcccaggggtcaatcagggcctggtccctgggaggacaatttgactgggcg

SEQ ID NO: 546117 - DNA, 316 bp, Homo sapiens
gccggtgcctggtcattattccctgaatggtcacgcatgatcgacaaaagaagctgatctcagtacagccattaagcaagttgcacaagaacgtcgcgactttatgtttattatcgctgctgatgctaaagccgcccatcaggatgtaatacgtgtgatggatgttgcaggtcagcttggatttgttaacgttaacatcagcactaaagttccaactagaggtttcaccgagtgaatcaagattttaaggtttatttacgccttttagcttatctaatatcttattggggtattgccttatttgtattacttggtt

SEQ ID NO: 546118 - DNA, 833 bp, Homo sapiens
gaggagtgtcgtagcccgtgctttctcctgctgctggccgatgcttgctctgaactaaccctctaacccttggggagtctgtgtgcagcagtgatgtgagctgaatccgggcgtgacagagtgggagctcccgctatggaactggcttcaagggaggctaatctaagagagaaagtagtcctcggggaagacagtcttggttgcacccctcatttgcatcttgacctaagttgctgccaactccgggggctccaggacaactctcatttgttctttctctccaaggggtcacgccattggttaaacccaattttgtcactttcttctgaacagatcacagcaaaagtagataactcagccagaagaattcagtgcgtagtgtgacgatgcgtgatgacagacgaaacagatacaggcatcaggaacgcagttaccagctcagcagaccacaagaagagcccgaggctcttaaaccaatcttagcagctcctctgcatgatgtcttgtcttctgtgagttggcagtgtgatgagtggttcatagttgagagacttgtggcacatctggccacgtctcaccgcgcactacttccagttctgcaattgacgtaatgtggagtcacgtgaacggagttggatgttttgggtgggcccagtgtaagggcttagccacgcggggttgtacaccaaacgggttccagaccatattttaaagggctactgtggtaccagccacagggcaaatgggcagaggaaccctcgtcgtgacgaaacttgacctgggtacggcacactgggccaccattgccctgagcgaacacggtggaggacccc

SEQ ID NO: 546119 - DNA, 1470 bp, Homo sapiens
gatcggaagtctctccgtctccactcgccctcggtgctcgctatcaggcccttcgctagttccgctgcgcagggtcggtggtcccgtcaaggtgacacggggccaatggtacgatgggatgatccggggaagaggtatgctggggcgagagagcagacgtttctgcgcgagtggattgcgcgtcgacgggcttgcgggagtgactacccgagcctcactgtcgagtcacgcgcacgactggaccacgcgcttgggagtccttgaggaggacagggtgctttgatgtactgctcatacgggcgcatcctgtcgtcggctcaggggaagcgatgaggcctgctggtaatcaactggtactcgagggagcgttccttacgtgtaaggcactgcgcaatgccggcgcggtgagaatttcccgaaaagaagaattcaggagagcttagatggaacgtctgaaggtccctggggacgagggcaaggcttgggaagacatggggccttggggtctttatcggtcaaggggggcaaaatttgggggggaagggatccatttttaagggaataccttccaaagggggaaaaaggacgggaaccaaaagggtggcccttctggtagaacaacatcgcgttggcgtctgcttcgcaatcccccacttcattagcagacttgctcctctagagaaccggccctcaaggactggaggccaagtggggccgggcccgctgggctgcaaggcggccaaaagggccacgaaagcgactcgaccagactgggcccatccggggcacaccgcgcccacttcgaactctctggtggctccatcccaaactggcccagggctggggtgggctgggggtcgttggggcgtgggcagccgcggcccaaagacaccggagagatacacccacagccgctcggccagactaaagccaccgattcttcaccaaccgggccgagcaaccatctggcccccgcaaaccagagcgccacgccggcccgtcaagccacacccaggggacacaaggagacgcgcgcaagaaaccccacctcggcacgtgacgcccccccacgacacggcgacaccgcggagcctcaatcaacccccccggcagccgcgcacgtggacccacaccacctcccagaccgacccgccacgccccagcagaacacacgtggaaacgcaggggacaacaaccaggcacgaacggacaccacacaactacgaagacgacgcaccacccagccaggagcaacccccaaaaccggcaaggggacaccgacgagagcagcccgcgacccacaccccgcgacttcgcaagcacagcaaagagccacgagcaaccgggacgcagacccgacgcccacacagacgggcgacacacaaccaggcgaaacaggagcagaaaaagcagcgtcgagcatcgacgcgacggccgagaggcgatcgtgcgagaccagactagagcacc

SEQ ID NO: 546120 - DNA, 109 bp, Homo sapiens
ggatctgttcttgatttacctcttgacgcatgactcgactcttaggatcaccttaccaaaagtttccattacaacactgaagtttagaatacagtattacttgggagcg

SEQ ID NO: 546121 - DNA, 269 bp, Homo sapiens
  misc_feature (34)..(34): n is a, c, g, or t
  misc_feature (43)..(43): n is a, c, g, or t
  misc_feature (48)..(48): n is a, c, g, or t
  misc_feature (57)..(57): n is a, c, g, or t
  misc_feature (62)..(62): n is a, c, g, or t
aaagaagggagcaagggagcacaccagccggggnagagggaanggctnaggagctcnacagnaggggaccgggaggaaggtcacagcacacgaaaagggaggcagaaagggaggaccaggaacaacggaaaaggagacaggggaacgcagacagcagggaaagaggcgcaaggcgacgagaagaagaagcagaaaaggggcagttggttggcgcctttttctgtggaaaagacagaatgtcaggaaaaaaaaagcacccgggccaaaag

SEQ ID NO: 546122 - DNA, 399 bp, Homo sapiens
tcttagaggataccccggccgcccttctccggccgccacagtcttctcccagtacctcaccagctcgtgggaactggtgcttgtagggaaccttccgcatccagcgagccgggaatgagcggacgctcttcctcttcgataagctgctgctcatcacgaacaatagagatgacacgtttacgtatgatgctcacatcctgtttggcaacctcatgcttctggaggtgattcctatagagccgctctggcttcagcgtcttctactacaagtagtccctagtctgcagtgcacagtccaggccctatcccggctctgacgaacgcctcttggctctgcatctggtgagactgcttctggtgaaccatgtatcctagatttctgcttcggcccagcgtgct

SEQ ID NO: 546123 - DNA, 153 bp, Homo sapiens
tcggtcctcattacttagctcccacttataagtgagaacattcggtacttggttatgttcctgcattcgtttgctgaggatatggcctccagctcccaaccacgttcttacaaaagacaggaggatctcattctttcttacagttacatcgta

SEQ ID NO: 546124 - DNA, 1072 bp, Homo sapiens
aagatacatagatgctgaagtacctatctaacccctttttctcttctgggatatctaccgcggggaactcttcctttgtgagtgtttgtgaaagttgagttacttgccatggtaactcccttcgaacacagaatggcaatgtttggaacactgccaaattgatgggcattaggtaacaataaccgccacggtgtccgcggaatccaagcctgggataaggcaaccgcgcgtgccaaagtccctccggttctactcaacccttcaagggtggtccaaccaaaaaaccctttgggataaaaaataacggttgggttccccaacctttaaggggcagatcttccttaagccctattccgcaccttgggacaaagggcctccattgtcagggttcttccaaccaggccccggcctggaacaccccggggctcaaaatagagggttctgagacccctgtggtgccaacggccggaaaagatgcctggtcggttccattgtttgtttcgttttgtgttgtgttcgccctttcacatggtgatatgatttaacaaagaaagtaagctgcttagaaggccctctggaagggaagtgaggaggagggacaaggaagatgactagttacggaggaatgcagggttgtctttgtgtgccgacaaaagacctcgggtagaagtgatcatgaataatatggcaccttacctgaatggaaccaccagagtacctcctgtgtggaaagggtactctggattttccctaacacccaccctctcccccgtcagccatgctgatggcagagaagataagaacttggagcccatttctcactggagaggtaaacttgtcattctggctttgcggagaaggttccacctacgctcgtaagtacattatctgtactatgtgatcaggatatccatatcttaaaaggacggaaaaaatgtaaaatacttgaattgagcttgtatatataatacattaatattatatgagagtatctgctttccaggctgacagtgactcattcattattctagtcctgctttagtcctcttgcaaattgtggcaatatgccttc

SEQ ID NO: 546125 - DNA, 931 bp, Homo sapiens
  misc_feature (656)..(658): n is a, c, g, or t
  misc_feature (801)..(802): n is a, c, g, or t
  misc_feature (880)..(880): n is a, c, g, or t
agcggtgggggccggcgaagccatgggcgccgggaccccgccgccgccgccgccgccgccgtctggccccaggaagagaagttaaacttctagagaaacctaacagacaatatccacaacaggtggtaacagaaaacaatccagatggggtgcacggtgctgtgcaataatacaaagctatctctttgagtccagttcaaggtggccctcctccctggcgtatgtcacctgaaagtccaacagcgtggcgaagctagaatgaaagacagacacttgagtatactttcacagggcgcatggggccacgtgaaagtctctgggtgcacgaaaaaaatgagacctctagaaggcgacgaggctccaacagaaagacctgtagagacacgcgagcacggagcagacgtgagtccaactgggaagacgcctgtcgtggggctctaccacaggggcgcgcagtctccacacggggggacagctcgggagcggcgaaacaaccactggccctgtcgggagtgctacacggggcgatctggcgcctgtggtgtgcacatctccacagagccacatggtgcaaatttccagagacccacaccaaggagtgagcacgtgggacgtcctggggcgcacgtgactgtgcaactattctgtggtccccnnncaaatctaaaccctttccctgtgagagggagggggggcgacccacggagaaccaccggagctgttggtgcgtgcgtgtgcgctcaagaagaggggagccccacagtctactgagacaaattgcgagaactctcagaagacgtnnccttctgaaggcgacgaacagtgtttgcggcttgggagcagttcacaggaccacttgtgctctcccagaatatccaangccccagaattacaccttctagcatttggggggcgcacgctgtggagacaa

SEQ ID NO: 546126 - DNA, 522 bp, Homo sapiens
cggcgtcccctcctctaccccaccccgaccccgggcgagggtggtcggcccctcctacctgcaaacaccgcggagcagtaggcatcgctgatgtcggtgtcgggtgtgtggacgttctcggcatagaggatgaagaccctcagcatgcttggcgcgtgtagggccccgtgcgcccagggcgcaaagagggctcggaaaggtcgggagggccgaggcgccgcttgtgggtcccctcgctggagagggctggctgggcgaggccggctcgaatctctggctcctggcttagagcagttgctcttaaaggggaacgggccacccccggctgctccagtgggctaggctgggtccccgccccggctgcgctcaccccgcttgtcagccggcgttccgagaacaggggcttctgctcatcttccacccccgccgcccttcccgagctccgtcgagctgtaatctaatgctccggctgcggagtctcccaatgacacggcattttgcacctggctgggcggcggccgc

SEQ ID NO: 546127 - DNA, 146 bp, Homo sapiens
ccaggcccacacaggctgcactcaatcatggtagaatcaggtgaggtctcatgggatctgatcacatgttactgtcggaggccctttgcagggcggcccatgattgactgcagcctgtgtgggacgtggatccacctctccttcag

SEQ ID NO: 546128 - DNA, 272 bp, Homo sapiens
  misc_feature (56)..(56): n is a, c, g, or t
tgctgggattatagctaccgcccagccctaatttacattgcaaatggcgatgcttngcctggctcaaaattctgaaggaaccgaggattgtgtggaggagacgccagctgagcgctgtccatgcaccagcaacgggcaggggccaggtagccgccaccacggtgagcgctgtacacgcacagaacctagagctgcttcccacagcaaagggcaggggttgggtagccaccatgatttcccctctacacggaggacacgcctgtgccttgacc

SEQ ID NO: 546129 - DNA, 795 bp, Homo sapiens
gagaattcctgagtgaacgaacagagcagttcctcttccatctccagcaaatgatctcgaacttcaatccccgagaatgtaaactggtccagaagtcaagtaaggtgcaagaactagtgagtcttcttcctgtcgaaattgagacggacaccgtaggtgccacctggtccgtgcgtggttgagaatttgtagaccagcagtagaaggctggacgcttcataggatgtgacgacagagattcgtgtgagagatcaactgggttgtcttttgtggacaacacgtaacgaacatatgtcgaaggttcgttggagtcctgtgctctacgaagaggagatggcgagatttcagtgaccatttcactagattgctggaatggaggatttcctatgcagaatagcaagtgcacaacaccacgggatggactctgaaatagcagttgtgggtcaatagctcagcaaaggcatgacaaggttgtgaggtgaataggctatacgtttcccctgtgcatgagactggaggtgtgcatcagatgtggatcccgagcgcccggctctgctactctcggtgacagcgataggacgtgccagctaatggctggctctccctgtacaagactgtccaagactcaagagagggggtgtccatgacttggatattcacacctgcaacggtggtgtctgtgcagacgcttgggagtactgcctgatggatgcacttgcaattggacgtgaactggggaagggattgttcacggatgcccggctattaagggaagtggtttgaccccggtgcaca

SEQ ID NO: 546130 - DNA, 626 bp, Homo sapiens
  misc_feature (597)..(597): n is a, c, g, or t
  misc_feature (600)..(601): n is a, c, g, or t
  misc_feature (603)..(603): n is a, c, g, or t
  misc_feature (608)..(609): n is a, c, g, or t
  misc_feature (613)..(613): n is a, c, g, or t
  misc_feature (617)..(617): n is a, c, g, or t
cagacgaagtcaggaggtcagcaactttgcgggcttaccaggaggcctgtcctgcctctggaagccagcgacagagagggatgcccccgacccagccagccggagaaagggatggggtggtcacgaaggtctgagctgggtctgggtgtaggctgggaagcaggctggggtgtagactgcgaaggcggccctgccgggacttctttccagtccccggcgacctcttcgaattctctgctatctctggggagcctcgggtgggagggggtgtaagagacgcagggacgtggggagaggagacaaggcaggcaagaaccacaggggacggcggacagacgggcgacatcctgcggaggacgccgtcagtaccaggaagtgcaggcgatgaggaagcgcacgtcgtccagcggcccccacgggctgggctcgggctcgggctggggctggggctggggctggggctggggctggggctggggcggatgccggggctgttccgggccctccggcgccgcaggctggggctggggctggggctgggtttgcgcaggctccggggcgccgcggccgccgcttagctgagcccccatggtctcngcnncnagacnngcgngtcnccccaccgc

SEQ ID NO: 546131 - DNA, 144 bp, Homo sapiens
atgaggtagccactctcctgcctccgcttcatcaggcgatcgaggaacagggaatgcacctcgataagctcgtccaggctggggaaagatgttctgcagctcctccatgggggaagaaacaggcgattcttgcccattgggctg

SEQ ID NO: 546132 - DNA, 294 bp, Homo sapiens
atagtctccaatggaaatcttgtccgaagcatctgcaggtcatcataaacatatacttgtggcgggtaggcatgtaacaagccttgagccataatatacggattaggcaacaacggcgggacccccaggagggaggttgggaggagcttttcctgaagtcgtagcaactgagcttcgagtcgaggctgtgacagtggagttgctgcctaagctgaggcccaggctactggcaatattggagactggagggagacacttgacaaagggctgtgtaccgaggctccgaattctgta

SEQ ID NO: 546133 - DNA, 586 bp, Homo sapiens
  misc_feature (9)..(9): n is a, c, g, or t
  misc_feature (19)..(20): n is a, c, g, or t
  misc_feature (35)..(35): n is a, c, g, or t
  misc_feature (43)..(43): n is a, c, g, or t
  misc_feature (56)..(56): n is a, c, g, or t
  misc_feature (59)..(59): n is a, c, g, or t
  misc_feature (76)..(76): n is a, c, g, or t
  misc_feature (93)..(93): n is a, c, g, or t
  misc_feature (110)..(110): n is a, c, g, or t
  misc_feature (112)..(112): n is a, c, g, or t
  misc_feature (116)..(116): n is a, c, g, or t
  misc_feature (146)..(146): n is a, c, g, or t
  misc_feature (149)..(149): n is a, c, g, or t
  misc_feature (166)..(166): n is a, c, g, or t
  misc_feature (172)..(172): n is a, c, g, or t
  misc_feature (180)..(180): n is a, c, g, or t
  misc_feature (182)..(182): n is a, c, g, or t
  misc_feature (190)..(190): n is a, c, g, or t
  misc_feature (199)..(199): n is a, c, g, or t
  misc_feature (202)..(202): n is a, c, g, or t
  misc_feature (204)..(205): n is a, c, g, or t
  misc_feature (212)..(212): n is a, c, g, or t
  misc_feature (215)..(215): n is a, c, g, or t
  misc_feature (223)..(223): n is a, c, g, or t
  misc_feature (227)..(227): n is a, c, g, or t
  misc_feature (231)..(231): n is a, c, g, or t
  misc_feature (242)..(242): n is a, c, g, or t
  misc_feature (252)..(252): n is a, c, g, or t
  misc_feature (254)..(254): n is a, c, g, or t
  misc_feature (263)..(263): n is a, c, g, or t
  misc_feature (277)..(277): n is a, c, g, or t
  misc_feature (280)..(280): n is a, c, g, or t
  misc_feature (282)..(282): n is a, c, g, or t
  misc_feature (286)..(286): n is a, c, g, or t
  misc_feature (300)..(300): n is a, c, g, or t
  misc_feature (303)..(303): n is a, c, g, or t
  misc_feature (309)..(309): n is a, c, g, or t
  misc_feature (312)..(312): n is a, c, g, or t
  misc_feature (314)..(314): n is a, c, g, or t
  misc_feature (336)..(337): n is a, c, g, or t
  misc_feature (339)..(340): n is a, c, g, or t
  misc_feature (342)..(343): n is a, c, g, or t
  misc_feature (346)..(346): n is a, c, g, or t
  misc_feature (349)..(349): n is a, c, g, or t
  misc_feature (370)..(370): n is a, c, g, or t
  misc_feature (372)..(372): n is a, c, g, or t
  misc_feature (377)..(377): n is a, c, g, or t
  misc_feature (381)..(381): n is a, c, g, or t
  misc_feature (394)..(394): n is a, c, g, or t
  misc_feature (404)..(404): n is a, c, g, or t
  misc_feature (406)..(406): n is a, c, g, or t
  misc_feature (409)..(409): n is a, c, g, or t
  misc_feature (429)..(429): n is a, c, g, or t
  misc_feature (432)..(432): n is a, c, g, or t
  misc_feature (448)..(448): n is a, c, g, or t
  misc_feature (460)..(460): n is a, c, g, or t
  misc_feature (469)..(469): n is a, c, g, or t
  misc_feature (475)..(475): n is a, c, g, or t
  misc_feature (564)..(564): n is a, c, g, or t
tgaggccanacatgtttannaggccggccccgacncccccccncggggaaggaccnccnaaaccaaaccccggggnccaaggggggcaggganaaaccggggcaaggcancngccncccccacccccccccccaaaaaaccccaancanaccgggccccaagggcncagggnccgggcancncagggcanccgaggccnccncnncccccancancaaatccncaantccncccccggccanaaaaccccanangaaaaaccncaaaaaatggcagnccncntccnccccccccaccccnaancccccnaangngccccccccccacaccccaacnncnncnncangcnaaacttaaaaaacccggccancncccanaccnttttaaaccccanagggctaaananaanaaaacgtccaaaaaaaaacntcnggaaaatccccaaaangttggggtccancggggcacngggggnaaaactgggggcgtacggccctgctgccgaaaaccgctgtacacggaaaaaatcctcttgctggagtcgctgctctgggccttgcgaanaccctcttcgtacaggagcccc

SEQ ID NO: 546134 - DNA, 128 bp, Homo sapiens
gtacgagcatagggtgattcaggagattaactttcaataacgctttaccaaccacctgcgcacgcttgtggcgcgcgaggaggtggctatacgactgatgcatctgtgggaatttgttagcgcgctgg

SEQ ID NO: 546135 - DNA, 592 bp, Homo sapiens
  misc_feature (563)..(563): n is a, c, g, or t
  misc_feature (566)..(567): n is a, c, g, or t
  misc_feature (569)..(569): n is a, c, g, or t
  misc_feature (574)..(575): n is a, c, g, or t
  misc_feature (579)..(579): n is a, c, g, or t
  misc_feature (583)..(583): n is a, c, g, or t
cagacgaagtcaggaggtcagcaactttgcgggcttaccaggaggcctgtcctgcctctggaagccagcgacagagagggatgcccccgacccagccagccggagaaagggatggggtggtcacgaaggtctgagctgggtctgggtgtaggctgggaagcaggctggggtgtagactgcgaaggcggccctgccgggacttctttccagtccccggcgacctcttcgaattctctgctatctctggggagcctcgggtgggagggggtgtaagagacgcagggacgtggggagaggagacaaggcaggcaagaaccacaggggacggcggacagacgggcgacatcctgcggaggacgccgtcagtaccaggaagtgcaggcgatgaggaagcgcacgtcgtccagcggcccccacgctgtcccggctgctgctggctggctggcggatgccggggctgttccgggccctccggcgccgcaggctggggctggggctggggctgggtttgcgcaggctccggggcgccgcggccgccgcttagctgagcccccatggtctcngcnncnagacnngcgngtcnccccaccgc

SEQ ID NO: 546136 - DNA, 198 bp, Homo sapiens
ctctagaggatcttcgggagccttaccctacacacaatctgatatactacttagtcactttctttttttttttggaagagggggtccttgcccttgtcattcatgattgggagctgcaggggttccatcacgggttcattggcagccttcaaccttccacagtggttaatgggctcccgggacgggtaaacggggctc

SEQ ID NO: 546137 - DNA, 534 bp, Homo sapiens
  misc_feature (100)..(100): n is a, c, g, or t
  misc_feature (131)..(131): n is a, c, g, or t
  misc_feature (160)..(160): n is a, c, g, or t
  misc_feature (170)..(170): n is a, c, g, or t
  misc_feature (172)..(172): n is a, c, g, or t
  misc_feature (175)..(175): n is a, c, g, or t
  misc_feature (181)..(181): n is a, c, g, or t
  misc_feature (184)..(184): n is a, c, g, or t
  misc_feature (186)..(186): n is a, c, g, or t
  misc_feature (190)..(190): n is a, c, g, or t
  misc_feature (195)..(195): n is a, c, g, or t
  misc_feature (203)..(203): n is a, c, g, or t
  misc_feature (217)..(217): n is a, c, g, or t
  misc_feature (227)..(227): n is a, c, g, or t
  misc_feature (263)..(263): n is a, c, g, or t
  misc_feature (309)..(309): n is a, c, g, or t
  misc_feature (312)..(312): n is a, c, g, or t
  misc_feature (413)..(413): n is a, c, g, or t
  misc_feature (417)..(417): n is a, c, g, or t
  misc_feature (427)..(427): n is a, c, g, or t
  misc_feature (440)..(440): n is a, c, g, or t
  misc_feature (512)..(512): n is a, c, g, or t
tactttccacaggggaagcttttgaccttttcacctttaaactttgtttgaacttggaaagaagacttttgaattgtttaacaaaaaaaaaaaaaggganaaaaaggaaaaaaaaagacaggggaaaaaantggttaggggggctgcaaaaaaaatgtgncgactggggnanccngccggnttntntgtnagctnaacagtantactaggaaaatantcctcctctngtctaggagtttctgctacggggagccacagggtantcagctcacatgacatacccagaggcgaatgctagcctgtgctgtnttngaacatactcaaacaaaggctgattatccaaacaagaattgggactgcagcagtcggaccagttaaattatagttagtaaaactgggtgccttgtgagctnggantgttacaatngcagctggatctncgttggtcaggcagccttactgcacaataaaaccagagatttttatctccgcaggactcagtttaactcctngggtgcaaacagaaaagtgcca

SEQ ID NO: 546138 - DNA, 198 bp, Homo sapiens
tgggagagaactgatcccacaggttgttaagtatgcacactgtacactgttaagaagttgagcttttatcttagaggcagcagaaggtatggagccacaggaatgaaatgatgatggcgtacttcaggtaaatgaattccagctgcagtgtgaacacaggggcaggaagactggcagctgtcaaaactggaacagtcc

SEQ ID NO: 546139 - DNA, 335 bp, Homo sapiens
tggcccccccccccccgtaagggggggttgcgggggggggggggaatttccccccccttttggccccactctcctgcctggccattccccccccccgaaaaagggggccggggtttttttgggggggggggggccttttttccccttgaagccgatttttcccccccttttttttttttgggaaagggggggaaagggcggggggggcccccccctttcccccccccctcccttgggggggggggggggccccaaatttttttcattcccccccccctgggggcttttttggggggaaggggaccccccggggaaattatttttttttaccccca

SEQ ID NO: 546140 - DNA, 1029 bp, Homo sapiens
gtattgtatcttctgcatttcagtttactgtaagaacatacatttgaaattatgaacatattttcataaaaattaaatgctttaagaaatggagaaggaaaaatagctttatcaatttttttctcctcaagattctgtaataaacctcaaagtctggtgtagaatggtattttcccgtttgaggtcttggtagttttattattatttttttaaacatggtgccatttttagaattaactaaatgttacaaaattctcagcattggttttggtctggtagtataatggagtcttttcatacacttcttaaaatgtgaaaatctatgtttcagtattatgacagtatctgcagatacgtataataatatgcttgggccaaattagctgttgactagagtgaaccacgatgtcagtatggtatgtggggatatgtctacataaatagaactcatttaacaagtatggtctcaagtactgctcttctaaaatggggaaatggattttcaaggagccgatccttatcctatataaaacgctatggacggctatagcttaatccactacagtgacggtgaacagggcaagtacactcaatcaaagattctaactcttgaaatctgagcaccaagtatcaatatccaagaactaagatctatagaatacactccaatgcaagggtgccgtgacaacaagatcgcagggaacaaaagtgatcagcgaaaaattttcagaccaaatgaccaaagaggtaaacagctaaacgcaggcaacagagatggcacaaaacctcagggccaaagcgagacttcagagaacctaaaagaacagacaaacacgagtgcaaaaaactgcgaagtagccacaaagagagaaaaaaacaccaagagaaatcaccggcgtgacacgggggcaacggaaacaatgatcgcgaacgagggcgtcagaacccgtcagaagcgcggaggggtgaggcaactgacgagcagcgcccacgaaaggggacaccatgaaccgaaagagaggacgacca

SEQ ID NO: 546141 - DNA, 974 bp, Homo sapiens
  misc_feature (523)..(523): n is a, c, g, or t
ccacgcgtcgagcggaggcaggttgctgtgttgtgcttccttctacagccaatatgaaaaggcctaagttaaagaaagcaagtaaagctgcatgacctgccataagcggtataaaatccaaaaaaaggttcgagaacatcatcgaaaattaagaaaaggaggctaaaaagcggggtcacatagaagcctaggaaatgacccaggagttccaaacagtgctccctgttaaggaggctctgtcttagggaagctgagctaaggaaacagaggcttgtaaagcaactataaaaacagacagcagaaacttgacaggcagaaggaagctagaaaaagaacaactgaacatacttgaaactaatcctgatattaagccatcaagatgtggaacctactggcaaacaggaggttggggcttggcaaaactgagaacaagagccagatgtcggggctacaaagcagaattcaaagaagctgtactgccaagaacttagaaaggtgattgaagcctccgatgttgtcctangagcgtgttggatgccagagatcctctgggttgcagatgtcctcagggtagaagagggcattgtccacagtggacagaaacagctggtacttatattaaataaatcagatctggtaccaaaggagaattcgggagagctggctcaaattattgtgaagaaagactgcgaacagggtgtgcagaaggctcaacaataacaaaggatgaacgggacgataaccaagcggggtgagggcaccagaagaatgctgctccatccagacgtgacgccggttgcgaaacaggggcgggagaactcgggaaggtcaggaactgcggacgcctcggtggacactcgggcccagggggaaccgatcaacggcgctaaacagacaaaggcacggggctccacgggcaaggaccacttcctggaacgcacaaaaacgggcagcacaaccccggggccaaaaga

SEQ ID NO: 546142 - DNA, 161 bp, Homo sapiens
ctgtggcaagacaagtacccaactatagaagagaggctaactagcgaacaataatagatgattcagccatggtatgagtagatctttaataaaagattggtatagattttattaactgagcgtgagtccggccctttcaagcatggaaggagccgggcgat

SEQ ID NO: 546143 - DNA, 269 bp, Homo sapiens
tacttctggcatactggaacctctctggacattaatgcccatactactaatagccatataacacatattagtggctagggcacagcatcaacctgtaatcctagacacttagggaggccaaggcaggaggactgcttaaactcaggacgttcaaggccagcctcagcaccatagcgaaaactcatctctacagaaaacttcaaactcaccaattagaccaggcgtggtgatgggcgcctgcagtcccagactactcgggaggcagagga

SEQ ID NO: 546144 - DNA, 1850 bp, Homo sapiens
  misc_feature (770)..(770): n is a, c, g, or t
  misc_feature (811)..(811): n is a, c, g, or t
tcataaacagaggctaacaaatcctgcctcaggttaattggtccaaatagcacaggaggaccccagccccatgcaaattggttaccccaggggcgggggtgtggggggttcgcaccagttccttcgtgtcctcatgtgttgggcagaaaaatatctatactcgtaaagcctttggataggggccgtgggatacgtttgtgggagccgtgagcgtggaacgtgaacgctgtgggagcgtgaacgcctgtggcgccagtgtgggttagagactcctgtgtgagcctgtgtgagccctatgtgcgcctcttgtgcgccgaggcaaaaagcctgtgacgcccctgtgtggcaaatatacgggcgccacaaagcacgcgctttcccaaagccgtgtgggaggtgtggtgcgccaaatgtgttgaggtgcacaaggctcagacactcggacacgcctttgtgacgtgaggtgtgtaacacaccccttttgtgggggaaatctgtgatgaggggactttataacacactcttcctgtgtggggggctatttaaccacgaagaggggggcgctttgtgagagatacgccctttctagaggaaaacagcagtagtgtaagaccctcatcataaggtgggcaccctgttgtgtgtggcaaaaagttgagtggtggggcacaggtggcaaatatccttctcttctattatataagggggcccccatataatatagttaggagatgatgaagtacgactatcactctttgggtgaggcaaanaaagaggtggtcgcaaatgttgttatttcactctaccaagngagaaaatctttgttgaggagtgagatgttacacgaaccaccgcccactcctttttcaagacgagaagaaaacttctgcgagaagaccacttccatcgagaagaggagaaaaaatcgcgcgggagggagaattctctcatatgttgaaaagataaacccacaaagtttacttccgttggaggtcgcaccccaatatttatagtgcaggagaaggagaaacacgtcgggcgactgtcaggtcggatcgacatcagaggagtgggcgatggaggatcaacccattggtggggcacatgtttgtgtgtgccccaatagtgattttctgtagtgacacacaaaaataaaagagcgcatgaggggaactcacccagtaaaaagatgcgacgcccgcgacgtagtttttggtgagaaaaagaacatattattggagggtgcccatacaaaaaaagaagaaaatttacaccatctccgggaagcgggagggcgagagatgaaagtgttagcattcggtgtgatataataaccagcccgagaaataaacatttcccctaaaagtgtgttcactagtaatgaaatccgagcggtgtgaaaaacacccaacacacttacccagcatgtgaccacgtgacaacacgaaaccgggtggtgccaagaaaaaaacacgcatacaacaaggggcacccacaaagaaaagggaggcagcgggtaatccagccctaacacgcatataaaacgggaggcaacaacatatcatcgatcacacgagggcaaacaagaatatcacagagaaaagacacataagaaatggacagatatacatcaacagaagaaacgagtgctagaaaacacaagacgacgcaaagtttgagcgagcccaagacataccacgcgggaaagaagcaaacgagcaagaagcaaagaatggcacagaagaacacgaaccaccacaacaacatcgcaacgaggaacgaaaaaaacagtaagaagaaggaaacggaagaaacacacacagaaaacaaacgaagaagactaacacaaa

SEQ ID NO: 546145 - DNA, 156 bp, Homo sapiens
aggctcccttgcctgactgtgacttgtgcctctttcctgcccccgtggggacatggcagcccaaaaccaaggctgggtgggcaggtgacccaaggaacctttttgggaaccccttctccccgggctgggaacaataaatgcagccatgtttttgca

SEQ ID NO: 546146 - DNA, 191 bp, Homo sapiens
aaaagggaaaaaaaaaacccccgggttttcccccgggcgggggcccccccccccccctggaccccccttgcccccccccccccttttaatttttttgggggtttttttcccccctattttttttttctttttttaattttccctttgggttcccaaaaaaattccaaaaaatttttggggtttggggccca

SEQ ID NO: 546147 - DNA, 384 bp, Homo sapiens
ctgtaggagtttggaccagggcgctctctaagttctctcacgagagagccatgttcagagcgcgcgcgaagatcgtgaagcccagtggggagaagccggacgagttcgagtccggcgatcttccaagctcttctggagctggagatgaactctgacctccagggtcaactcaaggagctgaatattaccgcagcttatggaattgaagttggtggtggccggaaagctatcataatctttggatccgttccttaactgagatcttttcacgaaaatcccagtgcgggttgtacgccaattggagaaaaagttcagagggaagcatgtctggctttatcggttacaggagaattctgcctaagaccttgagccgtaccagattgc

SEQ ID NO: 546148 - DNA, 290 bp, Homo sapiens
tgaaggggaaccccggggggcccccaggccgccctgggggtgaaaaaaacagccccgaggggcaacaaggtcctttgtcagtcccagccccccctgagatccggcaacatcaacccgagtcatttgttttgtggggggacaagtggattcagggcagggccagggtgcccccagcccagccaacaggcccctgccttagggttgggacgaaaccgggggggggggttttgtaattgggggtgatgggaagcccattcagacaggcaaaaaaaagggccctttttccctga

SEQ ID NO: 546149 - DNA, 481 bp, Homo sapiens
  misc_feature (150)..(150): n is a, c, g, or t
aatcagctcggtccatgtttgaggcagggcagttcttaaaataagacaacaagagttgttgcatcagttaatgctgttttcaagaaagatttctctgtagcatgcaatgctgtttgatagcattttacccaaagcagaatttatttcaanaattggaaccagtcctcttaaaccctgctgctgctcaagtaagtttatgtaaactcaagtaagtttttgtaattttctaaattgttggtgtcatttcaacagtattcatagcatcttcaccaggactagattccatctcaaaaaaaccactttttttgcttatccataagaagcatctctttatccattagtttgatcatgaaattacagcagttgtcacatcttcaggctctacttctaattctagttctcttgctgtttctaccacatctaaggttacttcttcctccaaagtctcgaacccctcaaagttttccacgagggttggaat

SEQ ID NO: 546150 - DNA, 367 bp, Homo sapiens
gtgcatgcaactagtgttttcacttcatctggcagtctcattcccactttttcccattctttgtcacttttttaacagccactccacatttcagcacatgcagggcttatcatatctcttgtactttttagcatagatttactttcacatacataaaaatttctcacaaaggccaatagcttcacctcgttctttgtaaatacaccaccatcattcccatttgcttcaagcctcatgcagtacacttaatcatttctcttcccacccccacatgtttcaatctcatccactgatcctttaggccctcacctctaaactcaaacccaaatctgtcccttttctgtttccactgctggctgatgcaatt

SEQ ID NO: 546151 - DNA, 199 bp, Homo sapiens
tgtctccgacatagttgtcgcaagaatccatttaggtaaaacataagaggggctggtcacaggggctcatgcctataatcccagcacttgggcaggccgagccgggtgaatcatggggtcaggagatcaagaccgtcctggctaacatggtgaaaccctgtctcgactaaaaaatacaaaaaattagccgggcgtggtg

SEQ ID NO: 546152 - DNA, 422 bp, Homo sapiens
gatagttatccaatcgagaacgagatcatatgtggggagagtttacacgagtcatgccgttataattgcaagacatgatccactgagtgaagcctgcgcccattgagccggcgccatcccagcagcagcagaagccagctgagggcagtctacagaagcgcagccgcacgagacgtcaccctagaaaaggggctgcagaacatggaggtcaccgatgcttgaacattcctgcctccctatttgccaggctttcatttctgtctgctgagatctcagagcctgcccaacagcagggaagccaagcacccattcatccccctgcccacatctgactgcgtagctcagaggggaacagtgccatgtaccacacagatgttcctgtctcctcgcctgggcatagggacccatcattgatgactgat

SEQ ID NO: 546153 - DNA, 178 bp, Homo sapiens
tatgagtgcggtggtgcaaactcggttgctgagcctccgcctcccaggttcagcaatactcctgcctcagcttctcaggcgcgcaccatgcccggctaatttttgtattctcagtagagacggggtttcaccatgttagccaggctggtctggaattcctgacctcaggtgatccacc

SEQ ID NO: 546154 - DNA, 578 bp, Homo sapiens
  misc_feature (162)..(162): n is a, c, g, or t
  misc_feature (331)..(331): n is a, c, g, or t
ccaacggaagcttcaaaagcctgtggtgtaggaggcctggcgggaccaccctccttcatctttgctaataaccaggacctgcctggagcactgtcctctaacgccatcccagaggtcttggagttggactccatccgcagccaccactggtgcatccagggntcaagcgccgtccccggggagaaccttctgccgggcattgactggctcctggatgacatttccacccgcatttttacagctgaatgaaccactccaaatgccccccccctaacagttcaggttcctcaaccttttcccaaccctacccatggggggttgggagtaagcnggcaaaaataacactccccctcctcccccccagcctggtggtggtaatgttgcccgctgttgctttgtggccccccggctcccatggcgggagggctgtgccctggctgtctttttggctcctgacctggcctttggctaccataccaaaaaaaaagggctgggcggggaggagctgctacttctgctacccaggctgtgggcctcatccttcactcagttgtgaaataaaccgctccttgccccca

SEQ ID NO: 546155 - DNA, 185 bp, Homo sapiens
ccgttgtaaaagaatctttttcagtaactaaagggtagagtatatattttattgaaattttacaatgtaaaaccggggactttttaattagtaactttttcaaattcagttctaaaaaatgataaaagaagggaatttttaaaacatgttattcgacaggacatttaatttttaaaagatggtaa

SEQ ID NO: 546156 - DNA, 951 bp, Homo sapiens
tgcagcgccaatgcccgagaagctcgaggcttgcttcatggcggaagattaattggagcctcgtacgtccatgaacggaacgtgctcctctctacccaacacgtagtggagcgacttctcgagtctccactttccttgtgtgtacacgactgatgtgctctttcgtgtaccatcatctgtgtatcacatatgagaactgcgcaaggcgtggaggatccacacgtatagagctgccgacctggcagcccctcataagaaccgaggctcccggagtcgaagccaggctccagctccagcctctcccttcgggaaaggtggacagtgttcaagggtctgctgtggtacagttgttcccttggtcgtacgtttactttgccgagtatttcattaaccaggggactttttgaactcctctttttctggaacacttccctgacgtcacgctcacgcaataccgctggtagccagatgctgtaccaggctggcgtctttgcctcccgctcttctctccgctgctgtcgcatccgtttcacctgggccctggtcctgctgcaagtgccttcaacctggtgttcctgctggcatgacgtgtggttcggctttctgcctagcatcttacctcgtcttcctgatcattctgtactgaggggctcctgggaggcgcttgcctatctgctgattcctcttccacaacttctgtccctggatgaccatgtgatgagcaccgggagtttgctctgtgcgtgccacctgcatctctgatctctctggggatctccctgtctgtgctcctggctttgcctctgctatgagttcctcttggccagctctccgtgatcgtcgcggatcctcatgacgcaggtcgacattcacctgtgggcagagcggacgggtcgagatacccagggcccactcctagagaccctccttgacttgtgctcccggccttcc

SEQ ID NO: 546157 - DNA, 145 bp, Homo sapiens
  misc_feature (20)..(20): n is a, c, g, or t
gacctggattatctacaggnggagcagactttaaatgggaacaagaaaggttatggggccaaaatgatggaatcattaaacctgaagtgacttggacctgggggggtccttaatagggatctatatatctaggacaaaaaataga

SEQ ID NO: 546158 - DNA, 239 bp, Homo sapiens
  misc_feature (33)..(33): n is a, c, g, or t
  misc_feature (43)..(43): n is a, c, g, or t
  misc_feature (48)..(48): n is a, c, g, or t
  misc_feature (70)..(70): n is a, c, g, or t
  misc_feature (72)..(72): n is a, c, g, or t
  misc_feature (76)..(76): n is a, c, g, or t
  misc_feature (96)..(96): n is a, c, g, or t
  misc_feature (100)..(100): n is a, c, g, or t
  misc_feature (116)..(117): n is a, c, g, or t
  misc_feature (120)..(120): n is a, c, g, or t
  misc_feature (130)..(130): n is a, c, g, or t
  misc_feature (142)..(142): n is a, c, g, or t
  misc_feature (151)..(151): n is a, c, g, or t
  misc_feature (194)..(194): n is a, c, g, or t
  misc_feature (208)..(209): n is a, c, g, or t
  misc_feature (222)..(222): n is a, c, g, or t
  misc_feature (228)..(228): n is a, c, g, or t
atgtatttaagtatttattagtaaatgcaaggngatgttagtnatgancagttatactctaaatattcantntgtnttataaaggtagtgaaaaantganaatttgctatttattnnaanacattaaatntcattccaaatnagataagtnatattactataacatctaagcatcatctgatttgatattcccnaaaacacatttggnntatatgctcatcnatagantcagtatctac

SEQ ID NO: 546159 - DNA, 351 bp, Homo sapiens
gggcgaagacggtggcatcttactctctttggtagttctctctggtgagccccagcccagattggcaatccaggacccaagggatactttcctaggcagctccgtgcctatagtttggggaaagtaaagtcgatgtttggtatgtcagctcacagttataattcgatgcagtctcagatctggtttttttttttaaatctcggccagcctcattccccctcttcttaaatatgtgcatgtatatttaaacatggtatgtatgcttatgtatctagatatgtatcgagatgccttatgcttttttttaaacagggattccttaaattccaaaccccacagtcttcgccggag

SEQ ID NO: 546160 - DNA, 975 bp, Homo sapiens
tgttttctggctcttctcagctttattcaataaatttgcattttaagggtgtatgagaaattttaactaaaaatgtgcatcatgatggaaggtgcagacttgtttggaagtttccagatgaggagggtctataagacccatgtgtctagaaatcgaggatcaagccctcgaaacgaatggggtcatgtgggcttgagtccaagaattaggaataaagcgtttttgtagaacatatcccactgaaacctaatacactgtgtttgcaacacaataattgcaaagttaccaactttggccagattgttggtggtgagttgcggccctcaaggaaaaaagatttataataccaaattgttgtggaccgtccggggcccgagacgggtatatccctgagggcacagctgtgtagcacgaacgagacaagccggtcgcgaggtgggggaccgagatctgccggaaattataaaaagcgcgagggcgggaaatccacgagggcggttctgaacaatgctcatatgtgggagccgggagagggatcaaagtggagattcccaaactaggaggccgaacagaggatcaaaagatagatgcgccaggggggtcgaccccagagaggaaagaaaccagggcaagaaagtagacaacgaccgaaaaacatgagattagaagctgctataggggataatgaaatctagaaagagatgcagccaaggttatagtagcggaggtaatcagacggtgaagggcgatcttccagtcagtgtattaagaagtatgaaggattatgaaagatatggtgaacctgggttcaaggttacatttgataaggtcagagtggatattttgggacctcggggggagtttaataattaaaaccttttaaatagagtttacgtgaattcctgaatcacagtagggaaatgcgaataacaggggggattaagaaaaaaagagcctaggaataacggataacgg

SEQ ID NO: 546161 - DNA, 240 bp, Homo sapiens
ctaaggcaggaggatgacttgaggccaggatatcaaaggacatcaaagctgctgcagtgagccataatcttatcacagcactccagaagaaaggaagtggaatcatacagaatttgtctttttatgactggcttatttcactctatgtaatgtcctcaagacttattcatgttgtagcatgtgtctgaatttccttttttttttttttttggagacagggtctaattttgccacccaggc

SEQ ID NO: 546162 - DNA, 399 bp, Homo sapiens
gcggactttttgggtcgtaggaacctggtattagggcccgtccaggtgtagatggggaagtggagttaatacgttagcggtttggagtcgggcccgctgttccacgcgattttgtggagatttcctgagaaactctgctctgattaagagtcgaagtcgactggtgagcacgggtcttggaataaatgcgaggctcggagggctcccatttcggttaagacttgtaaggttgtttgggaatcgtcgatgtccgacgagaaggatttatggtgctcgcctgaaggtaatgtttcgtcgtggtggtcggcttgtaccggggcgtcggacgagggtaagacgaagtcggaccatacttcgggttcggacagaggaccctccagagagatgttcgtagatttg

SEQ ID NO: 546163 - DNA, 177 bp, Homo sapiens
tgctgcgtttttttctgttgaacaagaccccttccttcccagaacatcgaggtgacgggaagtgcccagcagattaagtctgctgttccactaaacaatggactgagagaggcaacccttagccatccacagaaaagctacatgagcaaaagcaagagacaggaagattgctcttca

SEQ ID NO: 546164 - DNA, 182 bp, Homo sapiens
ggtgccgcacactgatatggaaggattggtgaagagatgtcagaatttcttgggtctgctcttaggggaggacgagcttttgatttgtgactatccagtccccgttgaaaggaggctccttggctgtatagcaaagctttctcggatgggagagttcttggagtaggattgctcgggataac

SEQ ID NO: 546165 - DNA, 1401 bp, Homo sapiens
  misc_feature (231)..(231): n is a, c, g, or t
  misc_feature (364)..(364): n is a, c, g, or t
  misc_feature (425)..(425): n is a, c, g, or t
gggagggcgagcattagctctcgggtacagactcgcatcaaggatggagagcgggcagagcacagacgtccaagctggtggcatggctcccgtgatcgcccgagcagcaggaggcccgttcagaaggccaggaagtacgccatggagcagagcatcggagagtgtgctggttgaagcaggaccagtcgcgcagcatggagtcatgcagacatcaccaagcatgcagatggncggacgtcagtcgggcatgcgggcggcctgggccagtcagtggtggccgtcggtcgtaacgctggtgactgcatagtctagctacttgatactgggtggagggaacatccagtgccgtcgcagggcctgttgncctcccttgttggctccgcattcaatgagcgatcggacattgtcacttgggagcgtccggntcgacacattgataggcaacagatgggacttatgccattactgtcggaggatatgatggtcgcccagacaggctggcatcacgtctggtgggctttgcgaggacacgcactagagagctcggggtcgactcgcgtcggggctgcgccagggaaagccaattcatgaggttggggggcaggaatacccatgacaaaactattacggggcgatgggtccccaagccccaattccattaggtacgcgagggttgggaacgtgtgaagggacaggtctgactcgaggtcccttatcctgaaagccggacatccatagcggttgggatccatcctgcatgtcgaacccaagtgggatacccgtctgtccatggcaaccgtaatgggacaacttcaaaggaagacggatggtttgggacgggtcgcccttttgtggcgcaaacaggaattccacacggtctcgttggacaaacaacttagtggccccggggggaacaccccgcacaagatttggggggggaaaaggcaaccaaaagggggcctaaccggggtggttccactatggagagctaaccgcacagacaaggggccccacaggttccggtcccgcacaggaattgccttggggggatactgtgacaccaaaatggagagaccccgtccatttttgagaccccttggggagttggggcgcccaaggggacccatatgcgacaggggggtgggggaaaagcgacgggggcaaaccacaccaggggccccaatgaaggccccataatgatatggaagcccagggccacaagggccctttgggaagggggcctcccccaacacgtggcaccgaacgcactggatgggacacccgctcttggtcaagccacaacggctgccagagaacaacacaggcccagcgacagacactgggcggcggaacaacaccggggcgtgggtgtaatccccggggcgcacaccagggaaacga

SEQ ID NO: 546166 - DNA, 179 bp, Homo sapiens
  misc_feature (179)..(179): n is a, c, g, or t
gtagtaatgatacacaggtaaactagcataacctacaaagcatatatctatagtaggtctagcatctatcttttccgataaggtcctagcgtacatacctacacgtacgcaactaggtccggcgtgtgggtaccagagctcgcaatatcgtaaatacatggtacatacgctagtactcn

SEQ ID NO: 546167 - DNA, 373 bp, Homo sapiens
tcaaccgagacgatttgatgctcacgtcccctcctgagtgagggtcactataagctcttcaggcaggcggatgtgggttgcagcgtccagcctgtgctctaggtgcagcccaccacgttaactcactgagtggtagccgccagtgtgccatcgcgcaggggacaggccacaccccgatgctcagacagcttattcctcatgtaattggtcatcatgtgactatgtgttttgtgtctgtgcaaatttctattaacataatgttctccaggttcctccatgttattgcaaatgataggatttctttccttgtaaaaaataacatgccacattttcttaccaatccgtccaccaatagacacttaggtcgttttca

SEQ ID NO: 546168 - DNA, 751 bp, Homo sapiens
  misc_feature (590)..(590): n is a, c, g, or t
  misc_feature (594)..(594): n is a, c, g, or t
  misc_feature (597)..(597): n is a, c, g, or t
  misc_feature (613)..(613): n is a, c, g, or t
  misc_feature (620)..(621): n is a, c, g, or t
  misc_feature (626)..(626): n is a, c, g, or t
  misc_feature (628)..(629): n is a, c, g, or t
  misc_feature (640)..(640): n is a, c, g, or t
  misc_feature (672)..(672): n is a, c, g, or t
  misc_feature (681)..(681): n is a, c, g, or t
  misc_feature (687)..(688): n is a, c, g, or t
  misc_feature (694)..(694): n is a, c, g, or t
  misc_feature (710)..(710): n is a, c, g, or t
  misc_feature (719)..(719): n is a, c, g, or t
  misc_feature (721)..(721): n is a, c, g, or t
  misc_feature (724)..(724): n is a, c, g, or t
  misc_feature (733)..(733): n is a, c, g, or t
ggtcctctggtggctcgtcgtcgtgtgttgcccctcctgtctctcaccgtgttctctctttctttccctgtttgtgctccctgtctgtgcctccattcacccgttcgggatgttggctcttctcgggcgtgtatggcctcgtgtcacccctctgtgcctctggtgcgtcccaggacagtcatgcccccgagtctgttagctagagagttcgagtgtggacttcatctggagctgctcttcctcgaccactggaaggaccggtacctgccggacacgcttctcttcggaggatatgtggcctcctgcggaaggggacagtgctactggctgactacgtgatctgtcccaggtgcgccatgacttcctagcacacgtgcttctgggagcagctgcttttgagtgcatcacactaccaatcgttcctggaatacagtggtaggtggtggtacggcctggagaacggccatctagcaaggcgcccaggcagcgcagcagggacccgtgactgccccccccggcccccctctcgggctctctcacccagcctggtactgaaggtgccagacgtgctcctgctgaccttctgcggntccnggnctgtgtcctaaatgcnaagcacnnctcgncnngaggcctgcgncctgacatgctaacctctctgaactgcaacanctggattgntctttnntaagantcaatcatgacttctntactaacantngcntagctatantttatcttatataatact

SEQ ID NO: 546169 - DNA, 811 bp, Homo sapiens
  misc_feature (595)..(595): n is a, c, g, or t
ccactagtaccatcaacctctactttggctccaaggtcctgtctcgggtcagtggcatcctgtttaatgatgagatggatgacttcagctcgcccaacttcatcaaccagttcagggtagccccctcaccagccaacttcatcaagccaggtaagcagcctctttcatccatgtgtccctcaatcatcctggataaggacggccaggttcgcatggtggtcggagcctcagggggtacccagatcaccacatctgttgcactggccatcatcaacagcctgtggttcggatacgatgtgaagagagctgtggaggagccccggctgcacaaccagcttttacctaataccacaacggtagagaaagacattgatcaggtggtgactgcaggcctgaagattcggcaccaccatacagaagtcacgcccaccttcatcgctgtagttcaggctgtcgttcgagcatcaggtggttgggcagctgcctcagactccagaaaaggcggggaacctgctggctactgagtgcccggaagaggcaagattgacccgcagccaagggacgagaatgggaacaggagcaagagtgggacgtnggagaacatgccgcctctgggtgggacagagggagcgcaataaatggaggccaccgccaagctgcgggaagcctttgcgggctgaaaaaaaacggacacctccgacccgcccacaaccacacacaacatcaaccaaaacacaggggggcgcccaaaacaccccgccggggcccaatcaaccgcccactttttcacagggccctaggggttaaaaca

SEQ ID NO: 546170 - DNA, 137 bp, Homo sapiens
tgccgtcgctagcccccgcaccaataggatcctcccgaatcaatgcctgactcgcctctccttcataaagttattcaagcttcctacactattaatatgtttaccacaaacaccaccccatcatactgttccggggt

SEQ ID NO: 546171 - DNA, 450 bp, Homo sapiens
aagacctcacggggactgcgtgctccaaggcccagatacacctccccaagactgatatcatggatgagaccctcaagcttccactgacttacagcagcactgccacaacatggcgaccacccggagcttccaggctctaggtgtagtagagcaggaccagtgagccataagaacatgcgcatgatttgcacaggataagaaatgatggatatgtaatgctccagcaagtgccaagagctgaatatggatgccatctaagctagccgcagaccacaagccattcttaactacattgccagcaaatgcagcctctatgccaatgacatagtctgagaacatgccctctttgatatgccatatagaaggtatagccaacattggatgaaaggagcctaattttgccctaatgaccacctgaggaatgagccgcctagcttgccttgtgcaaag

SEQ ID NO: 546172 - DNA, 488 bp, Homo sapiens
  misc_feature (28)..(28): n is a, c, g, or t
  misc_feature (30)..(30): n is a, c, g, or t
  misc_feature (33)..(33): n is a, c, g, or t
  misc_feature (35)..(35): n is a, c, g, or t
  misc_feature (40)..(40): n is a, c, g, or t
  misc_feature (66)..(66): n is a, c, g, or t
  misc_feature (111)..(111): n is a, c, g, or t
  misc_feature (166)..(166): n is a, c, g, or t
  misc_feature (175)..(175): n is a, c, g, or t
  misc_feature (213)..(213): n is a, c, g, or t
  misc_feature (217)..(218): n is a, c, g, or t
  misc_feature (258)..(258): n is a, c, g, or t
ccactcctgatccttacctttgtggcangnctncntgtcnccttatatataaaatgtgggggtaantgtgaggagatctgcccctacaggtgtcctgaattctggctacanttctgtgtggctccctcatcaacgaacagtgggtggtatcagcaggccactctanaagtcccgnatccaggtgagactgggagagcacaacatcgaagtccntggnnggggaatgagcagttcatcaatgcagccaagatcatccgncaccccaatacgacaggaagactctgaacaatgacatcatgttaatcaagctctcctcacgtgcagtaatcaagcgcccgcgtgtccaccatctctctgcgccaccgccctccagccactggcacgaagtgcctcatctctggcctggggcaacactgcgagctctgaggccgattagccagacgagctgagtgcctggacgctcctgtgctgagccaggctaagtgtga

SEQ ID NO: 546173 - DNA, 183 bp, Homo sapiens
cccgtggtcttgtctggtgacgtacaaggcgcagcttgagctggtggcctcccgggccaagaagcccaaggtccagtcgggatcagagagtgtcatccaggagtacgtggacctgcgtacgcactacagcgagctgaccacactgacgagccagcacaatgaaccacacgagcacaagaacct

SEQ ID NO: 546174 - DNA, 208 bp, Homo sapiens
gcttagggtatgtgattatttcttgaaagtcaccagtgacgtgaattgaaggggtcgtgggtcaaaaatctggcacatttctttctatgtgtgtgcgtgtggtgtgtgtacctgttttttctataacaaaccaagtagtctcctgaatgccttgtgtcagtttctttaggaggcaagtcagcctttgattacttacctcgttaagctt

SEQ ID NO: 546175 - DNA, 363 bp, Homo sapiens
gggattacagacgtgagccaccacgcctagccaaatactgtattttctatctgcttttagtaaaaagacatctgcatataagaggacccatgcagttcaaacccatgtcgtttaagggtcaactgtataatcaatatgccaagaaaagggagaaaatgaaatcatataatgtgctcagttaaaaccacaaaaggcagaaaaagtgtaaaagacggaaataggaacaaagaacaggggccacacacagaaacctgtaataaatatgatagatactagtccagactatatcaataatcactgtggtaaatataccaattaaaagacagagattagtagagtgaattaaaagcaagacccaactat

SEQ ID NO: 546176 - DNA, 281 bp, Homo sapiens
gcttctggcaaagggggtacccacttactttccctgtagactttgctagtttcccaggctcctttttgtgtatttataactgtcaccagttagccactgtattaaactggtatatattgttctagaggacgcctggcctagtacccttcagtgagccatgcccacccttgtagttgtacgtgagaacgctgtacgtacacgcactaaccttactagtctctgaaatacgtacagcacgcaaactaacagacgcttacaaactcgaacaaaaaaaaaaacag

SEQ ID NO: 546177 - DNA, 849 bp, Homo sapiens
aagaccagcctgggcaacatagggagaccctgtctctaaaacacataatttaaaaaaattagctgggctatgtggtatgcacctgtggtccctgctactaggtgtgtgggtatgcacctgtggtccctgctactacagaggctgaggtaggacgggattatttgagcccaggaggttgaggttacagtgagcaactaattatgccttgcacactctagtctaggcaacagcatgagaccctgtctcaaaaaaacgaaaaaacaagaaaaaacaaaacaacaacaaacacaaaccctgtgggttcgggacggcgacgagcgcccgttggaaaaagcgctctttctagcacacacattcgtgatggggcggcgagcggggacccagcagtagggtacagggtgaccatggggctcgatgcgcgggtacccaagaagaagaaaacccggggcgccaagtggaccacagcgcgtgacggaggacttcccagcgacaagtaaagaaaacgccgccggggcggacacaacccggcgcgccgttctgggaacaaacccaccaagagggggggtcacaggagggccccaatcaggggggccaaacacaaaggggggcgcccccacggggagcccctgacatatcaaaattaagcccggccggggggggagaaaacccaccaaaacagcagacaccaacaacacaggagacacagaagaacacaacgagctaacatcgaccacagcacacacgagactacagatcacacagagaacaccacaagtacagaacacaacacacaccaagaccacaagccgcacaacagtcaagcgcagacagcagactaccaaaacaaga

SEQ ID NO: 546178 - DNA, 970 bp, Homo sapiens
  misc_feature (970)..(970): n is a, c, g, or t
cttcatgatgacgcatggactaaggcagagactgaccacctatttgacctcagccgccgatttgatctgcgcttcgtagttattcacgatcggtatgaccaccagcagttcaagaagcgttctgtggaggacctgaaagagaggtactaccacatttgtgccaagcttgccaacgtgagggctgtgccaggcacagatctcaagataccagtgtttgatgctgggcatgagagacggcggaaggaacagctagagcggctttacaaccgaaccccagagcaggtggcagaggaggagtacctcctacaggagctgcgtaagattgaggcccggaaaaaagagcgggagaagcgcagccaagacctgcagaagctgattacagcagcagacaccactgcagagcagcggcgcacggaacgcaaggctcccaagaagaagctaccccaaaagaaggaggctgagaagccggctgtccctgagactgcaggcatcaagtttccagattttaagtcggcaggtgtcacgctacggagccagcggatgaagctacccagctctgtgggtcagaagaagatcaagggcgctggaacagatgctgctggaacttggtgtggagctgagcctaccccacagaggagctggtgcatattgttccatgagtgcggagcgacctggtgttactctacgagctcaaagcaggctgggccaactgtgaatatgagctaagatgctgggggagcgggacgaggcctggtctgggcagagtgctgggggcctgcgcgaacagtgggcaaccccggtctgggggcaccgggtctggttctgggtgttgtgggcccccaggacaccttgtgtggggggcccccacaccatccgggaagaggagagacccccctcttgagaagacaaacacaggcgcggtgtgtgggaacacgcggggcgcacacaacacaaaaaaaagggggggtcn

SEQ ID NO: 546179 - DNA, 396 bp, Homo sapiens
cctttgtgataacaatcaattactagatgcagtggatggatgcagcacaaatctgggctgagccaaagtcccttttggcaatacacgccataacattcgaaggacatcagcgaccttggcttgtataggtgcatattatacttccagctgcaggtagtcttgacaaggagtgtttaaacagaaggctcaagatgcattccttgtgtacggtcggagagagcacttctaatgtaacgtggggtacagatcagctgcccccccaagtagcctggacatcgtcttatacccataataccttgccatccctacaaggcccatacgccaccaccttttcccaggtttattgaggtatgatagacatccagtaaaattcaccctttggaaatatacagctct

SEQ ID NO: 546180 - DNA, 397 bp, Homo sapiens
ctaaataaaaacagttatcagtaaaataaaatgggcaaaggaaaaagttggacaatcaaaacaggaatggaatagaaatagggataaatcaataaaatgggcgagggatataaatcagcaaaacaaggggagggtaaaaagaccaaataatagatgtaaagaggcgcaaattcagtcatgattaaatgagaatgagcaaggtgggcctaagggattcccaaaacggtaaaagaggaataagagccagtatggggggggattataagcagatatgatatttcagtgatagagacaagcaggacagtctcaatggttaaaatattgaaaagcatgtgtgacaatggtaaataggagtagagaaagaggaaaacaaaaattaataaattgtgtaaagtct

SEQ ID NO: 546181 - DNA, 1048 bp, Homo sapiens
tcaccccacccaaaacaccacaccatacggctaggtacgaggctgggttttaatgcggggtcagtgctgtggggggctgcagtgacccccttctgtgtacagctgcacttatgtgtacactgtcccacaaggcacctgtctcagagtgagggtgccctggcaggcagcgtggaaactcccttcctggagcccatgctccatgctaacctgcccacagcaaccccacagagccacattccctgctgcacctggtctgcagtgggtgtcccagtgacatggcccaatgtcatgcccagcatgcagctgccactcctacacctgaagatgggcagctgggcttatccaggggcgacataacggatgtcaggcctggcaccctcctgtggcagcgaccagtggtgcacaggtccatgaggcgacctggtgcccacacacagtgcccaagcaaccaagcgtggactagcacgatgcagtcggcgttgcgggccaacgtagcgcaagacacgaggcgggacaacgccaccacacgtacaagcatagtggctagcaggttactcgaaccacccgagagggccttcccccatctgtactcagccctatctgacggcgctgcctcgaccactgcccacctgctcactcccaactaccatggccgatactaacacactcgtacaccatcgtcgacactcagcggaggacccagcaagcagctgctcttgtacccacgtgcgcctagactacccctccagtccagaagcagctacaaatcacaggaagctgccaccacccggccagatatctgcacttcgccctcgcaacacagtgttgactgaaacatcgtgtcatattgacaaaacccatcacgggtcaaagacaaaaccgtggccacctaccccaaccaccttactgcgcattgtccaccacgatacaaatgcgacttgcaaaacatgaaccaacttaatcatccccctccctagggtccaacccagcactatggcacacaccactggcatcaaactataacattgtcgtacactgaccaccaccc

SEQ ID NO: 546182 - DNA, 392 bp, Homo sapiens
ataagaaaatgtctactttccatggaataccatgcagccttaaacagaatgagatcattcctttgcagcatcatgaagtttgccagatggccatttagcccaagtaattaacacaagaacagaaataccaaataccacatgttctcacttatcagtagtagctaaacaatgtgtacacatgcacatgaagatcgcaacgatagacacttgggagctactacatagtacagggaggaaggagatcaaaggttgaaaaatccttgggtaccatgttcactatctgggacatgggtcctattgtatcccataactcagcatcacgcaatatacccctataagctttattgtaaaactaggatttccaataagcaactttctctatattcttcatt

SEQ ID NO: 546183 - DNA, 314 bp, Homo sapiens
ggctacgagagagcaacagtattgatatctgatccctctccctttcttcaagtcgacaccatcactgcatgtgacccagaaagaatgggagagcttctggtgcccctcctcttgcattgcctccctgcaaaaacaacaggcgggtgtggtgcctcacgcctgtaatccagcacttttggaggccgaggctggtctcgaactcctgggccttcaaaaagtccacctgcctcagactcccaaaagtgctgggattacaggcatgaggcatcgaacccagcttaatttgttataaataaactgatcccttggactgg

SEQ ID NO: 546184 - DNA, 137 bp, Homo sapiens
gtcattccaggcaccccatcctctccagcccttcttggccccacatccatcgcctgtcgtgccccctctcacccccccagtgcccacagcagcacagcatgggcattgcgggctccagcacatctcccagtccgggg

SEQ ID NO: 546185 - DNA, 612 bp, Homo sapiens
atcagcaggaatccacaactttaccgcttccctttaccctaaccaagcaggacaagcactcatgtcattgtgttcgcccgtgtcctcctctggagaatcttcacagtcacctcattcatcaataatgtaccatatgttctgactgccatcatccaggagctcaacccgcagccacccatgactctgcctgtttgtacccaacttttcaaccaactcacgccattatttcggcgggccgtttgttggcaggccacccagtaaatcaccacactacatcaataatttcgcgggcgttacccactagcctccctgcagtcttcatcctcccgcgaggacttccctcggttgtccctgctattgtccaacgaccccctctttgcagctgtccgcccgtcgaggcctggtgtcatcaccaacatcctcacttttctccatcatttactcattcgttctctacctcgtcttcttctcccctcctggggtcctccagcagtgatgcgatgtagggggggggcctcctctggagttccgctgcatgttgctggttggggcggccgtcgtctacatcgtggttggtgactcgccgggggggcgactgtgggcggggggggc

SEQ ID NO: 546186 - DNA, 834 bp, Homo sapiens
tggcaggtgcttataatcccagctactctgggggccaaggcaggagaatgcttgagcctgggagatggaggttgcagtgagctgagatcatgccactgcactccagcctgggcaacagagcaagactctgcctcaaaaaaaaattaaaataaatttaaatacaaaaaaaaaatagccaggtgtggggtgcatgcctggaatcccagctacttgagaggctgaggcacgagaatggcttgaacccaggaggtggaggttgcagtgagccaagatcacaggagccactgcactccagccttgggtgacagagtgagactctgtctcaaaaaaaatttaataatttattataacctttcagaaatgcggtgtgcctttcatgtccttttttttagcattatgtcactctccctaatgaaatgtacttcagagaagcagtattggttaataaatacataacctcattctgaataatgtccctcatttgactataatgtgcttggtttcaaaagcaaaattaaaccaaattctcagtccctcgaagtgaactttgggttacctgcgtcagaaggcaggtggttacttccattcagatttggaatatgacctgcgcttaggatcacgatgaattttactcatgaaatcttttgaacctgttggttgaccgattatctgaggtgactcctaattttcattcaaaaaaaaaaaaaaaatgggggggggccgaattaaatttggggccgataagaaggtagttgaagcggaggttaaaaagggagggaacggttgtggtagtgactacatccgggggaatgaaaagagagtgtgatagaagtg

SEQ ID NO: 546187 - DNA, 259 bp, Homo sapiens
aagccaaacctctttctaaaattcataaaacatccctatggtggacattaacttctccagcattagatcctatcaccttcctttggctttaagttgtcatataatgagtttgcattgtgctggaatcacatgggagtctacagccagtggatactgtgcgtcagacccagggacagattggaacggtctgcctttcttaccgcaacccgtgcaccctcataaaagctgaattttcaatttgatacaaatgtattttgcc

SEQ ID NO: 546188 - DNA, 306 bp, Homo sapiens
gaactttaatcaaagcaaatgggtttttccggtagtcataaaatcccccttcccccatatacaaagggcaagacccccgtttggcatccaaaaataccatatattaaaattgggttccttggaaaactcagggctgggtaaaaccccctttataacaaaaaaagcaagcaaaaatgcttttaaaacattcagatttataaacagcagcttgatatccccttttcgaagtcaaaatttggcaacatttgggcaatattttttacccagcccaccagctcatttttttgtaggggtatttggccctta

SEQ ID NO: 546189 - DNA, 138 bp, Homo sapiens
gtcagtgtacccgaggctgatgtagaggcaggctagttgcttgacgcataggaggtgtaaggttgcagtgaaccgtagattgaaccactgcactccagtgctgggctgacagagcacgactccctttcaaaaaacaca

SEQ ID NO: 546190 - DNA, 338 bp, Homo sapiens
  misc_feature (12)..(12): n is a, c, g, or t
ctgtgctagttncgcttgccattgattgaatgcggaatgaagtatgaagatgctgttcaatttataagacaaaaaagaagaggagcattcaattccaaacagctgctttacttggagaagtaccgacctaagatgcggttacgcttcagagataccaatgggcactgctgtgttcagtagaagtagaagcaggctggctggatcgtggcattagagggaactcttggtacctggaaatgtgaatctggattcttacctgtgtcatcagagtagtaatggattcagtactcctcaactcctaatgattgagaagaaggcaaacgataaagaaatccctc

SEQ ID NO: 546191 - DNA, 202 bp, Homo sapiens
  misc_feature (134)..(134): n is a, c, g, or t
  misc_feature (157)..(157): n is a, c, g, or t
tataccaggacagatcgaggacatctagctgtatggaaaagccacattgcctggttccggaccattcactgctaaggcacaggctcttcactcttctccatcaggcattaaatgaatggtctcttgggcacccncagcgtgggaagtaacattttcnctgaacaattccagcctgctctattttctagaaggtaccgagctc

SEQ ID NO: 546192 - DNA, 401 bp, Homo sapiens
atcacagaagaatccttagattgacatcatacctagcgagtatacaaagcctatatcccactgtccagcttacacttcattcaacctatgacacataccaacaattgtgaaacattccctaatagataagtacaagggtgtctggtgaaattccttaatttaattaaacaaccaagataccgcaatacgctctttaatatattgtacagggatgccactgacaagtacaccatcagagaacacactgctattttcaaatatacagaactgaacaaaagcattttagcatgctgccttactgtacacagcaaactggtgagcatcttcagacactaaggacaggcaataaaatgggttaatgccattggttgatatgtttatgaatcactcagcagtgttga

SEQ ID NO: 546193 - DNA, 163 bp, Homo sapiens
tcctttcttcctcccttttcccgtctgacccaacgttattgtccaacatgactgacagcagctttgtttcttgacctgtatatgcagtctgctatattgcagaggtcagttttgggtatagcggatttcgttatcatcatattagcaggaaaaatgcttgttc

SEQ ID NO: 546194 - DNA, 143 bp, Homo sapiens
cgggagccttaacctggggggtttgaatcagtgagtgacagaaattccaggcatggttggaaagctcaggtggttgtctcagacatctgtgcattctggaagtaaggacaaacggtgcagcgtaacctcttgtcatttgggag

SEQ ID NO: 546195 - DNA, 1406 bp, Homo sapiens
  misc_feature (871)..(871): n is a, c, g, or t
gccaaatcatttgttgctcctgctgctctcattgtgccacgtttttttttttcaagtgtttagtaatagtataatccagtgtggttggatatcaaaagtagaattactttaaggtagttttcttcattatggtcatggcgtgttcttaagttttacccctattagatggtaagaacaattaaggcagtttggcacaaattatttttacattctgatcattcagttctgtcatggtaatcttgggtggttagaaacaagtgatgaaaccataggggttctgtaaactttggtaatgctatgaattcttgtctaaattttgggctgtctattttctgctgaaaccatgcaaaattgagcttggtggggctgggagggttgtgctttgagggaagttacgcttatttttttttggtctttggttttttttttttttgtttccctttttcgggagaaagggcgtctcgctcatatgcgcccgaggcgaggtctgcgaaactccgcgaaaagggtaaaaagaaaaaaacaaacagaagagagaaaaaaacacacaacaaacaaaaaaaaaaaattgtgtggggcgcccgcccggacccggaagagaagttttcaacaacattgtcggggggggacgggcgacccacgagacacacagcacgatgggtcgccagcgggtgctgcagagagagaacgcggggccacaaacagaggtgcggtggtttccccccaaaaaaaacggcgcggggggcacacgagtcgtctgttcggacacacacccaggaggagattagcaaggaacaaggacgggctttcacaagagcggatgccccacaggaagcgggataataacaatagacccgcgcgcggtggacanacgaacaaacaatcattactactcagacgcacagaccagacagcacatgatcaaccacgacgccacagcgagagacatgagacagagacgagagtcgggaagactgaggcgagcagccgagcgaggcgaagcagagaggaagagctgatagaaaacagagtactagggagccacaccacaagaacgacacgaaaagcgaggcggcatgaagaagcgagcgcagcagctagccgccgatgagagagagccgcagcgccaaggaagcgacgaaatagcagaagagactatagcgctgccagcagctaatgcagaagacaatcgatcaaagtctgacgtagagaagtatagacagcgatgccaatagagcacagcacgacagacgagaacggacaacagctcagaaaccgacaagaggacaacaaaggacaggccgtgcagcagacacgcagagcacacagagaagacagagagagcgatagatataggagagagatgaacggacagagacaacgagagaaaaacgaatagtaaacgg

SEQ ID NO: 546196 - DNA, 143 bp, Homo sapiens
acaggaagaaaggagggtggagatgctgggagtttggagagagtttagtgtagaatagtcactatggagtttcagttatccagttgccgaattcggtgtggcaagccaaggctgtgcaaacctaggccggggctaggctcatg

SEQ ID NO: 546197 - DNA, 791 bp, Homo sapiens
gccaaatcatttgttgctcctgctgctctcattgtgccacgtttttttttttcaagtgtttagtaatagtataatccagtgtggttggatatcaaaagtagaattactttaaggtagttttcttcattatggtcatggcgtgttcttaagttttacccctattagatggtaagaacaattaaggcagtttggcacaaattatttttacattctgatcattcagttctgtcatggtaatcttgggtggttagaaacaagtgatgaaaccataggggttctgtaaactttggtaatgctatgaattcttgtctaaattttgggctgtctattttctgctgaaaccatgcaaaattgagcttggtggggctgggagggggtatgtatccatggggacctttaattggtacagaacacagaacttatttctgtcagttatttaatacatgtgcacactttcgtcgaacatgtctcaacgagaataagatgtttcccaaaacaacaatctttactgttacacacacttagttcttcaaaagatctgtcgtactatacgggggcatatttcttctttaattttcaaacatttacctctgaaagtgtgtattctctctttttaatcttaccctcaatttgaacttacgtggttggttttccaccatcgtgcctgcggattgcctacggaatcatcggtagtttcacagaaccgcgtgtgtggcccaactttggtaagcctatatctcctttcttcaaacaaaggtgttttgggcccagcgacaccgtggtgcaggacc

SEQ ID NO: 546198 - DNA, 792 bp, Homo sapiens
agagactagatgcttcactagggaatgtcttcccacccagcatcacaaatgtggacaatcactgcatccacatctgtaggcatatttctatggaagttaattgacagctatatcattatttatttacaatttcatttttctacaccttttgagatttcatgaatgcagttttttcttaaaatttattttaccttgacagtatgtttttagtcccccaatttaattaatggcccatgtgcatatatatgggagtgtgcttacatgttaataatttacttgcatacttatgagaatttcacattggaatccataatggtaaaacaacatacatctgccaatatacgttttcctgtgggttcaagagaagataactgacagctttacctacttcctacagatgcttctaaacccagatatactgagaagagtgtattgcctctgagtgtaagagcagtatgtgtggggttaagtctgctctagatcataatttgtaacacaaatatacgtcataatctgttacacctaacaattggtcaggccaactttgtagactgaacatgtctggcacttgtagtctcagatcacgtgtcacgtatataatttgcttctcccattttaacttggtaggaaggtacttaacagtaggaaacgcgattaaaccacttttatactgtaaaagggcttttcccttcctaatggttaattgccccagtgtttggccctgaagagctttatggcgtgacttgttcacttgggtgacatggggtgctgcccgggtcacctgttgtcccc

SEQ ID NO: 546199 - DNA, 326 bp, Homo sapiens
tatggggtgcatagccacttctgcagatagaataacgttacccttaacagactatatacggtgatagtacttagaacagtgcgaagtcgcttgcggcgtaccttcttaccatgagatggggccgtcaaatggcttaagcctgaggagtgatgacgacttgagcatcataatagctcagaaatcctccacggtggagcagaaacgacggtagcccaacacgaacaaagatgtagcaggattccatcgagacctcatgtgggtgatgaccagaatgtctggctcccatagcgtggtcaacatgagaatgtccataacaccacacaatt

SEQ ID NO: 546200 - DNA, 1174 bp, Homo sapiens
  misc_feature (15)..(15): n is a, c, g, or t
  misc_feature (19)..(19): n is a, c, g, or t
  misc_feature (89)..(89): n is a, c, g, or t
  misc_feature (117)..(117): n is a, c, g, or t
  misc_feature (157)..(157): n is a, c, g, or t
  misc_feature (174)..(174): n is a, c, g, or t
  misc_feature (196)..(197): n is a, c, g, or t
  misc_feature (222)..(224): n is a, c, g, or t
  misc_feature (266)..(266): n is a, c, g, or t
  misc_feature (318)..(318): n is a, c, g, or t
  misc_feature (367)..(367): n is a, c, g, or t
  misc_feature (377)..(377): n is a, c, g, or t
  misc_feature (525)..(526): n is a, c, g, or t
  misc_feature (548)..(548): n is a, c, g, or t
  misc_feature (626)..(626): n is a, c, g, or t
  misc_feature (671)..(671): n is a, c, g, or t
  misc_feature (700)..(700): n is a, c, g, or t
  misc_feature (716)..(716): n is a, c, g, or t
  misc_feature (752)..(752): n is a, c, g, or t
  misc_feature (799)..(799): n is a, c, g, or t
  misc_feature (817)..(817): n is a, c, g, or t
  misc_feature (819)..(819): n is a, c, g, or t
  misc_feature (1046)..(1046): n is a, c, g, or t
  misc_feature (1090)..(1090): n is a, c, g, or t
  misc_feature (1127)..(1127): n is a, c, g, or t
  misc_feature (1173)..(1174): n is a, c, g, or t
attaaagaaaattantttnaattagttagtgtaattaataatattaattaaggattaaagttggataatgtgatttttttattaaactnttagtcattttattattcattatagtanaatgaaaagaaatttttgtaagttttttttatttaatatntaatattaaaatatttnaaagaagaaattttaatattgnnctcatatttccgaaatatcacaagnnnccactgttccactcaattgtcctcggcgagagagcgcaccgnccataatatataagattatcaataaatagacaaacgtatttatgttctattngtaatttagtttcacggtccttatttttagtttcatttctttaattcgnagaacgaatnccatacactgcatgaactgacctctatagaccataagtacaccaaccacactacacaaagccattcgcgtttccatctcatcaatttgttttattttactacatctctctcttctgttctcttacccatatatgtctcaatagcaatnnaccgataactcattatatgtcncattatatatatatgattttccttttattctacctcactctatatactttatagtcatatgactagagagaataatanataagttatgggtaataaataattaataatattattaaaaaagtnaagatattttatatataggtgtcatagtnatatttatcacagtcntaatattaccttcaatcccatattatatttatgttnctatttatttaataattacaatatttactcaaaaattatgtagattnaaagatgtgtaagtagtntnaaattaatatttcatactaataaatcaatattacaactgtttcataatattcctccattatctataatattattctcactccactatatattcattaacttctcaccgtagtctaacatcacctccatctaacttacatcactcttatagatcacctcaatcttattctataaactgcttataatatagaaaataatccgcgaatagtattaatattatatactacnttccctctagtatctacccaatatgtcttataccgtagaaagtnctccaatcactaattatcaatctcgaatgtataattncgtatgataagcagtatataactaatatatttcaccataaaaggtnn

SEQ ID NO: 546201 - DNA, 295 bp, Homo sapiens
  misc_feature (22)..(22): n is a, c, g, or t
  misc_feature (25)..(26): n is a, c, g, or t
  misc_feature (88)..(88): n is a, c, g, or t
  misc_feature (210)..(210): n is a, c, g, or t
  misc_feature (219)..(219): n is a, c, g, or t
  misc_feature (237)..(237): n is a, c, g, or t
  misc_feature (250)..(250): n is a, c, g, or t
  misc_feature (264)..(264): n is a, c, g, or t
cctggagggcagtgactgacgngannccccggggccatcaacttcaccatgttcctcaccatgtttggggagaagctgaacggcacgnaccccgaggatgtgattcgcaacgcctttgcctgcttcgagaggaagcctcaggtttcatccatgaggaccacctccggagctgctcaccaccatggtgaccgcttcacagatgaggaagtngacgagatntaccgggaggcacccttnataagaaagcaanttaactacgtgganttacccgattcttaaaatggggccaaggtaa

SEQ ID NO: 546202 - DNA, 548 bp, Homo sapiens
cccggccgccgtcgcgacgtgtatcactcctgtgtacgttaagtgacaggtaatctttaacgactagagtagcagaagaaatcatggcatgaaatatgggtatgcagatgaagcacgaagataaggtgctgaataatgagttaaaatatctccttagtcttttattcactcatttggcaaatacataacatacatcataggtcagtcctgctctcaaggcaatgagaagtgactgaaagaatgacaggattccagctactatgggactgtgctctagctgggcaaggcacccagacgattagattagagtgtaatcaacaatgtgtcacaattagcagacagtagctacgtgagtttcaaaatgagtcatttgatgaacagtgtcggggctgtgggagggaggaggagaagggggcttcgtagaaatggttgtagcccaaattagattccgaggaagatgaagttcatttgaatccgtatatatattcacgatatgctgtatggaatgccaggttgtaaaacaggatgtgccggatgtgtactactat

SEQ ID NO: 546203 - DNA, 242 bp, Homo sapiens
attcgcggccgcgtcgacccacaagtaaatgtatctgcaagctgatttaaattgtacattttctcttcattgcatataatctgatgttgaataaagtctgagtattaactaaagtttttgcttcttaaatttgtaagaattggcctgaaaatctgtattgttgagcacagtattaaaaacattgttacatacattgtatttcaagggttctgcatacagcaaccatgttttatcgtaacact

SEQ ID NO: 546204 - DNA, 357 bp, Homo sapiens
aggtcatagggaaggaggaattgttggctgttaaaaaaatactgcaaatggcctttgaaagtctagacatcttcatcataaacacaaacattcctcttcacaaagggacttcaagtaaccttaggctggagggcccacttgagtatgtttttcttctcattctttcttaccttccctccagccaacccaacccacattcagtgaccaagtcacgtgggttttacctcctaaatcttttcagatccgttcactgctcagccactctcctgacaccaccataaaccaagccaccatcacctccagctgtttgactgcaaaggcctcctcactggcctctgtcttcccctggccctgtga

SEQ ID NO: 546205 - DNA, 89 bp, Homo sapiens
ccaggggtggggggtatggggaccattcattccctggcattaatcccttagagggaataataaagctttttatttctctgaaaaaaaaa

SEQ ID NO: 546206 - DNA, 262 bp, Homo sapiens
cactcctatgtcccttggcgttgtcctggccgcgggactggtccacgtgggaaggtctctctccaccccaggctcgtgcttccatatacacacatctcccagtagccaccaaacagctggccactgattagggcattaacttgcctcggatggctcacgtcataccataagcacataacgggctgtttctggtgcttggcattggtaggtgggaactgcgggcaggggctttcactccctggcactggacattaggcctgca

SEQ ID NO: 546207 - DNA, 128 bp, Homo sapiens
cttgctggacatacttctggtgggcactgtgcggcacttgaggataaatcagtgagctgcatgcacttgaaaggcatgcgctgtctcctcacttaagtgcaaggtccatcgaccaaagccctgttctg

SEQ ID NO: 546208 - DNA, 294 bp, Homo sapiens
gtagatcgatcatgagacgcatgacaaaattggcggataatgcataagaatggtgatcaaaatgaagactagcacacgtgagctaatgaaaaatgatactggctattccactgcacttgactataatatttggataattagaccaaggaaaatgacctcatcttacataggtacagagccacaaccttctaggtgatttgacaccttcctagctgtcaggtgtaagaagggcacaaaaacagatgtacttcagtataagttctaactagttggaccctgtttgtaaatagcatc

SEQ ID NO: 546209 - DNA, 184 bp, Homo sapiens
tacagccggaggcaggtttcacccgggaggaggagacacttcggtcgtcacccaaagtgttacaggcttaaaacacaagctagctttgtaaatactgcatcgtgatcagaagtgggtcatgctggttagagatggagtggctgcatttgagtactatggacccagcgaggaccaccttcgacgg

SEQ ID NO: 546210 - DNA, 262 bp, Homo sapiens
ttttcaaattttcaaaagggaattttcccttttggcctttttaaaacaggtgggccaaaatcctaaaggcccgcttttaatttaggggcccgcccatgggccctttgggaacaaaaatttgcagggaaaatttgggtttccctggacccttttgggtttaaacgggttaattttgggggttcaaggttttgaagtgaaaccccataaaaaaaaaaccctgggcccttttttttggttttacatgtttgggatgtttccccca

SEQ ID NO: 546211 - DNA, 552 bp, Homo sapiens
agatagaacataaaaaatatcttagtaaattatcaaacaaggggagattataatattaatagtagtattacgccagtcaaggtggcttacgcctgtaatcccagcacttttgagaggccgaggcgggtgaatctcctggggtcaggaatttgagaccagcctggctaacatggtgaaaccccatttctactaaaaataaaaaaaattagccaggtgtgatggcaagtgcctgtaatcccagctactcaggaggctgaggcaggagaatcgcttgaacccaggaggcagaggttgcagtgagccgagatcgagccattgcactccagcttgggcaacaagagcgaagctccatctcaaaagaaaaaaaaaaaaaaactagtagtaatagtggcagtactaaaagtaggggtatggataataatagctaaagggtatgagatactatatgccaggctttattctaaacactttacttatttttactcatttattctccacaagggtcctatgaagaggagatggagagaagttaagtgacggggggtaccgagc

SEQ ID NO: 546212 - DNA, 186 bp, Homo sapiens
ctcacacgagaaatgaaggcgtctgatgcagaccacgggacccgccggggtagaactcaaaacccaacacaaagaaatggctctggcgcgaataacaccacacacaacttgtctctcacctggacacacagggctgaggcgccagagactcgagtccttccccaccccagtgcttggtggctctgt

SEQ ID NO: 546213 - DNA, 846 bp, Homo sapiens
agttaatgcccatgtgacaaacatgtagatattcatcaaagaccacatgtatatattgtaaaggcatttgatcttctccccatatgtatgtatagctagaatctgcttgcggttgtaaccttttcttctgcatggagcttggggtgaagcaaggccattggtccagtgtgtcatagccttaagcatgtttgcccttcgtttgttgaatgttcaaaaaatgtcaagtgatcaagaaaaagctctaactttcgactttgttaattttatgacatgacactggccacaatatggtcgccaattactgtggacgccattcttatcatttccctgacaataaaatatgcaatgttttacgacagtattctaccaagagtctctcagacactttttacaaaaaactctttttttcattatgcactggataatacacagtatcagtgtctatgtcttaaagtcctttttaattactttttgacaaaacgttctctttgggccaagtaccggtgctcgtgtctcctatatgacacacgtgtccatttcaatatgtattattgtctttacataaccagaatcaacaagcgaagatcacttttaattggttcatcagaagaataaacccctttggtgacagatatggcgaaaacactcatacgagggccggccacggttcgtcaacctcttttcacggcaggaatttctaaggctgggtacattacttccaaatgggtaggggacagcatgcttctcggcgggcagtttacacccgatgtggtacgagttcacaccggtacactgtaccttcgggttttccgcagtccagtaccgtctaaggggacataaacctgt

SEQ ID NO: 546214 - DNA, 1798 bp, Homo sapiens
  misc_feature (1)..(1): n is a, c, g, or t
  misc_feature (478)..(478): n is a, c, g, or t
  misc_feature (713)..(713): n is a, c, g, or t
  misc_feature (1505)..(1505): n is a, c, g, or t
naggttgtgagtagtttgtttcaactagttagctgttcttttgatggttatactgagaagttgtttgcttgtatctagtcgtggtatcctcgctttgtccgccctctttggttgtggctcgtcttctagtagtagtgctcttgggggggtggtttatgcctcgcctgtggggctgcttcgctgagtccttgtgatccctatctgctccttttggtggagagttcccaacagatgggtgagaaattgtgagagagtactgtttgggctgcacacacttatagctcaagggtctccacataaattattttgctccgctggtgccgaccccaaggaagccgtatagagtggcagacctggcgcgggcttaattatcacgaaaagaagagggctgcaacattcgcaaaaggcgtcgtcacagagttggtgtggttcgccaggaacagaattgctccctgccatggtgctgctcttatatccnactagatgtgttatcacaacggggtggcataacgacatgtcagtgttagtactcaaatacttgttgccgggggccgcccacatagtgagtttggtcctcccggttgttggctcttggtctgccgccacgagccccacccaacttttcccggagaaatgtgttttttgtgttgttccacctttggccgccgcaccccgtttttgtggggctcatgatgacacttgtcgctccacgnggggggagacacttctcctctggggggcgaaccaccgttgggaggcgcccccgccacagaaaccaccagtgttgcaaaccgcccgctgttggggaaacatgtttgacagcaccatgtgtggggtgtttgctctgccacgcccacagatgacatgtttctcccggttttagaagagtgggtccgccccccccgacacgacgttctggagtagtgtagtctttcggctccttcgatcatgctgtttgctcctgcacgaggtgtgtcgacgagtctcccctcacagtctcccccacgggtggtcttttgtctctatagagacgctctttccggacagaaccgcccttgtgtgtgcgccccgctcttgggccccgctataattttttgtgtcctccccttcgtgggaatctctggtggagaaaaggagagtttccacgaagaggtttggggggttttggtgtgtaacacactcgtttcccacgagaggggggaaacccctcttttccgcgagtctctctctgttctctcgcgaagagagtatacgcgcccctcgagattgggctctctttgtgccacggtgataccctcggtttgtaaaatggcgggaaagaaagggggggcacatctctttcttgagacacacacccctcgcccctctctgtctccacggcttcccccactttcacacacacacacacccgcgcacacttttgcacaaaccccctcgagacctctctggagacctccacacctaaacacacctcgggaatgttacacctcggaagaagaatatgnggggtatagtgttcttccctctgctggcccacgcggctggaatacccagagtggggaattggggaaagaggccctcctttcttctgaccctccctctcactagagtatgcctcgagcccctccccactacctcttcccacttttcctcttgagtagttatatttgtgtacacagctttttaaataattttttataaattatttaacccctgggggccgaaactgacggagggaggatataagggatccccggactctgtatgaattgaaataaaagagaaattaaccaatctt

SEQ ID NO: 546215 - DNA, 1464 bp, Homo sapiens
  misc_feature (766)..(766): n is a, c, g, or t
ctgaggcttgctagcgggcacggggaatggttgcaaatggcggaggcagaggcaggggtggcagtgtgacggtccgtggactgtccccctgtcgtgtcgcgacgagctgctcattctactacttttgaaataccggcgacgctcctggagaggtggaccatggtgtctgaggctggacaggagacatgggctgatggcgggcgtcctcaccttcagcagagcctgcagacgccgagaagggtcttggccccaggactgaatcacgaagctacatggtgcccagctgagtcctgcggagcagtcgtccgaggcacgagcgtccctgcacggcggtgccgtgtgtcctaggggaagcgtgcgcacctcttgggctaccagcgcgcgcgcgagacggctcttgggacgcaggcgagtgtcgcgaggaaccatctgcggtgcagtgggcctcgggggtctcccgaggctacgaggccttgtcctgatgccctttgtgccatgtccccctcgtgcgcagtatccggggggcgtcctgtgctccaggtatagccccaagggcccccctctatcctggagcggccagtactgctcccggctgtctctgctgtggtatgtgtaaggcaaggcgtcgccaaggatattccttgtgtgtccatgtgcaccgcgcggaggaacacccctcttggctgctctgagattcgcgcctttgtaggaccacccccgggatagatttcccccccccacgaggcgcccccgcaacatcccgcgnctagcttgtctagttcgctacctagcggagtagacgcatgacgtaggcacctccctcgggcatagcgcaactcctctggcccttagaactcggcaattcgacacacagtcttaccgcatcacccatttgcagcacacgcacagctagcactcccaggcctcggcgcatagcgttcgccgattctacagccataggtgcccccactattgatacaaccgtacacccctttgctcaaaatccggccacgattaagcaccgccggtagggtctccgcacattgtacctgccaatccttatgcgatctcgacacacctcccacattttccccacaaccaaaacgattacaagcacccaatctgtggctgaaagcccttaggcgtagtgtccatctgcggctagaaactcacaacaccaaatcgactctacgcaacgcaggcgatacaacaccctactcacaacacgatattgcccagcggcccaattacattcccccttgtcacctacaccgcctcctcacaacctactgtatcgaccctatcctgtcgcagcacttatcgccctattcctacatacttgtgtacccaccatacacgcccccacaactctgtgatatcgagcctactcaatcgtgtgtatcctcaacctcaattctatgtaccatggtgtcaatccaaatcctacgctcacatcagccccag

SEQ ID NO: 546216 - DNA, 767 bp, Homo sapiens
  misc_feature (10)..(10): n is a, c, g, or t
  misc_feature (341)..(341): n is a, c, g, or t
  misc_feature (564)..(564): n is a, c, g, or t
ccaaatgggnaagggaaagactcctattcaccttggccggccttggacacgttgattccgggccagttcacacaataatgggcatctggaactataaactggccgggggcactcgcaaccaaacgaaacccttggaaaaactttgacgaaacgaaggctggctgagaaatgggaaacggggcttcctctccaggtaatgtgcctcggggttctcgggactaaacctggaacaggctgtaagcggtgtaaacgctgggtaatcacaccacttggctaattcttcccttggtgggaacactttggaagaaccacggcaacggtaactaatggtgtaactaatncacattggaatgtgccccagaggaacaccacgaggaactcttaattccaacacaacactgtaattataccgggggaacacttctcacagggctggaactggtggcctggtccctggaaattggttggcctggcatggggtggttggggtgtaacattttgagaaggctggggtaaatctttccaaaggtgggggcacggaaccccgcaaagagagcaatgtgncgcctttcctggggctctatcaccacctggggggtggtgtcacacaccaaactttaatttgggtcggggtgggttcaacccaacaatgggggatttccccaattgtgaaacccaacacccttaacagagcccagcacaacagacataatgtagagggacttgggttccagggggacaagtccagggccttttcccattttggc

SEQ ID NO: 546217 - DNA, 912 bp, Homo sapiens
ggtaaaccactgtgtccctctgccttgttcctcgggttgttgtccccccccttacaactggggagcacattgttccctccggagactgcgaattccccggggcctggtggttttcgatctccccaaccgggcccagatatccccccctcctttatctatggcgggtcctaaacttcaagtcttcgaggatacagtcaatgacccggggcccttttctcctcccacaagcgggattctgggcccacctttgcgaatgtagcacacacttcctcttctgtatgaagacgccgtgcgcgtgaatccgcacatttcgtgggagtctgctcccctccccctctttataggccctctctttaaaaggcggtcctccccttggagtattatcccccccctcaggacgactcccctcttgtgaaagctcccactaaagtggggccctccaacatgccttgtggagcgcggactgatccttgtcaatgatcaccttacaaggtggtgatcgcttctttccgaggagttatatctctaaaagagacggaaggtttccagggtgattggcacttcatggtacctctccacaatagatctcgttagatcgacaatgttcctctcgtacctgtcctggcgtgatttctgtcttccccctgtttcttcaacgcaataatagctcctcactcattggcctcccttttcaccccctcctgctacagagtacgattcatcatttccccatatattgaccccaaccgaaaacatctatatggtcatcataacagcgctctgccccaggaagttggcgcccgcccagctttcctaaatcttgaacaatttattacccggctatttccccctttatgacccgcacctttttccggacctcaaccccaaaaaatttcattctcgacaccacaa

SEQ ID NO: 546218 - DNA, 161 bp, Homo sapiens
aaaaaaaggaatttttttggggataaataaaaacctgcctgataaaccgtagtcaatgttcggttcctccaaaggttttgctgctgtcaggtgttatgccctccctccctcataactgtattaaaccccttttatatgttaataaacgtggggccttttga

SEQ ID NO: 546219 - DNA, 239 bp, Homo sapiens
tgcggcgccctttattaaatatacagagaaataagtaacacctatagtatcagatattaattttcttcagtgttcaggcaattaatatttagaaagctcttgtccatagagatggctctgggatgtgatagatgattgtatgggatatgaaagcaatggtacgtatcataggagcagatcatacataaattcttagatattaaaacgtggttttgcgtttcagattaggagagaaaaat

SEQ ID NO: 546220 - DNA, 848 bp, Homo sapiens
  misc_feature (294)..(294): n is a, c, g, or t
  misc_feature (515)..(515): n is a, c, g, or t
ggccgaaggaggaggtggaggaggaggcggctcggagagagcgagcagcgagctggctggagttgccgagcgcgagttgagggagccgagtccggccgcgcgccgccgtgcgtccgccctccgccctccgcagaacaggagcccgggccaggggtcctcggtcacgctggtgcgccatggccgatccgctcgagcgttgagggccgcagagggctagccgcagcggcagaagcggatcgacggcgggaggagaggaggcaagcagacgcgcgcgagagtaggggaggcaacggnccgagggacccgtagccgtgcgcagccctgccgctgatgtcgcgccgcttgaaggggcaagccgggcgtgggctgccgtggtgcacggcggtgaagcccaaattggcataagaggggcatcctgcatcacacacgtcagtttagcgttaactaacaacaccaacagaaggcagtttcgttcgattcctattaacgggcccctaaccttagaaggccccagnagtcactacaggggaaacgcgttgactgtagacgcccatcatcgtttagttgaagccttccctaggagatcaaagcccctgcattttgtggtacaatgtctgacactcactttgcctacaatttttaacaaaccctatgagcttgggcactgatgtgcccacagcctggtatatcccagtggattcacggagacatgagggtgggaggattgctagaaagccagagagttcgagaccagccttgggtaaacataggctagaccacagtctctttaaaagtagaataggttacatttagccaggcttgatgactatattgccttgtaagtccca

SEQ ID NO: 546221 - DNA, 502 bp, Homo sapiens
tgtgtgcctggcctgtggcactggaatgaccctgacatgctgctcattgggaactttggtctcagcttagagcaatcccgtggcccagcatggcccatgtgtgactggtgcttggcatgtcccccatcttgatgtccacatgacctgcgtaccatctccgcccagaacatggacattctgcagaatccactcatgatcaaaatcaaccaggatcccttagtgcatccatgtggactgcagtgattcacaacggaacaaatctctcatcgaagtgtacatgcggactctgtccaacaatggctatgcgccttagtcttcttcagctgcaggaccgatatgccttatcgctacccactcctcccttggcccaggctgaacttcacccgggtcttgtgatactatcgaggcccatggacgtctactcatggtgacatcactcagtgtgcctccgacgatgaaaccaacttcacagtgatcatcaacccttcaggggtagtcgatg

SEQ ID NO: 546222 - DNA, 119 bp, Homo sapiens
cctggcttatgaaaggaataacaaaacctccaggatatggtctatgtaagaagactgaacctacaggccgagcacagtggctcacgcctgtaatcccaggactattgggaggctagagg

SEQ ID NO: 546223 - DNA, 491 bp, Homo sapiens
  misc_feature (324)..(324): n is a, c, g, or t
  misc_feature (338)..(338): n is a, c, g, or t
  misc_feature (342)..(342): n is a, c, g, or t
  misc_feature (443)..(443): n is a, c, g, or t
  misc_feature (454)..(454): n is a, c, g, or t
  misc_feature (478)..(478): n is a, c, g, or t
tttccgcggcgatggcgattacacgcattgcctggttgtcacggcgaagttcagccagcagatcaagatcatactgacgggtgtaagggtggctggagacaaataccaccaccagcgtttcgtcatcgaccagcgattttggtccatgacggaatccggttggagaatcataaaaggccgccagtttacccgccgtcagttccagcactttcagcgccgactcgcgtgctgcgccctgtaagccaccgctaccgagataaacgatccgtttccacggtgcgtaaccaaacacaccttcgctgaaatcgcccagtgaggtcaggntcgcctggcaacgntccnccacgtcgcggaaggtttggctgttgatcgtctcaggtgcgaaaccgcgaggcagctggccatcatggtggtaatgctgctggtcatcgcaaagccgcggntcgtgcgtttntgcgggcatcagcagggcaaacgngttatcgctgttg

SEQ ID NO: 546224 - DNA, 152 bp, Homo sapiens
ttggttgagcgcgggatcgatgcccaccgagcgcgcatgtgcgcgtgaagagcgtgatcatcagggccttccagcgcaacagcagcaccagcagcgagacgccgccgatgtgcagcagttgcaccgtgtcggccggggtgatcgccaggatg

SEQ ID NO: 546225 - DNA, 629 bp, Homo sapiens
ggtggtgcaggagctcattgtgctgcccgccgtgtgcagctgccggtccgtggtggccatcccgggcccggcatggcagcgctggcgttgacccctgcacggcagcggcggcgtgcggctgctgctctgggacctggcctgaccatctcgctggggatgtgcgtgcaatggtgcttcagcctgcatgcacggacctggttgctgccaccatgtgccactggcacacgggtgaggcggccacacctgctgctggctgatgttgcgtgcaatgggcttctctgcaggcactcgaatctcggtgacgcaccaagcgcatccatcactgggtgcgaagaaaccctagcgcctgtctcctacttgctgccaagccgcttcagctgagatgctctggcgctcgttgcagcaccatgcgcactgcacacctggggacgcgacccttacgccttgcggggacttgttggcaaggcgcttcagctgtctccttccaaccttgctgcgccaccggcgcacgcactcgggcgagcggccctacgttttgcgaggacttgtggcgagcgcttccgacacaaggtgcagattccgccgccacgagcgccagcttcacggcgcgtgccgctccagggggcctc

SEQ ID NO: 546226 - DNA, 144 bp, Homo sapiens
cacgaggagtaatacagcccaacttgctcatgattgacaaagaggccgaacagtccaataaattgatgacaggtagtgaaactccaaattgagtactgatcaaattgagtccacaggcttgcgctttcacaacggcaaaattag

SEQ ID NO: 546227 - DNA, 328 bp, Homo sapiens
  misc_feature (17)..(17): n is a, c, g, or t
  misc_feature (202)..(202): n is a, c, g, or t
  misc_feature (273)..(273): n is a, c, g, or t
  misc_feature (276)..(276): n is a, c, g, or t
tggccctttttcttggnctggaaagaaagttgggccccctgggagtgtagttttctgttttaaatcccccacccctggctgggctcagtggctcaccccctgtaatcccagctaacttttgtatttttggccaacattgtgaaaccccatctctgccaaaaatacaaaagttagctgggattacaggcatgtgccactacgncggctacccggggaggctgaggcaggagaattgcttgaactcagaaggcggaggctgcagtgagccgagantcngccactgcactccagcctggtcaacagagcaagactccatctcgaaaaaaaa

SEQ ID NO: 546228 - DNA, 262 bp, Homo sapiens
gcggcgcaaatcaggctcaccgcaccctccacccctcaggatcaagcgatcctcctacctcagcctcctgagtagagggagctacgggcacacaccaccatatctggcttattttataatatttctcaccagcaatcgcctctccctcgagcgatgttcttgaaagctgaactacaaccacagtggaaaagccggcgtgtcaggcctgcataagtttgtctgttgtggttttgtaaaaattaattgtgaaatacacatcaca

SEQ ID NO: 546229 - DNA, 272 bp, Homo sapiens
ctccacccgacggggtgctccacccgacggggtgctccacccgacggtgttctccacccgacgtgtcgctccacccgacggtgggctccacccgacgaggagctccacccgacgctgtgcatcttggttttatacattttaggaaggcatgagacatcaatcaaatacatttatgaaatacattgatttggtccagaaaggcggtacaactagaagtggtgttgtcagacaaggtggggggcgttatttttgttgttgatgttttttttttg

SEQ ID NO: 546230 - DNA, 83 bp, Homo sapiens
  misc_feature (34)..(34): n is a, c, g, or t
  misc_feature (37)..(37): n is a, c, g, or t
caccatggcagctgccttggctcggcttggtctncgncctgtcaaacaggttcgggttcagttactgtcccttcgagaaaaac

SEQ ID NO: 546231 - DNA, 209 bp, Homo sapiens
gctcgtaccgctctcgtgagactggtgttacttctgtgagtcattgtctactcagcctgcagctgataccacacagagatagaccaatctactcaggcgcacacccacacgaattccacatgtcacatctctcaccttgggaatgagacataatcatctacttgtaacccctgagggctaagagtggggagaaaattaaggatccaggc

SEQ ID NO: 546232 - DNA, 292 bp, Homo sapiens
aggtgcagagaaaaacaaagtgtaagtgtggggaagtgtaaattagttcaaccatgtggcagagaatatggtgattctgcaaaggatctagaaccagaaataccatatgacccagcaatcccattactgggtatatgtccaaaagaatataaatcattctattataacaatacatgcacatgtatgttcactgcagtactacttacaatagcaaagacatggaatcaaccctaatgcccatcaatcatagactggataaagaaaatgtggtacacatagtgacgttcctcat

SEQ ID NO: 546233 - DNA, 171 bp, Homo sapiens
cgagaccttttctggcgtggactccgctgttacctctcctctgcctctatgctggtttctctgtctccatgttgaatccctgctgtggcggcctcaggcaatctcactgagactgtccagcctgcatgacaggcagcacctcacttgcccttgctgatcgcctggggaccg

SEQ ID NO: 546234 - DNA, 350 bp, Homo sapiens
  misc_feature (175)..(176): n is a, c, g, or t
  misc_feature (281)..(281): n is a, c, g, or t
  misc_feature (290)..(290): n is a, c, g, or t
  misc_feature (294)..(294): n is a, c, g, or t
ctcatgcctctggcaccctgcccagaggtgtgagcccctgcctcacactggctcctcccgcgctgagagaggtcagtgtgagcccttgcctcacaccggcccctcccacgcggacagaggtcagcgtgagccccttgcctcacaccggcccctcccacgctgagagaggtcagcnngagccccttgcctcacaccggcccctcccacgctgagagaggtcagcgtgagccccttgcctcacaccggcccctcccacgctgagagaggtcagcccgagcccntgcctcacnccgncccctcccacgcggacagagacaggcgtagtccgggacagggaaatctaggcacta

SEQ ID NO: 546235 - DNA, 1133 bp, Homo sapiens
gattcactgtctccagcgcctcttctttgagaaccacccgtgacctaccataccgctgccaagggtcaaagcaagttctccttgaaaacagcgctgcattgtgcccccaaaagtaagcctgtcctagagcccctgacacccccacttgggtgctccatcgacctcggagatgctagaagttttacccctgggcgaaggaacacagctccatctcctggagccctctgtgattcgccgaggccgcaggcagtctgagccggtgaaggacccttatgtcatgttcccacaagaacgctacgcctggcattcaagcacgctggcagcccacggcggacactctaccctccagaatctcagccaccagtaccaggctctgcaccccctgcaggacctggagcatgctggaccccacaacactgcaccccctctggccacctcaatcacctgaagaaactcctggacactgctgcactcagccgaggcctctcgagatccaggaaccgcaccacccatgacatacccaacgctccccggaacactcccagagcgcctggacgaccgccgacacccctcacataccacagcccatgcccagcccgcgaacatctccgcacacacgacgcaccgaacgcaccagcgacgagcaatgaccacaagcaacagtaaaccagagggacctaccccccactcccacactacaggcccacgcgaccccacacacaaaccacgcccaccgcaaacagcccccaccaatcccactcacctaaccacacaaacccgcacgcgacacaccaacacatcaaccacccacccaacgaccacaaccgaaacgagcacccaccactacccacacacacccgtcacatatcagcccgctaacacgaaaacccggacacaaaaaacacaaagtgtacaccacaaccagaacacctacccaacgaccacatcaccaacacacagccacagagcccaaccgaaccaaaaacaccaccccccacacagcgagcaaaaaaccagacacagaaaacaacagaccggcaacaagacaaaagatcacaacaaacacacacaagaaacaagaacaccaaacgacggacaaacgcataaaaggcacaacacaaacaaaacagaca

SEQ ID NO: 546236 - DNA, 112 bp, Homo sapiens
gaggatcccgaggagatagcaggagcaatgggggcatcaggtgtatgaacatgcagggtgttttctcgtgtgcaagcagggtttcatgttgttaatgtggtgggtgagtgag

SEQ ID NO: 546237 - DNA, 710 bp, Homo sapiens
ccgtgccgttactcgtatgtcaggcggcggcgcaggcggtggggcggatagcgcagcagggcgccttagcagcagcagcagcagcagcatgcatctcgaggtacccccgccgtcgcagcccccgcgctgtggtgcatgcagcctcgactccctctgctcttcctcccttcgctcgcaccatggctgatcagctgaaccgaagaacagattgctgaagttcacaggaaggccttctcccgtatttgataaacgatggcgactggcatccgatcacaatcaaaggaacttggtaatctgtcatgaggtcacatgggtcagaacccagcagaagctgaatcgcaggatatgatcaatgaagtggatgctgatggtaatgggaactcgattgacttacgcaccggaattttatgagctatgagtggctagaaagaatgaaagatagcagatagtgaagaagaaatccgtgtaggctattccgagtcttggacaagggatggcaatggttatatcagtgcagcagaactacgtcacgtcatgacaaacttaaggagaaaaacgtaacagatgaggaaggtagatgagaatgatcacgagagagcaggatattgatgggagacggactaagtcaactatgcaagaacttcgtacagcatgatgactgcccaaaatgaagacctacttgcaagtcctttttcccccctctagaagaa

SEQ ID NO: 546238 - DNA, 141 bp, Homo sapiens
tgaccaatttactgctgacatgctgggttctgctgaagtagctgaggaagtcaatttaaatggttctggcaaactgctccagattacaggctgtgccagccctggaaaaacaggtacaattgttgttcgtggttctaacaa

SEQ ID NO: 546239 - DNA, 281 bp, Homo sapiens
agttttccatttgggggggggggggggggggtgtgttttattaacccccccaaaacggactgcgttttttttccctttataaaagggatcctgaaatatgccaattaaaatatttattttagttaaaagccgctaaaaagccccccccctccctgaaggtttttaatatgttttgaaacccttaaaaacccccggggaggtctggataatttttaaagggcccccccccctaccaaatggcccctcccccccccgattaaacggggtcttgaaggttttta

SEQ ID NO: 546240 - DNA, 437 bp, Homo sapiens
  misc_feature (7)..(7): n is a, c, g, or t
  misc_feature (79)..(80): n is a, c, g, or t
gctcggnacccatccttccctctttcacgacgtcgccccaccaacatactaggctctagacacacaatttctttcaggnntttttagtcagaggcctcgttctctcccaactctacaccttcacatatgccatcacttttctctggaacactcttcccttcccctcacctgggagaacgctatcttcttctggtctctaggaagctttctttgactccacatgtttggttaagtgccctctttgtgctctcaatagcacactgcagactgaatagcacactgtactgcagagggtcatcttagacgtgtgtttcttccagcagtctataagtgtgtcaggtatgtcccccacattcaacgaatactcttcaggcaggttctcctaacagtcagcaagacataaagtctttgcttttaaggagactgcttgcttacca

SEQ ID NO: 546241 - DNA, 481 bp, Homo sapiens
atcaccgaaagccagtttctaatcatcagacgaaggcaatgagaaccagcaaagagataccatctcacaccagtcagaacagctttggttaaaatgtcaaaaaatgagaaacgtggtgaggctgcagaggaaagcagacacttgtacactgtgggtgaaggtgtaaattaatttagcgtaggcacagtcagttgggagatttctcagagaactaagagtggaactaccattagacccagcaatctgatggctggatatacggccaaaggaaaataaatcattctgccaaaagaacatatgtacctgtatgttcatggtggcaccattcacaatagcaaaaacattgaatcaactcatgtgcccatcagtggcggactagaaaagaaaagaaaatatggtacatagccatcatggaatactatgcacccattaaaaataatgaaataatgtctttgcaacaacatgaatgtagctggagggc

SEQ ID NO: 546242 - DNA, 159 bp, Homo sapiens
ttggctagtggggggttggaggaaagtggggatgataatgggtacaaaaaatagaattaataagacctactatttgacagcacaacagggtgactacagtcaaaaataattttttcgttttgttttatttgagatagagtctcgctctgtcacacaggg

SEQ ID NO: 546243 - DNA, 489 bp, Homo sapiens
  misc_feature (407)..(407): n is a, c, g, or t
aatgtatgtaaaaaacaaacagcaaaagtctccacaaccaggactgatggcttcactgctgaattcttcccaatattaaaaaaactaatacaggtcaggcatggtggctcatgtttgaaattccagcactttgggaggctgagatgggaggattccttgaggccaggagtttgagacaagccaggtaaacatagcaagactttgtctctacaagaaatattttgaaaattagacaggtgtgatggcacatttctgtggtcccagctactcaggaggctgaagtgggagaactgcttgagcccaggagtttgaggttacaatgagccatgatggtgccattatacaccagcctgggcaacagagaaaaagcctgtctcaaaaaataaaaaataaagaactaataaggncgggcagggtggctcatgcctgtaatcccaacactttgggaggccgaggtggggggatcacctgaggtcaggagttcaagac

SEQ ID NO: 546244 - DNA, 437 bp, Homo sapiens
  misc_feature (20)..(20): n is a, c, g, or t
  misc_feature (347)..(347): n is a, c, g, or t
  misc_feature (437)..(437): n is a, c, g, or t
cgaaacgcttatgcccatgntcgtcttaccccttcctgctttgctgtggtatccattagtctgttctcgcgctgctaataaagacatacaaaagactgggtaatttataaaggaaagaggtttaatggactcacatttccacatggctggggaggcctcacaatcatggtggaagatgaaggaagagcaaagggactttttatgtggcggcaggaaagagagcttgtgcagggaaactcccatttataaaactgtcagatctcatgagacttattcactaccatgggaacacgtatgggggaaactgcccccatgattcaattatctccacctggccctgccctttnacacgtgggggttattacaattcaaggtgagatttgggtggggacacagccaaaatatatctggcatatgcaatctgatcaccccttccn

SEQ ID NO: 546245 - DNA, 205 bp, Homo sapiens
ggtgtgaggagtccgtatatgttggattttaggtgtggtgttgagctgacgcttcttatggtggctgctttaggctactatggtgtaatttacactctctctacaaggtaaaactagtgtcaagagctgttctctttgactacgtaattcagggttaggggcctggcattaagttactagtctctgcacgttcggcgggtttccc

SEQ ID NO: 546246 - DNA, 400 bp, Homo sapiens
tatcacgtgtctattgggtgtctgtgtgtgtgtctctgcgcgctatcttttattctccctgtgggcatatgttgtctctttctgtgtgtcacgggccagattttatcagtctatgcacaggtatgtgttagcatttacataggctatagtattcgtttatagtggttcaggtatagtatatttctaattttcgctcatgctctcaggtatctccttactttgtctgtagtgcgtcttttacatgttgatatttcttttgtatattctcttgtttggtcctgtttttatgtgtatatagatatttatagatatatatatagagagatagatagatatagagagatagagagagagagagagagagagagagagagagagagagagagagagagagagagag

SEQ ID NO: 546247 - DNA, 271 bp, Homo sapiens
cggatcctgaacggtctgttacccagtgcggtttatcggcgcctgggataaaaaaagctccctttttcagctatatccggtatagtgcgcgccgtgctttaaccgggccgcgtataggtagcgcaattccccgaagtcagcttcggctgcacgtccgcacagcggactcttccttggacggaatctttttccatttcatttcggtttttcgcaaaatcccccggccgaacaaatgcagcccagggcggacttctttggagtctcaaacact

SEQ ID NO: 546248 - DNA, 596 bp, Homo sapiens
aagatgggtcctgctgtggttatgttaacatcttctaggtaacaccccaaccctaagaagtcatgtgaaatcttacagaagagctgctaacaatcaagggcatgaatactgctttccgaatttcactaatattggccagctccttttagagttgccctggaacagagaaatttacagccaactgtaaatcagaaatgtcagtttgggctagggggccatgatccaatagtggagcaagattaatagaataatctatacgtattttaaagtatactcatctataaagaatagaattaaacttttattgttataatattggcctttggttatttttatcaggttttaaaaataaagatgctgcataatagcaaattattactaaacatttatattggccacaactgtcataaatccagagtaatggaaggaattcctatctttgcctttggattttattttatttttttgtcccgaatttgccgttgaaagaatttttgtgaactttccaatgtgcatagtatatatcaagatgcaataaattcaaaagaaataaaagagaaacagcataagattaccaaaaaggagggacccactcg

SEQ ID NO: 546249 - DNA, 1053 bp, Homo sapiens
  misc_feature (158)..(158): n is a, c, g, or t
  misc_feature (226)..(226): n is a, c, g, or t
  misc_feature (233)..(233): n is a, c, g, or t
ggggcggagtgtggaacttcttctcgggaggcagtgctgggtcctttccaccatggcacctaagaaagcaaagaagagagccgggggcgccaactccaacgtgttctccatgttcgaacagacccaaatccaggaatttacaggaggccttcactatnatggaccagaacagggatggcttcattgacaagaacgatctgagagacacctttgctgcccttgggcnggtgaangtgacaccatgcaccgcacactcgactgcaaactgatcacggaggctccgggctccaattaacctttacctgtgatcctcacaaatgtccgggaggagcacaaccttcacgggcacgcggacccttgagcgaaaccattctcaacgcattcaaagtgtctgaccctgaacggcaaaggggtgctgacaggctgactcacgctccgggaaatgctgaccacgcagcgccggagaggtccccaaggacggagcgcttgacccagattgttcgccgccattccccccctgacgtgacctggcaaccttgcgcactaccaagaaccctggtgcacatcatcacccacggagaagacacggactacggagggggcttcgcttgcttgcgccctggggctccgtctttgcccgagtggttccctggcctcatctcctctcccccgaagtacccgctcttgtcctaccttgtctgtacgccatgtggttgcccctttatccactccatcttctttgccgcctggccgccatcggcactcgacggccgcacatccaaaggtggaatcccaccagaaggcatgttcaataaacgcacgccgcgtaacaacacaaccaacacccaccacccaccacccacccacacacacaacaacaacaacgagcacccaagccacacccccaccgcgcccactaaaccatcaccacccgccgtgccaacgctgctacaaaacgccgcggcacacagtccgtcctgagcccacccgcctcacgcgccgcaccaaccaactgaaccgtcacgcgccccacacggcaccccaccaccagcc

SEQ ID NO: 546250 - DNA, 922 bp, Homo sapiens
agcggagctgcatccctaccccgccctctcctttctccgctcctcctgcttttctacccgtcgtcacccgggagagccggagggggctaagttcgggtggcagcgccgggcgcaacgcaggggtcacggcgacggcggcggcggctgacggctggaagggtaggcttccttcaccgctcgtcctccttccccacaccggagcgggcactcttcgcttcgccatcccccgacccttcaccccgaggactgggcgcctcctccggcgcagctgagggagcgggggccggtctcctgctcggttgtcgagcctccatgtcggataatcagagctggaactcgtcgggctcggaggaggatccagagacggagtctgggccgcctgtggagcgctgcggggtcctcagtaagtggacaaactacattcatgggtggcaggatcgttgggtagttttgaaaaataatgctctgagttactacaaatctgaagatgaaacagagtatggctgcagaggatccatctgtcttagcaaggctgtcatcacacctcacgatttgatgaatgtcgatttgatattagtgtaaatgatagtgtgggtatcttcgtgctcaggatccagatcatagacagcaatggatagatgccattgaacagcacaagactgaatctggatatggatctgaatccagcttgcgtcgacatggctcaatggtgtccctggtgtctggagcaagtggctactctgcaacatccacctcttcattcaagaaaggccacagtttacgtgagaagttggctgaaatggaaacatttagagacatcttatgtagacaagttgacacgctacagaagtactttgatgcctgtgctgatgctgtctctaaggatgaacttcaaagggataaagtggtagaagatgatgaa

SEQ ID NO: 546251 - DNA, 339 bp, Homo sapiens
ggccctttttgcccccagggggcctttgggggcctttgggcctcctttaccggggggggggggggcccaaaaaccaatggggtaaccccctgggggggaggggcccagtccccccgggtgtttttgggggggggtttttaacccaagtttggggggggggggttcgggggggcccccccctgccctttgttcgggaacggggccttgttaatgggggggtccccccccaaaggggtttggggttttgggtttttttcggggtttgccccccccccgcccccggggggggggttaatgaaataattctggttttttttaaaaaaaaacacacaacacaca

SEQ ID NO: 546252 - DNA, 1104 bp, Homo sapiens
gggacggggcggggagtagtgggggagaatgggaggacgaaggggaggggaaaggacaggtgaggggagggtaaatagtgggccaggcaggaagatggcggcggtagcggaggtgtgagtggacgcgggactcagcggccggattttctcttcccttcttttcccttttccttccctatttgaaattggcatcgagggggctaagttcgggtggcagcgccgggcgcaacgcaggggtcacggcgacggcggcggcggctgacggctggaagggtaggcttccttcaccgctcgtcctccttcctcgctccgctcggtgtcaggcgcggcggcggcgcggcgggcggacttcgtccctcctcctgctcccccccacaccggagcgggcactcttcgcttcgccatcccccgacccttcaccccgaggactgggcgcctcctccggcgcagctgagggagcgggggccggtctcctgctcggttgtcgagcctccatgtcggataatcagagctggaactcgtcgggctcggaggaggatccagagacggagtctgggccgcctgtggagcgctgcggggtcctcagtaagtggacaaactacattcatgggtggcaggatcgttgggtagttttgaaaaataatgctctgagttactacaaatctgaagatgaaacagagtatggctgcagaggatccatctgtcttagcaaggctgtcatcacacctcacgatttgatgaatgtcgatttgatattagtgtaaatgatagtgtgggtatcttcgtgctcaggatccagatcatagacagcaatggatagatgccattgaacagcacaagactgaatctggatatggatctgaatccagcttgcgtcgacatggctcaatggtgtccctggtgtctggagcaagtggctactctgcaacatccacctcttcattcaagaaaggccacagtttacgtgagaagttggctgaaatggaaacatttagagacatcttatgtagacaagttgacacgctacagaagtactttgatgcctgtgctgatgctgtctctaaggatgaacttcaaagggataaagtggtagaagatgatgaa

SEQ ID NO: 546253 - DNA, 103 bp, Homo sapiens
ggaagtcagattcgggttatcttgaacagaaacaaactgacattctaggcagacagttgtctatgtggtctgagtggtcagcacgtctgttagtactccttcc

SEQ ID NO: 546254 - DNA, 923 bp, Homo sapiens
gggaagcggcgagtctccatggcggtggtggcgtgcagtgtggcgtggacccgtgttctggaggcgactgctgggcctcctgcctggtctgcccagggctggccgcgctcctggtgcgcctgtgccgaatcgcgctcggttgggaactcgggaccgccgagcgccatggtgggtcctcatggctgttgattgcggtccccttgctgtcctccgagtgttctgcccaggtcgagtttccctcatcattggttggctgtgtccagcaatggttgtgctaccggtttcccagtcggcttcatgacatatcctggtttcgcaccaccttggggatgtctcgcagtttcttcaccgtttggggtgctatctctttgcactccgggagcatgttcaacggagcctcgtgcaatggggcatgtatcacaagttagccaccgaagtgccgggttccgtgatgggccaatcccctcttaccctggggggaccagcgtgcctttgaagacagggagctggtggtacctgcctggagagtactctagcaccaaagtcactcacgagcatgggtttccttcgaatctcacggtctgccattctctttagactgtcctcgcggggctgcacgaaggcggaagaactcccgcgattattgcttgttccgactcctgcggggttccgagacgggggtccgggtctccctcttgccaggccggacttccggggtggtggggtccctcttgcctggagcggcttacgagacatcgcgttccggcacttaaggtgtccccttccggaagcgcctcttgaggggggactggagggacctgcttccccacgcagggcggaggtgttgcgacgggggagccgctttccgcggggccgggatgtctccctgggggcacgggggggggtcaaggggctcgcccctg

SEQ ID NO: 546255 - DNA, 990 bp, Homo sapiens
agcggagctgcatccctaccccgccctctcctttctccgctcctcctgcttttctacccgtcgtcacccgggagagccggagggggctaagttcgggtggcagcgccgggcgcaacgcaggggtcacggcgacggcggcggcggctgacggctggaagggtaggcttccttcaccgctcgtcctccttcctcgctccgctcggtgtcaggcgcggcggcggcgcggcgggcggacttcgtccctcctcctgctcccccccacaccggagcgggcactcttcgcttcgccatcccccgacccttcaccccgaggactgggcgcctcctccggcgcagctgagggagcgggggccggtctcctgctcggttgtcgagcctccatgtcggataatcagagctggaactcgtcgggctcggaggaggatccagagacggagtctgggccgcctgtggagcgctgcggggtcctcagtaagtggacaaactacattcatgggtggcaggatcgttgggtagttttgaaaaataatgctctgagttactacaaatctgaagatgaaacagagtatggctgcagaggatccatctgtcttagcaaggctgtcatcacacctcacgatttgatgaatgtcgatttgatattagtgtaaatgatagtgtgggtatcttcgtgctcaggatccagatcatagacagcaatggatagatgccattgaacagcacaagactgaatctggatatggatctgaatccagcttgcgtcgacatggctcaatggtgtccctggtgtctggagcaagtggctactctgcaacatccacctcttcattcaagaaaggccacagtttacgtgagaagttggctgaaatggaaacatttagagacatcttatgtagacaagttgacacgctacagaagtactttgatgcctgtgctgatgctgtctctaaggatgaacttcaaagggataaagtggtagaagatgatgaa

SEQ ID NO: 546256 - DNA, 680 bp, Homo sapiens
  misc_feature (84)..(84): n is a, c, g, or t
  misc_feature (259)..(259): n is a, c, g, or t
cttggcgggccgaagaacaaacggttggggggtcttgctctttgtagagaaggcagaaaaagcctgccagaagctgcagagcgnctggcggattaatataaagatgcccaatatcgtccaggagccctcatgtacacagtaaaaccggttttgggaagtgtgcggagtccacctcctgttctgtcagccagcgagaaaaacatagagaaggaactgccgcccctcaatgatcaggtccgtcccctttccaacggcatcnaaccggtggacattaagaaagatttcccgaaaaagcagatggacgcgggagcatttccgggtccctccagcctcccttttaacgccccccaaaggaagtgtttgcagggagtgcttaaaaaacaaggagagcccctcgctggccttattaagcagatcaagggcctccaaaaccctttcaggttttggccatccacggttcagagggccttaccaacggcccttgggcaggttttcttgaaatccccgaagaacccataagccactctatagcccatgaactttttttaaaaaaaggggttggcccccccccctcccctttaggtgccaatttttggatgaactaattttgttttttatttttatgaggggatatggccctggtttatttttttgggcaaaaaaggggtttggtcctttga

SEQ ID NO: 546257 - DNA, 914 bp, Homo sapiens
  misc_feature (176)..(176): n is a, c, g, or t
tggaccccccagcctgctggtctggccagtggggctgaaactggcagctggccggcccatttaacacctaccctgattgtgctgacactggaccacccatccctggtggtgcccagggtgtgagcctcatgactgtggcccctaactgggccatcatgcggtggggcctgtgccantcccgccagtcctcctccatcctcgctccctggctccgcacaccgagcccagaggtgccacccatgccctggagtgcttgcgacgcccactgcctcagagccccatgtctggtctccccgatcctagtggagcattggatccgaccccgtctagccgcgagtgcgtagagggcgctggacctgcgcacccgatgcacggcagtcgacctgtacggcggagccgctgctgccgatcaccccgaccgcgactacaggccagacaccggcgtgtccgtctgcgtgccagcaacagcgcccgcgatgggtaggtgcgagcggcctatgtctccacctcgcggtacctccccccacccctgcctctgctcccttctgacaccaaccgtagacggcccgctccgctaggcgcctctctccgcccgtcccgcggccaaccccaccctcctactctggtgcccgctgccccctgcagcctcgcactcctcccgtcgcgccccccgtccccgctcggaccctcgccacccaccacacacagcgcagtggctactcccgccggccgcgtcggccagcagcaacgcccggccgcacggccgcgcgcgtcccgcccgcgcgcccatcgcccggccctcccggcgtgctcccgcgcgccggggggtggggcggctgcgcacggccgcgcccccgcgactgctgctcctggactcgcgctcgacgggctaggcgccgtcgcgcgggtcgcgc

SEQ ID NO: 546258 - DNA, 124 bp, Homo sapiens
gacagttatgcagcagactccactggttcagcccctatgtagctacaacctaaagccttctgacatacactacactctccccacaccttctggttctctggtccccaaaaactacacagcttcc

SEQ ID NO: 546259 - DNA, 555 bp, Homo sapiens
  misc_feature (14)..(14): n is a, c, g, or t
  misc_feature (20)..(20): n is a, c, g, or t
  misc_feature (28)..(28): n is a, c, g, or t
  misc_feature (43)..(43): n is a, c, g, or t
  misc_feature (65)..(65): n is a, c, g, or t
  misc_feature (75)..(75): n is a, c, g, or t
  misc_feature (140)..(140): n is a, c, g, or t
  misc_feature (199)..(199): n is a, c, g, or t
  misc_feature (288)..(288): n is a, c, g, or t
  misc_feature (312)..(312): n is a, c, g, or t
  misc_feature (400)..(400): n is a, c, g, or t
  misc_feature (522)..(522): n is a, c, g, or t
  misc_feature (541)..(541): n is a, c, g, or t
aacgtgggtggggntccctnctgggtgncgaaaatttcccggnattttcccttggggttcttccnggttaggagncttgtaaattcaaattgttgcctgaacaaaccacagggaagcccaaaaaacctgttatattcatncttccgtggaaagggggattcaaaggggacgggctgaaaccaggactttcccccgctgnctgggtgtgggtgacatggtgtatgggccacagttcaaaggaaaagggcaaaaacccaggagcttcaggaaaaaaggtacattcccagncagtggttcatttcgaccaaacgnaaaagttcattacccgttaggaaaaaaggatgggcgtgtttctttattttgaaaggataaatgccagggagttcattagtgaaaccanattataaagggcgaaggatgaaaaggttctgccccattaccagggacccagttaggccaaaaagggagtgtgccagacttgtgggcccccccggattgcatcccaatgctggccagcatttncattgattcttccagtatnatttgtaaaaaaaa

SEQ ID NO: 546260 - DNA, 150 bp, Homo sapiens
aaagagttcctgaggaaaggcttcaggacaatttagatcttaaaagagctaagaagggaaagcctaaaagagaagaccctcaaaggcattcctgcctattggctgattgttttaagaatattacaagatcgggcctctgattcagagtat

SEQ ID NO: 546261 - DNA, 443 bp, Homo sapiens
acattgttgaggcagtgagaaggataggttccctttattgaatgttttttgtggaaacttagtttttcaatgcttcataggcctaaatcagtgtgcactactttggacattatccttggaagaaggaacagcttttcttcttctggcaccacagtgtatctgcatttgaatttctcccattgtgcatgagcacctcatgggccacaaagatgcgctttgagagcaccctgagatgaagtttattttaaaaggaacaacaaccaacaccaccaccagctccacaggggctgtccagtgtacattattctcatcttcttgggttattagtcttgatttttagaacacagtttggaaagtgctaatttagaatattaatgtctttatctttaatttaacttttcattctgtacacataactagcttataaacaattttgtttcaaa

SEQ ID NO: 546262 - DNA, 297 bp, Homo sapiens
  misc_feature (133)..(133): n is a, c, g, or t
  misc_feature (139)..(139): n is a, c, g, or t
  misc_feature (250)..(250): n is a, c, g, or t
tgctgacaggatgcatgtgattgacgtgaatcccttcttctaattcccttccctgtgtaaaactgatgtggcagattgtaggactttgtaatggttgtaaatagttggtttcttgaaaaaaaaaaaaaaaaantatttncaatttatattttaaagatgctgaaggaaatcctgacagtttacaacatggatgacctttgaatacgttgcgctgaaacaggccagtcacgaagggacaatttttgtatgntccctcttgtatgaggtccccagagtagtcagaaagtaggatggtgg

SEQ ID NO: 546263 - DNA, 324 bp, Homo sapiens
  misc_feature (37)..(37): n is a, c, g, or t
ggtgcattgtgtgccttcgtgttactgcttcaccttntcatgtatagggcctaactgtaatacatttaaatgttaagcctccaccccaaggtgtaacatgcatgcatcaggactgccttcatgaatattcatgaatccacctgtagcctgttgaatatgtatacttggccaacccattcaatttaaatttctgtcttactcttccttccctagaagtgcctgcctccggtctttgctggaggttacgctttctagcctgcagaatgaccaccttgtaggctgtaaccctttgtaagaaataaagtatcctttccaaatgcaaaa

SEQ ID NO: 546264 - DNA, 1033 bp, Homo sapiens
gacaagtaggtaggagtcaactaatcccctccttcccctttacccttcccttcccgggagaggctgggagccggcaccaggcagtactgtggccgctgaggactcagctaccgactgtagtcaggttgcggagactccaggccgattaccagggcgagtactcctgattgtgacatcacattcatcccctgttgcgatggagcttgtccactgggaaggaatactcagacggagaatagccaacaagatgggttcactgggagaatctcttcagatggcacctgagtggagggcaatcagggggttggagacttgatgaacatggaacctgacccccaacacttgtgaagggccctggagtaacagtgatgagacctggggtatgatgtaacccgtttcaagggccggattgtagacgcaagcatctatcgtcctgccctatatagcagtggaagtccttgggaagagacagccagcaacagaccagcttatcgatacagccatgcaactctcacactatgctgtgcacgctgacacagcttaataggatcattgctcctgcaagccattagccagaccagagacacgcggtatcatcctggcgcaaagatatcacggaagaagctcacgattacccaggcactacattgtccaacatgattctctgcaaagcatgatccaccaagtggtgctctcaacagcagacatgtcacgtgaaccgaagagaagtgacggaagccatttgacgaccgatagctcggacatgcggagccaggtgacaggatgagattgactgtacaaagctgagtacgagtgtgtgcgtgacggatggcaccgtgatgccaccaaagaaaggagaacacgaaggatgtactgtaaagtgggacggagatcccagagaagccacaaactgattaactgatcagacacaagacataatgagaacatgacaacagtgggaaacaagtaaatgaagaaccctaatgagtagatgtacaagaggatctacacatgtttcagcccatctttaaag

SEQ ID NO: 546265 - DNA, 143 bp, Homo sapiens
  misc_feature (47)..(47): n is a, c, g, or t
tgacactttaagcacatggtactctggggctgtgcagtggcattatnttgaattcctaagctggcagttcttgtgcgcgacagcaggtttgtgtgtggttgatctgcttcacttgagagaatgaagagaaagatagcagagac

SEQ ID NO: 546266 - DNA, 371 bp, Homo sapiens
gctcgaccgcacagagagaccgttttttccttcagcgcctggggagcagccaggttccatgagttaaatgcagatctgaaccaagctgggattggggtacacactctcctctactgaaaagtagctagggattccaactaggtgagaaggagagtggggcagagcagagccagacaaggactgatcacctggaaaaagcctgccatcaaaggtcttggcaaatgctgggtgcagtggctcactcctgtaataccagcactttgcggggctgagacgggtggactacttgaggcggggagttcgagtccggcctgggcaacatggcggaaccacatctctactagaaatacaaaaattagctaggcatgcta

SEQ ID NO: 546267 - DNA, 392 bp, Homo sapiens
ttccaatttctccacgttatcaccaacacttagtattttccattttttgagaatagccatcctaatagatgtgaataggtatctcatggttttgatttgcatttctttaatgattagtgacgcagagcatcttgtcatgtgcttaagtcatctgtatatcttttttggagaaatgtctattcaagtcctttgctcatttcttaattggatttttttgtttgtttttattattgagttgtaggtatattctctatatattctgaatattaactacttaccagatatatgatttgcaaatatttttcatttattctatgaattgctttttcactctgctggtagtgttttttgatgcacagaagtttttaattttgatgaagtctaatttgccc

SEQ ID NO: 546268 - DNA, 288 bp, Homo sapiens
  misc_feature (78)..(78): n is a, c, g, or t
  misc_feature (135)..(135): n is a, c, g, or t
  misc_feature (158)..(158): n is a, c, g, or t
  misc_feature (166)..(166): n is a, c, g, or t
  misc_feature (177)..(177): n is a, c, g, or t
  misc_feature (180)..(180): n is a, c, g, or t
  misc_feature (186)..(186): n is a, c, g, or t
  misc_feature (223)..(223): n is a, c, g, or t
  misc_feature (225)..(225): n is a, c, g, or t
tactactactaactcgagaattctggatcctcggcccgggccgagtccacatcattcctgtctcacacccagcaggtntgggccacctggtcccctgggaaccaaaaaacggccttcaacctcccaaactctagnattcctcaagggcatcaaattcnccttccancctgggctganaanactganctgggatccttctgaggtgcaaccatgccaggcctanancacggttctcaacctgaggatccaaattcctcgattatatatactccacccggggattcccgg

SEQ ID NO: 546269 - DNA, 954 bp, Homo sapiens
ctccctgcttcgctctctctgggttctctcccccccagtggtgtgtgttgtccttcctcctctcttgtctctcttgtcttcatgtcgcgcgtttgtatatttttcctcttcttctcttgtttgatccttctctctcctctgctgtcgtcttgtcctgtcgcttcttgttcttctgttcattctttcccttcctgctcctctggtgtgtttttcttgtcccgctcatgctctcgtgtggtcctcgctcctcgcttgccaccttcttgttcttcttccttccgcttcgtgtggtgcgccgctccgcttctagtttcctatcgtcgtcttttcgttctttagtagtgtgtctcggttggtgctcacctgtgttctgctctgtttgtgtatgcctccttctcgtcacgggttgtgctcacccctttgttggtttttctcctctctctcttcgtagatgtttttttctttgcctcttttttgtttttttcgtctgtcggtacggttcttttttggcatgacgctccttttacgtgcaaccgtcaggatctccttggtcgactccatctcacgccggtgttgaccgttctcttgtattgtcctccggtccgatccaggacttccggccctctcgccttgtctcgcgctgacgtgattacgactttctcctctggttgttgcagtctactgaccacgtttaggtcgctagggtgtagggtgtacagcttattgggcccccacgattttggttctgttcttgcgcacgtgcctggtgctcggtctcgggagatcttccccgctgcactcctccgctccgtcgttctattgtctgtttccgtttctcatagatcttcgtctccctccctgcccaccaacaaaagaaacaaaaagaatatcaaaacagaaataaagataaatataacaaacaaaaagaacaaatcattgaatacaaaaaaaata

SEQ ID NO: 546270 - DNA, 247 bp, Homo sapiens
ggatttgctggtgcagtacaactaggcttaatagggacatggttatgttttattcctcagtttatacatttgattattgtaccaagcagagtacctttgaaattttttttcatttaaagaatatggatcttggctcaggcctgtaatcccagcaaatttggaggccaaggcaaggggatcacaaggtgaagagatcaagaccatcctggccaatacagtgaaacgctgtcactactaaaaatccaaa

SEQ ID NO: 546271 - DNA, 636 bp, Homo sapiens
tcccgcctttacgtatgggtgcacagcctttaggtaggcacgctactgcatattacctgtctgcaggctattcagagtactccaaccattaaggattactcacgtctttcctaagacaacgcacacgtacaacttcatgcacagctaggcgtctcaggacagatacttctcgctacttaagttgactcactcgagaaagtcctgagaacccgcaatgagaagcatgcagacagctccaacagcatcaacgtgctcaagctatctgctgaacgacactagctgtgcctgcaactgtaacagaccatgtatgcctcgcagagtgcacagacgtgactgttgtcatacgtccaagtatagctatagaggtagacgcgacattctgagcgcgagtctgaaaggatgctaaatggcgcatttggacctgttgagttccagatacagatccattgtcgctaatttacgactgctaatacgctaacaccatgtgctcatcaagcttggttttaactagggtcacatgcacatgacctgctggatagtactgctaagggcctagtctccatgtctgatgagcattagcccattgatcaacaggaaggactagggagggtggcaacttaaggctagagtgcacgg

SEQ ID NO: 546272 - DNA, 152 bp, Homo sapiens
aacccatatgattatagaaaaatcatgtggcagctacactagagatgtccagcccaaggctatgggccgttgctcccgttccttttcccccccaaatcccaatattgactccacagaagcgtataggcttagagaagttctagctacaagac

SEQ ID NO: 546273 - DNA, 737 bp, Homo sapiens
gggggggggggggttttcccaaaattacagttttgggggtgtgatccaggatgaccatttcccatttttaaaaaaaggtgtcccagttctgttttgataccggtctccttttcccgtgaagttcgggcaccccatgggttgacacttgcaaaaaatttgggattgatctcacccattggacaattctaaacaaatctcctacaagtcttgggtgtgggaatatctcccattggtaatacctctgattaagttaaggataatgggtctctagaatggaattctcaacagagtcagggcactcatttaaaattaatcctggtatttccagaacaattggtctggtggtgggaaacctttttatcctctatagatccatccctaattgcttaatggtggtccttgggttatatcagattcaaattacagaaataaatgggtggtggggataatggtggtccctaaaatggctccattaaatttttatttacagtttggaaaaagagggaccgtgtaagagaaatggggcacaagtaatttttttgtcaaagacttcttttagtaataaaccagcgagtggggcaaaactcggggtctcatgcgtcacacggaatagttctctaaacagctacgttaaatataggggtggggaaaacaggctagcccttccaatttaattgaatttttccattagtggtggcaagcctataacctgtgttattacaaagaaacccttgttt

SEQ ID NO: 546274 - DNA, 527 bp, Homo sapiens
  misc_feature (226)..(226): n is a, c, g, or t
tagagacgtatcctaacagagtgctggatacaggctgagcactgtgccggctatttttttattttttgctgctgagaaggggatattggtctggtctggaaaaggatgggggaaagaaagatgatggattataaccttgggtgtaggtacactggtcagtattatttattcatcaacacaaagtgtatgccagtccctggaggatgcaggacaggagctcagagcnctatcttggacgcaaaaaacatttggatatcagggccctggagagacaggactaaagaaaatgctttggaggattcagagagaggggaatctagggaagcactgcctggacagaggaagcatctgtagctcagactgggaaacatacacgagtatggaactgcggagtggcggacagggagggcatcacgtaagccgatggactgtggggatgctcagagtgggtttgaggcaatgtgggtggattcatttgactgatgggaccagagagtaggtcaggaggtcttgagaattagactggt

SEQ ID NO: 546275 - DNA, 1311 bp, Homo sapiens
tgggagcagccgagactttcaacagtttcctgcgctcgggcacaacaggagacacagtcaggtccccacagagcgaagtagtccttgtgaagtgctgctcagcaacgcggcagaaagttctaggttcaacgtgtctaatcttacagatcagcactgaggatagtcctggcaggcctgctagcttgcctacagcctggcactctttccacgcactgtacctctgcacttggcactacctctctagcctcctacttctatagccttcgcatgcaacacatacgtagcgactggcacgccctctttcgttctctgctacccgcgcacacgcttgccaacgcacgcttctgcagcctgcccttctactgctgctcctgctccaccccagcccgtctcgcggacgctctatagtacgcttctacagacctctgctgctttatagcgcacacgcagtttcactctggcgcacctcctggcccttacttgctactggcaccgaacctgcctcccgttgcgcccgcacacccctgcggcctctgcgccccgtgccttccccttggcctttctacttgccttccacgtaaccgtgccttcttccccgcatcttcctctcgcacgcgtccgcttgcggcttgcgctcctccttttcgtcgcctcgctacctctattgggtttctccctccgctccaaccccgctgccccccgaccttcgcatacatttcttacctggtcccccagcccagctagcgcaggctccttgcccaccgcccaccggggcagatttttcgcgttgtcaacccacctttgggttcgcccgcggatcgcccttgtccgccccctccttcattgggtccttacttttggccggcgcttttggcactcgcttcctggtcgcctcccgccccttgtatctcttctccccccacgccacacactcgcgcccccccggctctccctgcccgccctggcgcggccggcggccgcgtccccaccccccgccgcaccccctccatcgcccctgcccgtcttttcttgctccctcgctcctggccccctccgcctgttcctcctcggctgcaaacgggctcctctttcccggcggcgtttacccgccgcgttcatgcctcccttggccttgtcccggcggctttctcccttcctttccttgctgctctttttgccccccacatgggtatcctctctgctactgctagggctcaccgccccctcggcttcccttagccttgattgtctgtgccccttgggacatgctcgctgcctctcctccgtctgcctccctcactctctcgcccc

SEQ ID NO: 546276 - DNA, 330 bp, Homo sapiens
gctcttggctaattttggtatgtagggtagagatgggggtttcaccagtgtgggtcagggctgggtctcaaactcctgacctcaggtgatccacctgcctcggcctcccaaagttctgggattacaggcgtgagccactgcgcccagcctgacaaaagtgattttaaagaaacattaaggtgatgattatgtatacaatggattagaaattatatcaactcctaatttatttataatgtagcatagtgtcatggcctaaaggtctggtatcctgtgttcttataaacaatatccaagtgaatgtactaaataaaatgggtctggtgaaaa

SEQ ID NO: 546277 - DNA, 225 bp, Homo sapiens
cccggccgccgctacgtgacctactctacaagcgcacccccgctcgcctaatatctgtctgcagcacgtcgccgctagagatatgcagcgccagagccgaggagaacccccgctccctgatgaggacctgtccaaactcttcaaaccaccacagcacgactgccaggatggactacgctgctcattgcaggccagataaacacttactgccagaacatcaaggag

SEQ ID NO: 546278 - DNA, 996 bp, Homo sapiens
gtaatcagaaaatactgccatcgatcattatttagaagcccttaaaggtcagagacagatcaccccttcgcacaaactgacaagtgctctgaagaaatgtctaccaagagacttggtacaatgctttagatgtgcagagtttaagtgccctagggttgtttacaagctggaaggagaaaagaggaagcgtgtgagtactatgagaaggcacaaaagatagatccagaaaatgcagaattcctgactgctctctgtgagctccgactttccatttaaatacatactctaggaaattagctctaagtttttcccttcatttgggttctcctgttgttgtatttaaacattatttaaaatcccttgtttatttatagagctaatatttattgaatagttattgtgtaccaagcattgttgctcaaatactttatatgcattatgatgaatcttgtgcggtatacttgacttgtttaccttttattaattaaaatacgtataatccatgagaaatagccaatattctagctatgtacctttctaaaaagtggtatggcattagatctggcttgttatctcatgctcttagaattctcatattattatagtcactatatccctaggtaaaccttgataacttagatcagagaatactcttccaggagtaccacaacttacattatgaacagcatcagcctctttctctgtggttcgcctggcaacaccacaggcaatcttccctcacgcatggctggacttgaagaagcaacatcaacacataaacctatagtcaccgtaacatagtcgaggtaggccccagacatactcaacaagtggcacctaggagtatcagaaacatcagagacacaagaagccaaaaagacgaacgggacatacgcaagcaggcatgaaaatactcaacaaaatccagaacaagacttatatgcacaatacaggagagaaacgcgacactaaacgagaaaacgaaaacgcaaagac

SEQ ID NO: 546279 - DNA, 633 bp, Homo sapiens
  misc_feature (14)..(14): n is a, c, g, or t
aggctgtacggtcngagtttaggatcttctctgctcttctcatcctttatcgctctgctgctcttgcagtgtgacgagtccgaatcctcttcccacccagctcggcctttcttcttgtgcctgcgctgcttctatttctccttcggccgcgcgccactgctgcacatagctggtgtcggtgccgctctttaaacccccaagtcgttcccgcatgctatggcccaggccgcttgggtatttctgctcaatgtaaacacagtccctctttaaaaattccgccgaaaaagaggagacgctttacccgactcttatggtgccgattatctcacggacgaactttctgtagccaagtatacaactatcccaggagggcctaggaaacagtgctgttatagagagcagttcgacttcaacgctgagccaccttgtgaacctagctgatgataggggggttccatctcccaatttgtccatttgttgcatattctaaggacccagacataggcttgatggcccgtatcttgtctttgcctggtcttatgacttacggcttgtggaactacggtgcgatgaaaggctggattcgatgatgcaaactactccgttggcctgttggatgaaggaacaaacctg

SEQ ID NO: 546280 - DNA, 869 bp, Homo sapiens
  misc_feature (639)..(639): n is a, c, g, or t
gtcgatgtttcctgcttcaacagtgcttggacggaacccggtcgctcgttccccagcccggcacgaacgcccatagtccagaccctccgtcactctcttcgacctgcaccctcggcattgccacacttatatggtggcgccctcggcgcagccggcatcctagccagaccgcagctaggacaacccgtccgtccgcctgttcggtgcaatctcgcgttatgcgtcgtactggtcatggatctgacaccgcgggtacgaaccatcctcaattgtgctgagctcaagacagcgtatcgcagacatggcacgttcatgacggacccgaagcatgattccagcccaggagtcacatgcgtggcaggcctcgatagcaggccctaccctatcgctttgtactcttagtccaggtgctcatctaacttatcgtatgtagcacacgacggacatgagtcgtaggcatgtatgaaaggacacgtttagctcgataagtaactcttgcgttccgaaccaaagtcatcgattgagggaggaagggagacagtgcttcgaaagacaaactgatagacaagccttggtatcgaatccgaaggcgaaggatgtgacagcaaatccgttcacgttcacgtgtagtagtcgaanggaacaccgagaacgtgttgaatgagcgtgggtagaatgcggggcttgaatgcgagatggaggtcgtagcacttgagctattgttgtgcatatagccattggtgatgttcgatcgtctacatactggggagagttggcatctaacatgtggttaatcttgaggagaaaaagtgaacgacctagttgagtgttgagtccatttgagagacgaacactgtaccctgattgag

SEQ ID NO: 546281 - DNA, 503 bp, Homo sapiens
  misc_feature (354)..(354): n is a, c, g, or t
  misc_feature (365)..(365): n is a, c, g, or t
  misc_feature (416)..(416): n is a, c, g, or t
  misc_feature (443)..(443): n is a, c, g, or t
  misc_feature (489)..(489): n is a, c, g, or t
  misc_feature (502)..(502): n is a, c, g, or t
gacctcctgaacctgggggattgaggctgcagtgagctgtgatcatgccactgcactccagcctgcgtgacagagtcagaccctgtctcaaaagaaacccaaaaaccaaaaataaataaataaataaaaggttccaaaaaaagtttggtctgttagttatgatttatatttaatatgctagttataatttagggagttttatttccttttttttgattgtttttggggtgtgggtaagaacttgtactcagggtttgaatcctagcttccatacatactaattatgtaactttagggaagttatttacagttgagataataatagtattatagtagtacctcctgggaattgtncataaaagatncaaatgaggattattacatcttaacatgttttaacagtgttctgttacaancaattctttttagtttaatatttaccnatttatggattattatattaaattatatttatgggggttttctttnccctaacttaccnt

SEQ ID NO: 546282 - DNA, 239 bp, Homo sapiens
ctggcatccacgcatgggcgactgtcgtaagccccctctccagctgtactactgcgccctgtgctgcttcccatagcaggctcagctatcgtacgtctactttggacgctctgtggattcgcgggctctcggtttgcggaaattccttgacttctcactttgacagcagaccactaattgccttgataagatatctaaaggctttcaaggatctcctgacagtctccttcacctctcca

SEQ ID NO: 546283 - DNA, 94 bp, Homo sapiens
agtttccctttttaatgggcccccccttttcccccaaaaaagcgggggggtgttttttaaaaaaggaaggggaaataaaaaaatttccaagcta

SEQ ID NO: 546284 - DNA, 356 bp, Homo sapiens
caatggaagagataaaagagactggaaggtataaagtccagctgtacttcatacagtgctgttggagataaagagctcttgtgtgtgtagctggatgtacccatcaatcagccaagaataatgtgcaggtgggtaagaggctagcatgaaaggagaggctgaggtacaccaacatagacggaaataggtgtaatgaggagagccatggtaggggtcgtctgagaccataaaggacatacaggatagactaggagtcgctgtgatacaacacttaatacgtactggataccacaatcatagggtacctaacatcatttagtcccatgacacataaataattaactctgcttgatcta

SEQ ID NO: 546285 - DNA, 137 bp, Homo sapiens
tcaatggcatagacgtgaaatgcaggtacacggccgacgagaaagagggtgctgagtatctgcgtaaccctactaattacccggtgttcattcgatttgggcggccccgcctcaattctaaatgagaaagcttacgc

SEQ ID NO: 546286 - DNA, 1003 bp, Homo sapiens
tatggcacatgtttgtcactaatgttgggacaaacgcctcggtgggaacactgggtctcgtgtgttcacgtacggaggccgtgtttgtgaccgcgcgcccgttgtgtaacaaacgcggcggggtgtgacacaacctgctgggtgtgtggttgtctcccgcggccgaagccctcgagttgtaacccgcgacgtgatgttgtggtgcggcagaggagcaccgttttccaaaaggggggacgacgcggctccccgcgtggcaagatggcgcccacagggtggtcacgccgtgtgacagggtgccgccaatgctaccgttgctgtcgattaggcccccccccaaattctccggccccgttgttcactcgggccaaaattattctcccccggggcgaacatatagtattataccgggccgcaaacacccccgcgagcttgaagctgccgaggtgcgggcatgggctacggcggcgtataccctacaagaagcgaacgggttgtatttcacacagggtagcgatggctggacggcaggaacaaggtcgaggcgcccctccaggggaggagccgcctcccgccgaagtatggcgacacaggggaagacacaaaaatagggggacaccacaaatccgtgaggacacacaccccttgggggacgccaaacgcccccacagcgatcctgtggagtatcatattgcacaccactggaggccatcacgtgcggaacacattataaacgggagtccccgcgctatcttctcgcgattcctacaatagttacagtgcccacgtgcggtggtgaatgtccatagattgttgttcccgcgacacctcacctcgagtattcttcgcgcctaattcgcgcccccatagttcatccgcccacaattgcatcaagagcccattcttgccgagaggaaaattatacctacacaagggcactcgctgcatccccccaacgaagcccctcccggggggaccccaaattttttgaaccccaaaacaa

SEQ ID NO: 546287 - DNA, 606 bp, Homo sapiens
aggctgaaggtcaagggggctccaggccatagcatgggccctgcctgaagcctggataggaagctgggattttctcttcaatacgcagtaagtttcttgccccgtggttgccttatctgtagctaggggcaaagacaataagagagctttctcggcggaggttgcagtgagctgagattgagccattgcactccagcctgggcaacaagaacaagacaccgtctcaaaaaaaaaaatttttttttttgggcagagcttggtaacacacgcctgtaatcccagcacttgggaaggccaaggcaggcagttcacctgaggtcaggagttcgagaccagcctggccaacttgttgaaaccccatctgtactaaaattacaaaatttagccatgcttggtgttgtgtgcctgtggtcacagctactcaggaagctgaggcaggagagtcgcttgaccctgggaggtggagtttgcagtgagtgagctgagattacgccattgctttccagcctgggtaccagagtgagactccgtcttaaaaaacaattttttaatgggtgtggctttaactcagcttataatatgggacttcagccgggatccgagctc

SEQ ID NO: 546288 - DNA, 1193 bp, Homo sapiens
  misc_feature (1192)..(1192): n is a, c, g, or t
tggaaatggatgtctcgctctggttgcccaggctgggattggcaattggctcgatctcaacccactggcaacctccgcctccggggttcgagcgatactatctgcctacagcctacctgagtagctggggaccactggtgcgcgccaccagtgcccaacataatttgggatattttaaaaaacagggatttctccagtgttgtggctcaggcgtggttctcaagcatcccaaccgtcagggtgactcagcccgcgtttcggcctcccaaaggtgtttgagaattccagtggtggtgagccaacgggtgcgcgtggccggaataattctataaacctcttacgcctttacgtttgggggactgcacaactgtgaacgtgcgtccagaaagcgaaagcatacctcaaagccaagggctactcccaagcgggacaatctgggtcccagatctcctccagggaagttaagacggggctataaacacagcgggagagagcacgaaaggggctcacggaggcataccggggcccgaggggtacaccgggggaataaagaaggggggaccgagagtggggattaaaaagtcaagtataaggaacttaaaaacaccagggatcccccccatgacccaggcaaatgcggcacagactcccgacggacgataatactggggaccagggagaaacccaagcggcaaaacataggggcgaaaacaacaggttaaggatttccccaaacagcgagaaggagaaccaataatggtgtccacaacgaggggccaaaaaaatataactaaacacggaaaagtgcccaccaagggagacaaagacaaagagaaccccaaggggggaacagaggaagacacaaacagcaaaagacaaggtcgccccacattaggggagaaggacaatcccaagatacactcgacaacgcagaaaggtttgacacccccgagggtgtccagcgggataaaaaagtgtgacaagggatttactgccaggaatcgatagcaaagacacagaggacccaagtgcaaaaaggagagagagcaccacacagaggcggaccgaagaaaaagtggtcgagaggacaagagagacccggagtgaatatacacagaaaaagacaccgatagaaagacagagccagagcacgacgagacgaagcaagcagtgtctgccctgcctcgtcccng

SEQ ID NO: 546289 - DNA, 121 bp, Homo sapiens
tgttcatacaccgtatcccccattctcctcctatccctcaagccccgatcatcattaccgggcttttcctcttataagataaaaagaaaagaaagataagaaaaaagagacagaaaaaaac

SEQ ID NO: 546290 - DNA, 156 bp, Homo sapiens
gacacttaactgacatttaaccaggtatctggggcatccggtggcccagtcaagtggacacataaaaataaccatcattaccaggtttcttaagagaagcctagaaatctatattttaatatagaatttttccaagttttcaatgggctgtagcaa

SEQ ID NO: 546291 - DNA, 202 bp, Homo sapiens
  misc_feature (94)..(94): n is a, c, g, or t
  misc_feature (97)..(97): n is a, c, g, or t
  misc_feature (136)..(136): n is a, c, g, or t
  misc_feature (139)..(139): n is a, c, g, or t
  misc_feature (172)..(172): n is a, c, g, or t
gaggatccaccaaccatagaaaggaaacaacacttggagtgaacccgacccaagccactacaccccagcctaaccgacaggtgctagactaatngtnaaaaacaaccggaaaatagacccggacgaagatcaaagnttntcaatccaaacattttagggggaccaagacccngggatcaaaaacaaggtccaccacacccaa

SEQ ID NO: 546292 - DNA, 1686 bp, Homo sapiens
  misc_feature (256)..(256): n is a, c, g, or t
  misc_feature (299)..(299): n is a, c, g, or t
  misc_feature (319)..(319): n is a, c, g, or t
  misc_feature (366)..(366): n is a, c, g, or t
  misc_feature (470)..(470): n is a, c, g, or t
  misc_feature (541)..(541): n is a, c, g, or t
  misc_feature (554)..(554): n is a, c, g, or t
  misc_feature (600)..(600): n is a, c, g, or t
  misc_feature (683)..(683): n is a, c, g, or t
  misc_feature (799)..(799): n is a, c, g, or t
cacagacacgtgatcagcgaaatccgagacctctagcactacgtcgtatatctcaagtctcgccgtacacacatgtcctcgccttatcgttactgagcgaatacgacgagccgcagcatgagagctagagtcgactacctatagtagtcatttcgttcgaaaggcaaccacgctaatacccaggcctctggacgtactgagtacaccgcggactgacgcgtgacacgcatcctcaccagaccggcccctggatacncggcgaggctgcgaccaattgaacgtgtccgctgactgttgcntgacctacctcgcgtatacntaagtgggcttgctcgctgtccgcctcgtgaccgtcctagtacggcncatcgtcaaagtttctgagcacccttcgaccagaccaacactcttgatggggcttaactttaaatttctagtcccctacactttgacatcaatcctacatgcanatcgtgcgctcctaagagtgagacttgactctcaattagcatcacacttgatcgctccaaagcgcaatctntatgagatttgantaggagcttgcaatcttttgcacaaacgaaattaatcgcactcttnttagttccgctacagacgagagataccgccctcgtctctactgttgagcgatcaccgagaacttgcttcgaccggctctcccntagaaacggcgcctaattgtctccccgaaaggctcctccccaatcaaagcctcgagcgctcgaggaacctatggtaacggtgctgtcaccaagcgaatgttgaacacttccttaanaacactacccgtaaaccgccgttgcgcgtgagtttgggtggacttgaacagttgagcggcgcccaatttcaagagaaacgtgcgggaatgaacgttgccttaaagtacccggctaccctgtggagacacaaagaaccaaaggctagtagaagccctttatagcgccccctttataactcctgttggttaagcgtggagttgccccccgggtggaatgtgggcaacggggcgcacttcaaagaattgtgtaattcccacgagtggggggcgagacaacagcaattaccttatgcaaccgtttttacaccgcgaagggaaatactacaacattggccaacgctcctctaagagggccactgtctccgcagttccagatatttccggcgccagatataaccttccattttcacaggatgccccacccgctagcggaaaagatgtcacaaggcgccgcctatcccggtttaaacggataaaaaaccacggcaccaatgttggcgtaccaatttttccaaaaggagcctcttgcggcgtttggaaacaagggctgttgttccgaacccccggtggcaaggaccccacggcgccagagatgtatacggttcacaactttcacaagtgcctcggaccccccaacatcgggggggccgttttttacaatttccccttccacagttattaccttaaatatacgcgttgtggtcgcgcttatagagcggagacaaacactctctctatgagcgtttcatccggaacaacaggggggccactatcaacacaagaggtcggcgccagagtgttcaatacaaagtttccccgatcgttctcgtcagaagcggggaggaatttccaacaacacggtacatttcgcgcagctaagatatagg

SEQ ID NO: 546293 - DNA, 133 bp, Homo sapiens
aatgaatctataaaacatctagctagagagggtactatggtacagagtatgtactatcatgagcgaccgatcatagtgccacttcacacgagtgtgcgtctgatcgattcatccactattcgtaagttatgca

SEQ ID NO: 546294 - DNA, 777 bp, Homo sapiens
ttttttttgaatctatgaaggggagtttattaggagaattgactctcgatcacaaggtgaggtcccacaatagctgaggagcaaggaagccagtccaagtcccagaacctcggcaagtctgctctttccaacttctgcctgctttattctggctcgtgatggcagctgaagagatggtgcctacccagattaagggcgggtcggcctcccccagcccactgactcaagtgttcatctcctttggcaacaccctcacagacacacccaggatcaatactttgcatccttcaattaaattgacactcagtattaaccttgacagcgcccaaggaggggagggccagacccagcgcacagttccagtttctgccacggaaacactgaccatgtgttgctcttaaggtcggagctccagggcggcgtttccccgggtttctgcgtttataagtgatgttagtatctggtttgcgtgtgcacaggtgacgtctcaaaaggatatggtggctgttttctgtcttcatataagttagaagcttgctttctctctctctggaaaacttgagtaatgtggaatgatctattccctgaaggtttgagtattcacctaagaattgcctttgctgagcacatgaggtgtgctgtgtgcttttcctaatttattattatgaatctgccttagtgttgtgtgcctgaggatttttctgtgtttctgggaaccattatggtaactgagagttttctagaaagccaccatgtttggtacctgtttttctccga

SEQ ID NO: 546295 - DNA, 254 bp, Homo sapiens
cctcggtacctaatcacaggtcgtatcctaagcggaggagcgacatcagcttgtttgtaccaaggtcactctgccctttggcagagtggatggtggtgggtaagaatggagataggaagttactgcaataatacagatggggaaaatgggcttactctagtttcggggtggccaagcttttttgtaaagggccaaatggtaagtatcttagactttcaggccatcctgtccctgtagcaacgacattgtgatga

SEQ ID NO: 546296 - DNA, 739 bp, Homo sapiens
  misc_feature (4)..(4): n is a, c, g, or t
  misc_feature (43)..(43): n is a, c, g, or t
  misc_feature (48)..(48): n is a, c, g, or t
  misc_feature (54)..(54): n is a, c, g, or t
  misc_feature (126)..(126): n is a, c, g, or t
  misc_feature (156)..(156): n is a, c, g, or t
  misc_feature (158)..(158): n is a, c, g, or t
  misc_feature (168)..(168): n is a, c, g, or t
  misc_feature (182)..(182): n is a, c, g, or t
  misc_feature (185)..(185): n is a, c, g, or t
  misc_feature (188)..(188): n is a, c, g, or t
  misc_feature (192)..(192): n is a, c, g, or t
  misc_feature (209)..(209): n is a, c, g, or t
  misc_feature (217)..(217): n is a, c, g, or t
  misc_feature (225)..(225): n is a, c, g, or t
  misc_feature (233)..(233): n is a, c, g, or t
  misc_feature (247)..(247): n is a, c, g, or t
  misc_feature (292)..(292): n is a, c, g, or t
  misc_feature (304)..(304): n is a, c, g, or t
  misc_feature (319)..(319): n is a, c, g, or t
  misc_feature (349)..(349): n is a, c, g, or t
  misc_feature (359)..(359): n is a, c, g, or t
  misc_feature (377)..(377): n is a, c, g, or t
  misc_feature (380)..(380): n is a, c, g, or t
  misc_feature (403)..(403): n is a, c, g, or t
  misc_feature (405)..(405): n is a, c, g, or t
  misc_feature (419)..(419): n is a, c, g, or t
  misc_feature (422)..(422): n is a, c, g, or t
  misc_feature (439)..(439): n is a, c, g, or t
  misc_feature (445)..(445): n is a, c, g, or t
  misc_feature (456)..(456): n is a, c, g, or t
  misc_feature (470)..(470): n is a, c, g, or t
  misc_feature (472)..(472): n is a, c, g, or t
  misc_feature (482)..(482): n is a, c, g, or t
  misc_feature (489)..(489): n is a, c, g, or t
  misc_feature (497)..(497): n is a, c, g, or t
  misc_feature (511)..(511): n is a, c, g, or t
  misc_feature (561)..(561): n is a, c, g, or t
tgtnaaaaaaaacatttattttgcattttaaacaaaacaaccnaaaanccccancatgacttgacagtaacccaggggtttacagtgtgtccaacccaacagtgtggttctgggactgggtatccncacaaacacaggcaggagtttggaggaaanangggggcacancaggagtgtatctnaanccnttcncaaaaaaaaaaaagtanagcattcngagttgcngaaaaccngtgcaaatggggcntctgaaacattgtactgtgagcccccagggaaagggaggaaaaanatgttgaaaaanaaggaggcaatttcntgaggcaggggacgaggagggaggcttacnatttttaatncccccacccccagtcccnganaatcaaaggagaccatgtccaancntgaatcaattcccngtncaaaaaaaggtgccaanaccccngggacaaaacnctcaaaatatcatncnggtcattccngagttcnatcccccncaccatattaaaanatgggggttggtggggggtggggaggtcagaaggtagtggcttttattcngtggaagtaaaaaacttagttcacattaagcactgataaaacccaatgactgggcccacagatctgttgagaggtctctagtagggaccaagagggggaggtccagaacatcctctgcctgaggtgcaacaggtgtagaaagtctgggaggaggtgagttttaaagtaatgggaaaaa

SEQ ID NO: 546297 - DNA, 335 bp, Homo sapiens
tggacccggcgcatgtttagtgccgctggtgcacagcccctgagggctgtgcatggatctctgccttttcatccacccacagtgagctgggcagtgcctgagccagcagcccattggtgggaaggccaggcatggccaggaggtgtggccatgggaccaggaggggcaaggtcttacttcatgcggatcttgcgggccatggctcgaagctcgtcttcccgctcctgcagcagacagggctatgaggacgtggccagtgccagcacccacccgtcaccccagccctccctctcccacttcacctgccgctcatgctcctgatttccaccttgcca

SEQ ID NO: 546298 - DNA, 717 bp, Homo sapiens
ctgacccatgcgttcgcgatccacgcgtccgcggaacgcgtgagtcgaccgatgcgtacgcgacccagtgcgtgcgatctaggtggcaccctaataatatcatttaccagtgaccctatttacatgcttttgctgcgtcaacaacagtgccttatgaggaaacaagcacgtatcgcccatacgtttatacaagatgccgtgggcatctagaacatgagattgacacgaacattgggctcgtactgtctatcatcgagcatactagggacgcacaaggcgaatcgtacggctggtaaccttggtctgcggtggagctcctaggagccacctgcgtttcgaacctactgcgttgtatgctgcgtcgtcaactatgaggggtgttcttgcgacataggacggatgccgctgatgccccgtagtcctaagtagattggtcgatgcacggcatactgagtatgcgagcctggaagctagctatgagcgcggggtcgcgcacgtgacgtaagtggggccctacgaaatgtggcaagacttggtccttggggttgcctacagcccacaagggggtggtgatgtgggtactactgatataccgtatccacggctgaacaacggaagattgcggcttggtccgtggggcgccatcgcacgaggagaccgtgcgccatcctgttgacaaggtgagcagttgaaagaacggcgcgagtacattctccg

SEQ ID NO: 546299 - DNA, 127 bp, Homo sapiens
acgaattgagctggtaccccaccttatgcgtgggcctcggtttctgtctctccccactgaccctgacctctccctcggttcgtctctccccacggagtttggtgtctcccttgcgtttctggttgtc

SEQ ID NO: 546300 - DNA, 232 bp, Homo sapiens
agccatcgaggacatcatagggggattccacctccttgaggatcgctacagccattgggcacgtccaggctgcccgtgtgcgctcagcgtgctgcaggcatctgctcgcaccactgggctgaacgccgtcctgagggcctgaggaatgccctgccaccagcttcagccagcttctcattcttcctccgctctttttgcgaactgggccgacccgaatcggtggcctgtatga

SEQ ID NO: 546301 - DNA, 2678 bp, Homo sapiens
  misc_feature (268)..(268): n is a, c, g, or t
  misc_feature (351)..(351): n is a, c, g, or t
  misc_feature (428)..(428): n is a, c, g, or t
  misc_feature (486)..(486): n is a, c, g, or t
  misc_feature (1206)..(1206): n is a, c, g, or t
  misc_feature (1246)..(1246): n is a, c, g, or t
  misc_feature (1352)..(1352): n is a, c, g, or t
  misc_feature (1361)..(1361): n is a, c, g, or t
  misc_feature (1393)..(1393): n is a, c, g, or t
  misc_feature (1395)..(1395): n is a, c, g, or t
  misc_feature (1679)..(1679): n is a, c, g, or t
aagcgggggtctctgagtgaatttataataactccttccttccttagcatagggttttcaaaatttgatttataattcctatttccagtaaatattgttcatttgtccacatctctccctatgatatgttgctggaggtaagaatttctttcatattcctattttttttttccccatagactaggctcatagaatttaaacaagcaaattttcctgagctttttcttgccaaatgaaagaagactggtaaattctcatagagaggttngtgtagttcttggctcttcctggggttaatgtgcttatattcacagtggcaaattggtctcagactttaatttatttattttngatttgaatttctctttaaaagtatcaatttaaaaggtaactagaattattctttctcattttcaaaagtgattttngcattattaaatttccctgccattgtaatgccatttcacgcagaaaaaaagtcagccngtaattaagaaaaaaagtgatggagattaagtagtattttggcttatttttaggactcatcatgagaagacacagttcctttaatcaggaaattaatatccataattttcactcaaaattgcagtatgtaaagcagattctcaaaaactctcctgaacacttatttatatatatgtttttatataagtaaaatttttctcatatttttatacgatatgcacacacacacatacatgcacatactacttactacatgttctgtacttgtactttgtaccatgcatattcaaatgtttatatacataagtttattataacataaacagtaaaagtaatgaatactgtttaaaataactaatatagtattttttaatttttgtggggatggattctcaaatacttgtgattttaaaagattctaaagctaaaacacaacttgattttaaaaagaatgattctccttacacaattataaatatttgcagtaaatattttccttataatactgttttgaccccatttaaaaagtattagattatattcctttgatccaatgttagaagagtaaagatttgtcctagggaagatggctgacttcggttcccaacatgcgtatgcatttagactgtagctcctcagccctgtggacacaaaattggacagcttattaggttacgttagcaatgcatgacggtttctccacactaagatattcacgtngaaacagatttcctgttcgtcttatgtgtctggtaaaatngtttccccaattacaattgacatatcaatagagggttaacaagagtataattacataacagaattcctcatgaactgtaatcagtctacaggaaaatcattatttnatcttgatntgcagatgaatatactgctaagaaagggagcnantctgacctttgttaaagttgatctttgtaattgaggtataaggtatgaaaagataaaaaaccgaaggccagagaatcaggaaatgaaagatagtatggactgaaggtaacaatattttaatgttatgcaatatagccagagaaatattaaaaattagttgtttgctgtgcataggtggatctcgcaggaagctaatgaaacctaagcttcagtgcctctcacttagacatgttccattcgaggtcctgaacctaactttgtattaggaattctgtactaatttngttgaagaagaccagcaaagttgtgtacacttctacccccacaaaatctgcattgtccatgtgagtaaagtaaaataattcctgttatttttttctgttagaaataagtatggaggatatgtttttaaaaatttatgagttaattgacaatatccatatataacaagtgactttctcacaatatatatgatgtgatatatagggagatagtttcactttcatcatattttatacgttgattctgaactatagaaaaataataaatgggattttaattatagctcttagttgggaaagaaatatagagagatgtgggatttgaatgcccatgaaagacattttattttacttgaatatattcttgcttcactttaccctccataatatgttgtacattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagcttaattttcatataaacagtatttttaatctatgttaaaatagataatatctaaaagtgtgatctctaggtagtccttagtttattagtactgtacttcaaaaagatttttaaataggtccggcacggtggctcatgcctgtaatcccagcactttgggaggctgaggcgggcgaatcacctgaggtcaggagttcgagatcagcctggccaacatggtgaaaccctgtctcaactaaaaatataaaaattagccgggcgtggtggcaggcgcctgtaatcccagctactcgggaggctgaggcaggagaatcacttgaacccaaggggcagaagctgcagttagccaagatcgcatcattgcactccagcctaggggacaagagcgcgagacttcatctcaaaa

SEQ ID NO: 546302 - DNA, 642 bp, Homo sapiens
  misc_feature (628)..(628): n is a, c, g, or t
ggagcagtttgttcaatgatttaatatcatgttctttcattaggtaaaattccaaaacctttatattatcatttatttttaccctgataatgcatgagtagatcagccctgtgaaaatgatagtctatcaaaatgcattttacctaggttgtttccatgaaaaatgagaggtaaccaaatagcactcggaaaatggtgaaaggctgctgagaactgacagccagggaatgttcagaatccaaggagctgagattttcagagatttgataaatctctccagccacaggatgccagtattgaaccactttttgtttgatagcatttctctcttgagcactgctgtctggtccactgctgtaagataatctagaaggagaagttgctgtgacttcaacaggtactcatggtcaaaatcaattactctgcagaagccttcattacgatgaaagtcattcaaatccttatttagaagagtaaagatttgtcctagggaagatggctgacttcggttcccaacatgcgtatgcatttagactgtagctcctcagccctgaaatgttattgccagataatcttctatgcatttttcgtgatatagtgatttcgttaaaccaataagcgatatctnccgtgacaaaaacc

SEQ ID NO: 546303 - DNA, 1183 bp, Homo sapiens
actgctgtaaataactgcagatttttaaacaatcttttatgttaattttataaaaataaaactttcaactagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagggggagaaaaagaaagaaagagatcattacactgacacaacacacccctactaatctagagcatgacatctgcacaccaaagagcgtccgccacaatccaagaacgacataccagcgtgaggacaccacagactaagacacaaacaacaaacaaacaagaacaagacaactggggggaacgaccacacacacagaggcaaaaacacaaagagtgagacaacaccaacacaacgacaacaaaaaccacccacagggcaacatacaagcaccaacaccagacaccacaagcgagggcagacagacacaaccacttaaagccagcccgcgacaaactaacactgccgcacaccaaccaacgaagacactccaacgaacacccaccacaactcacaacagacaagacagaccacgaaaaacaacaaaacacacagaccaccacacgcaacacacaacacagagccaacaccaaacgaagaccacgcaccaacccaaccaacaaccaccaacaaacaacacaaaccaagcacccacacacgccgcccacaagtaacacgtagagaaaaggcatcgcgccacactcgacgcagcggagagaccagaccagcccgcacagacacgcacggcaccgaacacgcccaaacagacaacaccaaagacacgagcaaagaacgagcacgccgccagcgcacgagcccaaccagcagccagagccggagcaaccgacgacaaaacgccgacacaagccacacgcgccagcagacgacagacaacgacaacaagagacaaagacaaacagcaacagccagagagcagaagcgcagccacgatcaaaccagcgacggcagacaccacaaacgaggcagcaatagcaaactgccagtgcgaagcaaccaaccagggacctccacagacgaacagacatgcaatacgaccggcacacagacgaagagagcaagccacagccgagcaggcacaccaaccacgaagctgcccaagcgacacagaagcccaaaa

SEQ ID NO: 546304 - DNA, 2140 bp, Homo sapiens
  misc_feature (668)..(668): n is a, c, g, or t
  misc_feature (708)..(708): n is a, c, g, or t
  misc_feature (814)..(814): n is a, c, g, or t
  misc_feature (823)..(823): n is a, c, g, or t
  misc_feature (855)..(855): n is a, c, g, or t
  misc_feature (857)..(857): n is a, c, g, or t
  misc_feature (1141)..(1141): n is a, c, g, or t
ggagcagtttgttcaatgatttaatatcatgttctttcattaggtaaaattccaaaacctttatattatcatttatttttaccctgataatgcatgagtagatcagccctgtgaaaatgatagtctatcaaaatgcattttacctaggttgtttccatgaaaaatgagaggtaaccaaatagcactcggaaaatggtgaaaggctgctgagaactgacagccagggaatgttcagaatccaaggagctgagattttcagagatttgataaatctctccagccacaggatgccagtattgaaccactttttgtttgatagcatttctctcttgagcactgctgtctggtccactgctgtaagataatctagaaggagaagttgctgtgacttcaacaggtactcatggtcaaaatcaattactctgcagaagccttcattacgatgaaagtcattcaaatccttataaatggttagctgaaagtagaccttattcttgtccttctttagaagagtaaagatttgtcctagggaagatggctgacttcggttcccaacatgcgtatgcatttagactgtagctcctcagccctgtggacacaaaattggacagcttattaggttacgttagcaatgcatgacggtttctccacactaagatattcacgtngaaacagatttcctgttcgtcttatgtgtctggtaaaatngtttccccaattacaattgacatatcaatagagggttaacaagagtataattacataacagaattcctcatgaactgtaatcagtctacaggaaaatcattatttnatcttgatntgcagatgaatatactgctaagaaagggagcnantctgacctttgttaaagttgatctttgtaattgaggtataaggtatgaaaagataaaaaaccgaaggccagagaatcaggaaatgaaagatagtatggactgaaggtaacaatattttaatgttatgcaatatagccagagaaatattaaaaattagttgtttgctgtgcataggtggatctcgcaggaagctaatgaaacctaagcttcagtgcctctcacttagacatgttccattcgaggtcctgaacctaactttgtattaggaattctgtactaatttngttgaagaagaccagcaaagttgtgtacacttctacccccacaaaatctgcattgtccatgtgagtaaagtaaaataattcctgttatttttttctgttagaaataagtatggaggatatgtttttaaaaatttatgagttaattgacaatatccatatataacaagtgactttctcacaatatatatgatgtgatatatagggagatagtttcactttcatcatattttatacgttgattctgaactatagaaaaataataaatgggattttaattatagctcttagttgggaaagaaatatagagagatgtgggatttgaatgcccatgaaagacattttattttacttgaatatattcttgcttcactttaccctccataatatgttgtacattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagcttaattttcatataaacagtatttttaatctatgttaaaatagataatatctaaaagtgtgatctctaggtagtccttagtttattagtactgtacttcaaaaagatttttaaataggtccggcacggtggctcatgcctgtaatcccagcactttgggaggctgaggcgggcgaatcacctgaggtcaggagttcgagatcagcctggccaacatggtgaaaccctgtctcaactaaaaatataaaaattagccgggcgtggtggcaggcgcctgtaatcccagctactcgggaggctgaggcaggagaatcacttgaacccaaggggcagaagctgcagttagccaagatcgcatcattgcactccagcctaggggacaagagcgcgagacttcatctcaaaa

SEQ ID NO: 546305 - DNA, 2287 bp, Homo sapiens
  misc_feature (815)..(815): n is a, c, g, or t
  misc_feature (855)..(855): n is a, c, g, or t
  misc_feature (961)..(961): n is a, c, g, or t
  misc_feature (970)..(970): n is a, c, g, or t
  misc_feature (1002)..(1002): n is a, c, g, or t
  misc_feature (1004)..(1004): n is a, c, g, or t
  misc_feature (1288)..(1288): n is a, c, g, or t
ggagcagtttgttcaatgatttaatatcatgttctttcattaggtaaaattccaaaacctttatattatcatttatttttaccctgataatgcatgagtagatcagccctgtgaaaatgatagtctatcaaaatgcattttacctaggttgtttccatgaaaaatgagaggtaaccaaatagcactcggaaaatggtgaaaggctgctgagaactgacagccagggaatgttcagaatccaaggagctgagattttcagagatttgataaatctctccagccacaggatgccagtattgaaccactttttgtttgatagcatttctctcttgagcactgctgtctggtccactgctgtaagataatctagaaggagaagttgctgtgacttcaacaggtactcatggtcaaaatcaattactctgcagaagccttcattacgatgaaagtcattcaaatccttattggggttaggagaaaagactagacaattactatgtggtcattctctacaacatatgttagcacggcaaagaaccttcaaattgaagactgagattttctgtatatatgggttttgtaaagatggttttacacactatagatgtctatactgtgaaaagtgttttcaattcttattcttgtccttctttagaagagtaaagatttgtcctagggaagatggctgacttcggttcccaacatgcgtatgcatttagactgtagctcctcagccctgtggacacaaaattggacagcttattaggttacgttagcaatgcatgacggtttctccacactaagatattcacgtngaaacagatttcctgttcgtcttatgtgtctggtaaaatngtttccccaattacaattgacatatcaatagagggttaacaagagtataattacataacagaattcctcatgaactgtaatcagtctacaggaaaatcattatttnatcttgatntgcagatgaatatactgctaagaaagggagcnantctgacctttgttaaagttgatctttgtaattgaggtataaggtatgaaaagataaaaaaccgaaggccagagaatcaggaaatgaaagatagtatggactgaaggtaacaatattttaatgttatgcaatatagccagagaaatattaaaaattagttgtttgctgtgcataggtggatctcgcaggaagctaatgaaacctaagcttcagtgcctctcacttagacatgttccattcgaggtcctgaacctaactttgtattaggaattctgtactaatttngttgaagaagaccagcaaagttgtgtacacttctacccccacaaaatctgcattgtccatgtgagtaaagtaaaataattcctgttatttttttctgttagaaataagtatggaggatatgtttttaaaaatttatgagttaattgacaatatccatatataacaagtgactttctcacaatatatatgatgtgatatatagggagatagtttcactttcatcatattttatacgttgattctgaactatagaaaaataataaatgggattttaattatagctcttagttgggaaagaaatatagagagatgtgggatttgaatgcccatgaaagacattttattttacttgaatatattcttgcttcactttaccctccataatatgttgtacattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagcttaattttcatataaacagtatttttaatctatgttaaaatagataatatctaaaagtgtgatctctaggtagtccttagtttattagtactgtacttcaaaaagatttttaaataggtccggcacggtggctcatgcctgtaatcccagcactttgggaggctgaggcgggcgaatcacctgaggtcaggagttcgagatcagcctggccaacatggtgaaaccctgtctcaactaaaaatataaaaattagccgggcgtggtggcaggcgcctgtaatcccagctactcgggaggctgaggcaggagaatcacttgaacccaaggggcagaagctgcagttagccaagatcgcatcattgcactccagcctaggggacaagagcgcgagacttcatctcaaaa

SEQ ID NO: 546306 - DNA, 671 bp, Homo sapiens
agctctcgcgagcacgggccagcttccttcaaaatgtctactggtgtcacgaaatcctgtgcaagctcagcttgcgtagggtgatctaagctctacagcccccagaagtgcatatgggtctgtcaaagcctcatacctaaccttctgtatgctcgatgcggggatgcatttagtagaacaaagttttgaaacgagctcgatcgaaggacctagaaggtgtcggatggagtgtcaccatttggtcatactatgtgtagactcgaggacacggagacgatagtgcatcagaagaaccaggaatatctgcactatctgacactaccgagaagcaaggaccaaaatacggagacttgctatcaggcacgtgtaattacagtcttaatctgggtccacctgagaagagggatgatcttaggagccatatatggggacagcatggatctagtatgatgggctgctgagggtgaaagatttccatgaaggggcctggtggaactgaggaggtactctctccattgagcatcatgctggctctcagaaggcaatcaggaggctgagggaaattaatagagttctagaaggaaatgtagaagactgatctggagtaaggagagttattgcagagagatctggtgacttcgaaaaggtgatggttggtcgggaaagggtaa

SEQ ID NO: 546307 - DNA, 988 bp, Homo sapiens
  misc_feature (135)..(135): n is a, c, g, or t
  misc_feature (139)..(139): n is a, c, g, or t
gctgaaggcagtaagctcggctcacagtcgcaggagagttctggggtacacgggcaaaggggcttgagaaggcccggagcgaaccgaagaagaagcaactgtgccccggagaagagaagctcgcccattccagantggnacccagttcagtgaagatggcagggccaatgtttgctctgagtccaacaatcgcgcctcgtgggtgttcctacccaatcgttatcatcactttcttcggtaggatgatcccggccattagtgtttccatccgtgctgcagagcgaaaagaagctcacccaggaaacaggtatcttgaccagtcaaagtcctatttcgaagcagaagtcctcagggaaaaaggtggaaaaatagttttcccaaaacgagtcttttctcttggacacgcgaaaattattattccaagcaaccccagaggatggatttttcaaaaaaaagctaaccggaaggtagtgccaccttttctccatatgactgatccatactattgtttgaccagacttgagtgacaggggaatgtaaacaaagtgtcctccctatgattcttatggggcatggactcaacaatgacaattctcaagggcttggtcacaaccaaggtcccattttccagtgaccctccgtattaaaggcctatgttacacgcaaggaatcggaggctactcacatttaggatgcctccgtgggtggagttctgcatccgtgctacttcctccagtgtattttgcggctcggagcatttacttctctgatttgtggcgcaagataatggcgtagccatcacgatgattgccgagagatacggggacaccatggcatgcccgagaacaaaacgaacgttcagaaagggggacgctggacggggcaacccgggcaattggtacaaaagctctggggagaccctatgagggggctacaggagaaccctttttacagcggcattcaacggggcacccactggggccacaag

SEQ ID NO: 546308 - DNA, 2126 bp, Homo sapiens
  misc_feature (654)..(654): n is a, c, g, or t
  misc_feature (694)..(694): n is a, c, g, or t
  misc_feature (800)..(800): n is a, c, g, or t
  misc_feature (809)..(809): n is a, c, g, or t
  misc_feature (841)..(841): n is a, c, g, or t
  misc_feature (843)..(843): n is a, c, g, or t
  misc_feature (1127)..(1127): n is a, c, g, or t
tgcagactcattaacacacctttatttaaagaaagagtaccgcgggttgattatccttaaagccgaaagactttttcaacatggatgtagacatgacagttgaatgccacatactctgcagctttccccggcaagcaggaagcttccttaaagacatacttgcctctcttgagcactgctgtctggtccactgctgtaagataatctagaaggagaagttgctgtgacttcaacaggtactcatggtcaaaatcaattactctgcagaagccttcattacgatgaaagtcattcaaatccttattggggttaggagaaaagactagacaattactatgtggtcattctctacaacatatgttagcacggcaaagaaccttcaaattgaagactgagattttctgtatatatgggttttgtaaagatggttttacacactatagatgtctatactgtgaaaagtgttttcaattcttattcttgtccttctttagaagagtaaagatttgtcctagggaagatggctgacttcggttcccaacatgcgtatgcatttagactgtagctcctcagccctgtggacacaaaattggacagcttattaggttacgttagcaatgcatgacggtttctccacactaagatattcacgtngaaacagatttcctgttcgtcttatgtgtctggtaaaatngtttccccaattacaattgacatatcaatagagggttaacaagagtataattacataacagaattcctcatgaactgtaatcagtctacaggaaaatcattatttnatcttgatntgcagatgaatatactgctaagaaagggagcnantctgacctttgttaaagttgatctttgtaattgaggtataaggtatgaaaagataaaaaaccgaaggccagagaatcaggaaatgaaagatagtatggactgaaggtaacaatattttaatgttatgcaatatagccagagaaatattaaaaattagttgtttgctgtgcataggtggatctcgcaggaagctaatgaaacctaagcttcagtgcctctcacttagacatgttccattcgaggtcctgaacctaactttgtattaggaattctgtactaatttngttgaagaagaccagcaaagttgtgtacacttctacccccacaaaatctgcattgtccatgtgagtaaagtaaaataattcctgttatttttttctgttagaaataagtatggaggatatgtttttaaaaatttatgagttaattgacaatatccatatataacaagtgactttctcacaatatatatgatgtgatatatagggagatagtttcactttcatcatattttatacgttgattctgaactatagaaaaataataaatgggattttaattatagctcttagttgggaaagaaatatagagagatgtgggatttgaatgcccatgaaagacattttattttacttgaatatattcttgcttcactttaccctccataatatgttgtacattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagcttaattttcatataaacagtatttttaatctatgttaaaatagataatatctaaaagtgtgatctctaggtagtccttagtttattagtactgtacttcaaaaagatttttaaataggtccggcacggtggctcatgcctgtaatcccagcactttgggaggctgaggcgggcgaatcacctgaggtcaggagttcgagatcagcctggccaacatggtgaaaccctgtctcaactaaaaatataaaaattagccgggcgtggtggcaggcgcctgtaatcccagctactcgggaggctgaggcaggagaatcacttgaacccaaggggcagaagctgcagttagccaagatcgcatcattgcactccagcctaggggacaagagcgcgagacttcatctcaaaa

SEQ ID NO: 546309 - DNA, 419 bp, Homo sapiens
  misc_feature (35)..(35): n is a, c, g, or t
  misc_feature (38)..(38): n is a, c, g, or t
  misc_feature (43)..(43): n is a, c, g, or t
  misc_feature (82)..(82): n is a, c, g, or t
  misc_feature (171)..(171): n is a, c, g, or t
  misc_feature (173)..(173): n is a, c, g, or t
  misc_feature (209)..(210): n is a, c, g, or t
  misc_feature (236)..(236): n is a, c, g, or t
  misc_feature (246)..(246): n is a, c, g, or t
  misc_feature (294)..(294): n is a, c, g, or t
  misc_feature (339)..(340): n is a, c, g, or t
  misc_feature (380)..(380): n is a, c, g, or t
gtgagccaccatgcgcggcgtggactctttaatantanccatnctgactcggatgagatggtatgccattgtgggtttgatntgcatttctctaatgatcacacgatattgggctttttttcatatgcttggtggccgcatgtgtgtcttcttttgaagtgtctgtgtatngnctttggccactttctaatgagaattttttttcttgnnaatttggttaaggtcattatcagtgntggacattanaactttgtcacatgcattggtgcaacaggtttctcctattctgtaagntggctgtgcactctgttgacaggttcttctgctgtgcagaagctnnaagaagaaaggttcgtgggtctgtgtctgtgtcttttggnattctcagacttatgtaggcattcatatatggtgattgg

SEQ ID NO: 546310 - DNA, 911 bp, Homo sapiens
gcccgggtcgagcatgtagcggctgctggcggcggggctcccggggcgggccgggcgggccgcgggagccgcacgcggcgatatggaacgaggagggcaagaacgggcaagaagcctggaattgtctcgccatttaaacgagtattcctacacaaggtgacaaacgagtagagataacgaaacgcccactgacgacacggtgacagagacggcgacccatctgacacacatgatgagtgattgtcattgcctgagacgcagtcgagccagacagactgctgagcgactatattgagaacggaggtcacactatcctacggtcagttaaacgtccaataccagtgatacactgaatccactccaagtaaggactgacaatcctgacataatcactagaccaatgccaacagagagcccaccagcttccgggacactctgactcaacaaagcacagatgctcgctgctccagccctgatactgccaatacccacggtccaagccttggcctgcgacagggacggagcgacggcatactcatccctcagcggctgcccatccatgaccatccgaccgacggcacacaccatactgatcccgagacacatgaccgcacgcaaaacccagcgaagcgcaccctgcacagaccaagaccccaggcaacccagggaaatcctacaccccaaagaccaaacaaaccagcggtgacggcacacacggctccgccagaaccggaccatccaactcgccacccgacacccccatcgacacagagcaggaatgatgccacgagggcacacccggagaaacggagacatagctaggccatggggacaatcccacagagccagccaacaagcaacccaacaggcccgctcgccagacacgaacacaccacgcatagccaagcata

SEQ ID NO: 546311 - DNA, 235 bp, Homo sapiens
catcaagtcacaagcacaaacattcgtattttttgctacacttaattagataaaagaaaacacctaggctgggtgcgacggctcacacctataatcttggttgttatttgggaggccaacgctgggaaatatcacttgaggccaggagttcgaggccagcgtggccaacatggcaaaaccccttctctactaaaaataaaaaaattagccaggcatggtggtgggcgcctgtaat

SEQ ID NO: 546312 - DNA, 136 bp, Homo sapiens
attttaatggtcctgcgtataacctaccagctatattagcattatatctctgcacatagcaattacgaatataattcgaatagagcaaatcatattgcaatctacttatccactttttagcagttaatataacatt

SEQ ID NO: 546313 - DNA, 1469 bp, Homo sapiens
cgcgggaaggaggggtctctggtgacgcgcgggggcgcgttgtgccgatcttattttgtggaggtgcccccactgtgggttggcgggacgcggtgtgttgttgcacgctgtgtggctcgttttttccccctgttccaccggggggttgcagaacaaggttttccctgggcgcaagcacccgtgttggcgttagtcgccttcctttgttgggggggggccccccctatagtgccccccccactcttggtatcacttgcttaggtgctctacagtaggatcgtcctttgctcttcccctgctggttgtgctggtgaaacgcaagatgtgcggggatacacctggcgggtgttttcccccccgccgtggggggccacccacggggcttttcccccgcgtgttcgccctagagacaacttggtacggcccccgccgcgcacactcatcgggatctgcgtgtgttgcctccgtgtgtttacagcctcgggttgagagccggggtgtcctgttgtgagccagggctcctctctttcttctgtgaagacggccccctctcttgagtgagacattagtggacgagtcctttttgtcttcgcaccgtgtgtgtttaggtggggggagcccgctcttgtctcacccacggattattccccccgcacgcgtgtttctctgaagctccctctagggcacattagggcgccccacgggccacacgacactcctctcccacggggggttttagtccccctcggggagtaagcgccaccctcttggggccccacacttagacaaccagccctcggattgtctcggataagaaccctctcgcggggccccccgtggggcgcccacacagatggctgcgctctctcccgctggtgtgcaccccgcgggtgtctcactcactcgaccccctgcgcgcctctcacacacgacgtgtgagaggggcgcgttatctcccatagagagaaatattctctcttgtgagcacatctactttttcttctcacggagtactttctctcgtgtgttaggggcccacatctgatccgggggagattcccacaggggaaaagattgttcaccacacccccccaagccaccgatggctctgtgatagataccccccagagaaccccctcgtgtgcggatttttctgtgagaaccacgcttgtaggcccacattggtgatttatcacttcccactcgcggagaaagaaactgttgaatttcttccacatatgctgaagccacgcaccacgctataggaggagtatttgaggagtaccctctcacggaggacttccccggagagattcaccgcccccctgatatggggttgaaatggagggtcccctttgacccctaatgctggggcgatcccggtttggatggaaatacagaggatttccgaaaatttctttttgtagattctttaatttttttgccaaaacccaagggatattaatata

SEQ ID NO: 546314 - DNA, 294 bp, Homo sapiens
  misc_feature (141)..(141): n is a, c, g, or t
aggatcttatatataatgtaggatcagcagcagatagattcacccatctgtgctctcagctgtcacaggcctgaagggaggaggtggcaatggcagcccaaccagccctccactctgggtaccagaggaaggcgcaggcgntggttacacagcccatcacctggaggtgatggagcgcaaccccagccctgcctggaggccctggtgagcttgcccagcactgttccaacccctccctgaacccacagggcagagccaggggtggtccaatggcctgagacgaggggacagggg

SEQ ID NO: 546315 - DNA, 199 bp, Homo sapiens
actagtccacggttggcggggaagcctcacaatcacggtggaaggcaaggaggagcaagtcatgtcttacatgtatggcagcaggcaaagagagagaacttgtgcaggggaacccctctttttaaaaccatcagatctcgtgagagccaaccgtggactagtactagtccacggttggctccaggaagggaggcgggga

SEQ ID NO: 546316 - DNA, 273 bp, Homo sapiens
gcgagttcaggaagagtactgggaagatttagaggaaagggaagtggaggcttaaaccttggtaatttctttgcaagccgtaagggctacagtcgaaaagggtttgaccgccttagcactcagggcagtgaccacgacaaagaggatgatggagtgattcagaggaggagtattcagcactctgcttcgctcgaacttcctctcctgcaaaccagctttgattagattagtaagatttacccgcatgtcagatgcttccttagcacgttaagg

SEQ ID NO: 546317 - DNA, 878 bp, Homo sapiens
gccgggcgcggtggctcacgcctgtaatcccaaaatgctgggattacaggcatgaactgctgtacccggctggttgttgcattttaatgtactgagccaagcaccaggctccaggacactgctactaggtggcctgtccttggtctgatgcaggcgcttccaggaagaatgggctgcagctctgtgcagcctgcctgtgctgggccaatgtcagctccccttgctcgaacaggatgtggccagaacacgctctgtgcctggagcagcttgattgccactgggggatttgaaggtttaggcgtccgttccttgagcaggaacctctgcagaaagggcaatttagacagaacaaagtgcctctccctgaggtctgtctccctcacaccaaaaaggaggtgaaagcttcctttttaagggagaccccttttttaagagccatgacctgcccaatggaactagggtttctattcttatggtgtcagtaaggtgtgaattttcctgtgaatcttgttcatttcaccaaattttcaagtttgtggggcttaaagtttcgataaatatactcttatttgtgtggtgaagtcccttttttatttcttgtatttgtaatgtgtgccttctttctttttttatgtccctttctttttatgagaataaagttccactccagctggtgacagattgagacgcgtttcaaaaaggaatattattttaaaacccaatattttttttttttataaatacctccactttgtttggccttgttaacaaaagcaataaatttaggtttattaccctcaaaactggtggtttcattttggcgtctattcaaggaatttgtgagccggcgcatacaacacagtgggtgacgaattccg

SEQ ID NO: 546318 - DNA, 406 bp, Homo sapiens
ctccaatgcgggtgccgccgaaatcttcgtctaccgcacgccgatcatgcagcatcagaacgtgtatttgcaggagcatcgtgaatatgcgggctccatctacgacacgcacacggatggcagcggcatctgcctctcctcccgtctgcggccgatcctgagcatccgcccgaaatacgaccacttcctggcccaggccccctggcaatacccggcggatctgcatctggtctattggcttgagcatatgggctatgagtatgacgtgttcacggatgaagacgtcacctacgaaggcttggctcgtctcgccccctataatgtcgtcatcaccggctcgcatccggagcataattccggcccgcagctcgacgcgctgcataactacacccagcagggcggccgc

SEQ ID NO: 546319 - DNA, 283 bp, Homo sapiens
tcagtttatacttctgtaaaattgttttaactagaccccccctcccctttctaaaccaaagtataaaagaaaatctagccccttctttggggccgcgagaactttgagcgttacccatctcttggccgccggctaaataaacggatttttttttaaataaacggactcttaattcgtctcaaagtgtggcgttttctctaactcgctcaggtacagtgactataaaagattaggccttcagcagctcacaagggctgtcctgacagtcactcctaataaaaac

SEQ ID NO: 546320 - DNA, 388 bp, Homo sapiens
ccgcaatggtagggtgtgcagagggagatggggaatttatagagcttctgaggaaacacagtaatgataatgtaatcaagtgactctccacaaagtcagtcccacgatgacgatggtcagccagagtattgataacctcagttgtgtgaggcctgagaacgtgatgaaggaggctgtccagcacggacgagtccaggcatgctgtcgatgtccagcacctgctgcccgggcaggtgtggggctcgggctcgcagccacctgcaggagcgacggatgtgtgtcagcgttgcggtagctcatagctgctcaggacctggatgagaagctagctcctcagcagacatggacagagcccggtgccatctgacaggttactttggcgcgtgga

SEQ ID NO: 546321 - DNA, 222 bp, Homo sapiens
tgtctactatatgtgtctctatagattaacctgctgtagacatttcatataaatgtaatcatacaacacgtgattgtaagcgttagggtttaataacttcgtgtaatgtattatcagattgtaaatctcaataacagcgggcagcactctcaacagacgcatggtcttcagtaatgggtgtagcagtaggaatacatgtgccatagtcaactgtgaaactgt

SEQ ID NO: 546322 - DNA, 149 bp, Homo sapiens
aaacagctataacggttactactgatttggtaaaattcacagtaatgttccaggttcatcatgtcaggatcattccttgatgcaaagtttgatgtaaattaagatcaagtggtttcttggtcaataattgcaatttctttcttttaaag

SEQ ID NO: 546323 - DNA, 148 bp, Homo sapiens
aggaagtatataaaataccccaacaagtccaattatattcttaaatattattataataaataagggacaaatttccaaatattgaaatgcagctcctgttttccccaactctggacacataacacatcacaaattcacaggggggtta

SEQ ID NO: 546324 - DNA, 348 bp, Homo sapiens
ggctcgacggtcaaatgaccagttcacaatacaaatcaaggccaggcatggtggctcatgcctcgtaatcccagccagcactttggcagtctgaggcaggcggatcacttgagctcaggagtttgacaccagtctgggcaacatgacaaaacactgtctctactaaaaatacaacaattaacctggcctggtggcgtgtgcctgtggtcccagctacttgggaggctgaggtgggaggattgctggagcccccgaggcggaggttgcagtgagccgaggtcgcacctctgcattccagcctggttgacagagtgagaccccatctaaaaacaaaacaaaaagtcgacg

SEQ ID NO: 546325 - DNA, 600 bp, Homo sapiens
ggatgcaagtgtccataaataagacatagcccctaccccgtactcagctcttcaaaaccagatccagaccctgtcctccccagtcccatctggtgtctgggttacctccgtagccttagggctcctcatccgctcagttcttacagagaccacgttattcatgcactgcccctttgtggctcggttttcacatgtgtgcatttgatgactgcaggtttcttagagtaaaaatcgtatgctctgtttcattgattcctttcttctttctaccaccctatatcatctggatattccaacccagttggaggcccattgttcccccaacaaaatcttgattctgctgcatctatgcctttgctctcccatccatctctgcttctttctgtgctcagcacgaactctaccttctctgggaaagattgcctttccccctgtccaggagttatatttactccaaacactatgcactttatctgttctccacttgtagcatgcacagcttttattttcatattctactcacacctgtagttctccaggtgggaagtcctgtgaaggcaggaaacacttcttgtgcatccttggaaagctcccaaaggg

SEQ ID NO: 546326 - DNA, 311 bp, Homo sapiens
cacgaaagaaacccccagccatgcccaaatgctgcttcaaaagcctgcctatccagtccttacaaaaaccttgcaggattaaatgtgttaacttattatatttaatgtacagatttctaaagtgattttatgctagtgatgttaaacatgaattacagtttattatgaggggtcgtgagcacctcctccatttaacataaactaggtgactttcctatttattttttacagaagtaggaaacccgtatgtgtgcctactcgatttacagggtttctagatgacagtcttccggaggggatcctactagagt

SEQ ID NO: 546327 - DNA, 203 bp, Homo sapiens
cgagacgtacgtaaagagtgacaaggacagcctataggaaaaacaataccacttagaaacaatctcctctctctctctctctctctctctatctctctctctatctcctctctctctctcctctcctatctctcctctctctctctcctatactaacttgttacaaattcggaagttatgatatgtattcgcccagaggaaaa

SEQ ID NO: 546328 - DNA, 292 bp, Homo sapiens
caggcagatcacaaggttaggagttcaagaccagcctgaccaacatagagaaaccctatctctattaaaaataaaaaaactagccaggtgtggtggtgcgtgcctgcaatcccagctactcaggaggctaaggcaagagaattgcttgatcctgggaggcggaggttgtggggagccgagatctcgccactgtactccagcctgggcaacggagtgagactctgtctcaaaaaaaaagaacaatcattgggggaaaggacactctcttcaatactgatctataggagtggtg

SEQ ID NO: 546329 - DNA, 176 bp, Homo sapiens
tggtgtccgtggaagtcctttctctggttcttgaatgaagcagtaacccaagatggctaccaacatcacgatgctgatgaccaggaacactgcgacagcaatctccacagagcctgagcagagaatggggattgcccggctcaggtcaaacacatccttcttggcgatgccgcgac

SEQ ID NO: 546330 - DNA, 956 bp, Homo sapiens
ctgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctacttttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagattcttagatactttttgctgctagttctagattacttttgctgctaaggtttatgttattttattgaccttgttgccaactttttatttttgtaagcctaaagtgattctttgaaagtttagaaacctgtcccaagacaggtccaaaaccgggccttgaatgtttgaagtgctcggattcggtaaatatatattcggggagggagcgcaagggtagcaacttaacctagtaatataaacccggggtggggggcccaccttcttgtgcaaacaacgggcggcaacacacgggggtaccgtaaataaatcaccacagtgacacacacgcagcaatctctcac

SEQ ID NO: 546331 - DNA, 777 bp, Homo sapiens
gagccccgccatggtgcgccctgcgcggaggacccctcgctggaaaggcattttaagggccacgagatgcagttacctgtgtggacttcagttatcaacacaaagcagctggccagtggctccatggactcatgcctcatggtctggcacatgaagccgcagtcacgcgctaccggttcactggccacaaaggatgcacgtcacctgtgttgaacttttctctccttcgggaacacctgctttggttccggctcccgagacaagacgtgtccgcatcttgggtaccccaatgtcaaacaggtgagtccactgtgtttcgtgccacacacttgccacagtgaggatgtgtcccactatctgcaagttgatggccagttcctttcgttgacaagcctctgacgacaagacagccaaaaggtgtgggcaactcaatcgcaagaaattcctgtttctccctgagcccagcatattcaacctgcgtccgcttgtgccaatgttctccccacgactgggggggcatcatccagtgtctggccagttgacttgaacaacgaagttgttcaagtcttgggggcgacaaattgagcatgcggggacattgtgtccactcggtatttggagagcatggcgggctttggtccacctaatggtggaatttccaaccccagtggggacgttgcattggcggtgccggcatggacaaccaccagtggacggttgggactgcgcggcatcacgggtgtcgccactacccattgcccgtgaccgtgaaggggc

SEQ ID NO: 546332 - DNA, 351 bp, Homo sapiens
tgtaacccggtagagcggctccctccctggtgaaatcaagcagatgcaaaggctccttagatgggatctgtcatttgccctgtaatcacaatccagactttgaaacttccccatgagtgaagacaggaaagacttccccggaggaggaatgtggttaatgtatctactgagctcctaaagtttaaattcaggtactgtgtgtacaatttcatcaacatctcgacccatgaaactgacatcctgtgccaagaagctgttggttctcgcaggcaccgtgtacaacatttgcagattcaggtatcaagaagcagagatgtctcgaaagcagcactttactaacagcttagtatc

SEQ ID NO: 546333 - DNA, 241 bp, Homo sapiens
cctgaccgggccttagcatcccatggttgacagttggtgtatgactgcgcctccctcagtggtcaacactgagattaaaaagaaagggacagccctgtaatttggaaggttatatccagaggagttcagcacccctcagagtctaaggggcttcctggtgatacggacccaccgctgcagagaaatgcccccagcctccctacttagtgcaccaggggtctggaaccctctctacctaaaa

SEQ ID NO: 546334 - DNA, 437 bp, Homo sapiens
  misc_feature (12)..(12): n is a, c, g, or t
  misc_feature (31)..(31): n is a, c, g, or t
  misc_feature (47)..(47): n is a, c, g, or t
  misc_feature (59)..(59): n is a, c, g, or t
  misc_feature (130)..(130): n is a, c, g, or t
  misc_feature (163)..(163): n is a, c, g, or t
  misc_feature (388)..(388): n is a, c, g, or t
aacaaaacaagntccccgggcaataattaanggtaataaattgaaanagaagggataanctgcctgaaacaagatttttaatgccaagtgcagtggtatgatctcagctcactgcagcccccgcctcccnggttcaagctattctacctcagcgacccaagtncctgggattacatacttgcgccaccacacctagctaataatttgtattttttgtagagatggggtttcgccaaactcctgagctcaagcaatccgccctccttgacctcccagcacttcgggaggccaagctgggtggatcacttgagcccagaagttcaagaccagcctgggcaacataaggaaaccctgtctttaccaaaaatagaaataaaaattagctggncctggtggcacacgcctgtggtcccagctactcaggagactgaggtgag

SEQ ID NO: 546335 - DNA, 347 bp, Homo sapiens
  misc_feature (304)..(305): n is a, c, g, or t
  misc_feature (311)..(311): n is a, c, g, or t
cttcaaatattttttatactcttcccttttctctcaagagactttcattagcttgttcttctaaccataaactaagcacatgactgaatatgattaatattagttctggctggttactggtgcattttaatattgataattgatatcctatctgatttcctggttttgcttgatatatgatgtatagtttccttgaagccactggaggtgaattctctttggtattttaggcaattgttcagttctagtaattaaaacaataaaggagaatatgactgactcccatatgctaatttatgccagnnatctcnaaagaaatggatccattcactctgaaggagaaatct

SEQ ID NO: 546336 - DNA, 452 bp, Homo sapiens
  misc_feature (37)..(37): n is a, c, g, or t
cctccaacactgaaagggctgacctgtgtaactaatnggatattgtggaaatgatggagtttgtcttctgaggctagatcatgaaagacatgtggtccttggaccacttaatcatgaagaagacagctgccatgttgtgaggactctcaagcagctctgtggagaggtccataggtaaggaactgagaaccccctccaagtgagcaatcttggaggtatatcctttcctctcagtcaagccttcagatgactacagcctgggctggtatcttgactgcaaccttatgagaaaccctgagccaacaccagctaagattctcctgaattcctcaccctaagaaactgagataataaatctgtgttggtttaagccacgtgtattgagataactaattatgtggcaatagaaaactaatacactaagagatgaattaaatagagaatccactcca

SEQ ID NO: 546337 - DNA, 247 bp, Homo sapiens
cacggttggctcagaaggtagtcagatgtgagactgcttccttgagacattttgtgctatgttttatacgaataattaaaaaacagttggcgttcatacaaatgtctatgtgacatgataaacatggagaatcccaaagaaaaaccgaacagatacaggatccagagataatgacacacctccgcgatgatatatgagacgcatgacatcagatactctgctccctggctctacaagcgtgacctgc

SEQ ID NO: 546338 - DNA, 135 bp, Homo sapiens
cacaattaccagcatcttgttagacaactaaactaaacagaactacagttagattcacatttagttcatacagcaaccagggatagttaattggacaaagcagaaacagcaaagacctcttaactagtactatat

SEQ ID NO: 546339 - DNA, 906 bp, Homo sapiens
  misc_feature (809)..(810): n is a, c, g, or t
  misc_feature (816)..(816): n is a, c, g, or t
  misc_feature (818)..(818): n is a, c, g, or t
gccgcacctacaccagccaacccagatcccgaggtccgacagcgcccggcccagatccccacgcctgccaggagcaagccgagagccagccggcctggcgcactccgactccgagcagtctctgtccttcgaccctgatgcccctgcgccctttcctgggacccctgcccctgctgggcagctgctgccaacctgcctggccatggatgacccctgtcccatgctggctgctgccaccctgcagctggggcgcaggccagctccactcctgctgtctgcccaccctgcatcaccctggctgcatggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagacctaggtgaggccaagaagcaacttcaggatgagatgctgcggcgggtggatgctgagaaccaggcttgnngaccantnaaggaggaactggacttccagaacgaccatctacagtgagggagctgatgtgagacccaagcgcctgtcatgagaccccgacttgttg

SEQ ID NO: 546340 - DNA, 659 bp, Homo sapiens
  misc_feature (584)..(584): n is a, c, g, or t
ggggtggagtcgcggagtagtcctcatggccgccccgccggagcgccggtgagcccgaggaagaggaagtcccttatgctcctaggattatttatgagtgttgaaaatactcccatgcgcccgggattcaatattgtatggttcattagagatcggtgttgtggctggacgttgggacgttttttgttcacaatagtagaattagaagatcatgtgatgttggagtaggagggttgatcttggtgactttgggatgctggtttcacttgtatggtataagttgagtggcaaagcaagagaagtccaggaaacgaggtgccagagaagaaggttaaacaagaagatattatatgagaggtacccatctcgatccggaaagaaaacacaatgggagtagtggtaattgaagcaaatcttgagcatagaagtcaatgtaaacggaaggttaacgatcaaccacataaaacatttcatgtgcgataagctctcaatcaagtaaataaagtttaagtgtagtcatttatttacccacagttgtgtggaagtgaaaagttgcagttatattctggccctgtgtctagtgncaggatagcattcttagtgttacgtatagtggacttgtcatccttaggatgtgagcaggagttattggagtgtgg

SEQ ID NO: 546341 - DNA, 1466 bp, Homo sapiens
  misc_feature (173)..(173): n is a, c, g, or t
tcatgggtcgtcgcccgcggccgttgttaccggtatttgtaaggaacaagccgtagcacgacaagtctcgcttctgcctgagtgtgtcccgtgcattgaccatagattcgcattgttgtgaccgtgtggagcggaaataaggccacaacagctggatgcacgtttccggcttntgtggccacgatggtgtcgagatgacatcatcgcagcacgccttgtcctcgtgacagcccgttggaggcgttgcccagagattcttgtgcccatatcaagtcacgattggttaagaaagttgtgtgagggaacagcatagagcttccgatcatcctggtgttgcagaggtcacagcccgttacccacgtctatcctgcatacaacaacaggatcgtttgtacctagtgcattggggctggacaagagcgtaccgagaacgagtgaccattgctccaggtgcctatgtgccaaagcacacccagggacactagtgcgcccaggggttcaacatatggtcaacggtctatccatgtcacgatccgcgacccgaagtctcgcaagaaacaaggggaggcactgtgagtttagaggacccgtaggacagggggccaaagtgacaagattatcctggaccgcacacgaagatccaaccatctcaacagacagtggagtgcttcaaccaaagcttacacatgctgacttgaaatattgcacatcaccatggctgagctggacaaacgcggctcaatacccagcattggacctagtgggtggttcacatgcttctcataccccaagttacgctgggaccactcctgggacaacgttggagagggaccccttagcactgccaacgaagggcggtatccccagatggtagattggcccaccatcaataaataaggtcaacccaactaagattcctaacacatccctgcgtcaaaaacaccaccacacaaaagagacaaggacagagagacagaagaacgacaccccacgaggaggagcaccagaaacatccggatgacacacaacatcatcaggaccaaagagaggacaccaatagaggagcggaggcggtaaaatacaagcacaagacccacatgccagccgcacagtaataacaccaagcagtgccgaagccggggacaaacgcgaggaccacggagggcacatgagtgacacagcaacccaacaccctagcgccggatacgaacgacttacgacccgagcgaccacaaaacgacatgcacaaatgaccgtcccagccaaacactcactaccgacgagcagatgtaaacaaaccgaacagacaaggacgacacgaccacccacatcagcaaaacacagaccgagccaacacgaccgagtcgaaagcacgaagagccaccagagagccccgacaaggctggaacgcacatatcgaccagagcaccgccaagaaccacgaagcgaagccagcactcgcccac

SEQ ID NO: 546342 - DNA, 113 bp, Homo sapiens
gcgcatcttgctcacatcaggagtcaccttccacccagatcagtacaagggtgaaaaaggcagtgagggggaaccaggaataagaggcattttcctgatgggagaagactgcg

SEQ ID NO: 546343 - DNA, 400 bp, Homo sapiens
  misc_feature (145)..(145): n is a, c, g, or t
  misc_feature (148)..(148): n is a, c, g, or t
aaaccatccttaaaattttccccgttcaatttggcccttaagttcaaagctgttacaagctgttaccccacccatgtttacagtttctgcccatctatctgtaagcaggaggtctaataagaattgccttaaactggccgggcancangtgtcacgcctgtaatcccagcactttgggaggctgagccgggcggatcccctgaggtaaggagttcgagaccagcctggccaacatggtgaaaccccgtctctactaaaaggacaaaaattagccgggcgtggtggtgggctcctgtaatcccagctacttatgaggctgagcagcagaatagcttgaacctgggaggtgaagattgcagtgagccgacatcgcgctactgcactccagcctgggcgacaa

SEQ ID NO: 546344 - DNA, 499 bp, Homo sapiens
tgctggagagtacccattccgcggaatcagaatgacgggtaggagagggaattccccgttcacccgcaggagtcgtggcccgtgcttggctactctggacctgcctgaaacactgaggggtcggggatgggggcaaatgtcgtgcgcgcgagcgtgtgtgtatatgcgttgccagaagagaagaggggtttaatgtctgtagcttttaactgatcctcttggtggagttcaatttgattagtagaaagtgagagtccgcgtcactatccatagcattctgagggttgagcattaagcttgggaattttccagtttcttggacacctgacagccggatagaggaacagacttgacgtgagcgtgggagtggcacacacaaaaattcctccctagcgtttcgtttccatcagtgggatgggaaggggatttctgaaagtttgggtcttctgtttcttctgttggtgtggtgtcagcaaataacattcaggaaaattttttt

SEQ ID NO: 546345 - DNA, 822 bp, Homo sapiens
ggacgcgtgggctttttttattgtgtagctcaataatgctgaattaaagggcagattcatatgcggctctggggggaattgttacaaatatcaaaggaactaatccagcatcctatatagaactctgcacacttgggggaggtccgctgaagcaggacaaagtgctctttacacaggaatagagtcggtctcaagtatctgctcgtggtggggaggacaccctaagcatgctacatacgtcaccccgtgctctcaggatgcacccaggtgggctcgcggtcagggttggccttgccggtgtccaccccgcacagcaccccacagatccggaagcggatccacacggggcttggaccatccacagcatccgggacatccagcgatcatacagtcgccctccgtccgtcttcctcgcatccgtccggtgtctgcctggaagccgtccagtgtcttacagcaccaatctggccgtcgtgcctgcgcttcttcatgaatggggtgatgcaccatgctgcccgctgaattcctcttcagcgagatgggagtgccctggctgggccccgtggcaggggacgatgcacaggtaccactaaggagggccgaagggacacacgatagtacacataagctccaattggcaagcgaaccgggcagagtgcatcctgatggaaagctcgtggtagcaccgagcagggtgcaagtacaccagcaacatccgaggaagcaaggccgggtcccaatcacactggaggtactcggaaaatggagccggtggacccgagaactcaaacggggatggacggaaccacgcagagagatgag

SEQ ID NO: 546346 - DNA, 294 bp, Homo sapiens
agccaaaattccgctttttgggagcttatatttaaaaacattatgtctaagactaattttacattgtcaaaaaaagaatggcccagcacgggggcttacactgtaatcccagcattttgggaggccgaggcaggcagatcacctgaggccaggagttcaagaccagcctggccaacatgcgaaaccctgtcagtactaaaaatacaaaaattagccagtcatggtggcgcacacctgtaattccagctacttgggtggctgtggcatgagaatcatttgaacccagagagccgg

SEQ ID NO: 546347 - DNA, 402 bp, Homo sapiens
agtatccccacgatcgtctcagcttacggaagtgggaggaaagagtggagaaatttgtcttgtggttcgagtgcccacttaggctgtaatagaatagaacaccagctagatttctaaggttttttgagtccagtttctggcttccagactgcatccctggacccacttggggcctgggggaactcactgccctgaaaggaagaatataagcctggccggcttcaccacctgctgattgtagagccctatggccttgagtaaacataggcagtagcaaggtagtaattacggcaggccttgggtgagattcagtgttgtgctggttacaggtctgacccagcacagtcccagtggtggtagccacgagggtgcttgtgtcaccctaccctcagctccaggcag

SEQ ID NO: 546348 - DNA, 199 bp, Homo sapiens
  misc_feature (22)..(22): n is a, c, g, or t
  misc_feature (43)..(44): n is a, c, g, or t
  misc_feature (177)..(177): n is a, c, g, or t
  misc_feature (195)..(195): n is a, c, g, or t
ggctccattaaggaccaaattnatgctaccactaaacaaaaanntatagtctgtgttaaatcgtatgctttttaaaggtatttaaagattcaactagctttaaagaggctgagcagctcaggaagcctgtaatgtgacataactctttggacctgatcttgatgttctgctgttgtnagtcttgaagagcgtatntgat

SEQ ID NO: 546349 - DNA, 802 bp, Homo sapiens
  misc_feature (85)..(85): n is a, c, g, or t
  misc_feature (87)..(88): n is a, c, g, or t
  misc_feature (101)..(101): n is a, c, g, or t
  misc_feature (111)..(112): n is a, c, g, or t
  misc_feature (162)..(163): n is a, c, g, or t
  misc_feature (189)..(189): n is a, c, g, or t
  misc_feature (239)..(239): n is a, c, g, or t
  misc_feature (253)..(253): n is a, c, g, or t
  misc_feature (255)..(255): n is a, c, g, or t
  misc_feature (270)..(270): n is a, c, g, or t
  misc_feature (300)..(300): n is a, c, g, or t
  misc_feature (304)..(304): n is a, c, g, or t
  misc_feature (367)..(367): n is a, c, g, or t
  misc_feature (417)..(417): n is a, c, g, or t
  misc_feature (425)..(425): n is a, c, g, or t
  misc_feature (463)..(463): n is a, c, g, or t
  misc_feature (469)..(470): n is a, c, g, or t
  misc_feature (513)..(513): n is a, c, g, or t
  misc_feature (541)..(542): n is a, c, g, or t
  misc_feature (545)..(546): n is a, c, g, or t
  misc_feature (598)..(598): n is a, c, g, or t
agcgggctgtcggccgcggtgtcttcttcgtgccggcgtcgcagtggccgggcctcttgcgtctggtaacgccgctgtctctaangnnagcccttggcgcncgcgccccgnnaccgcagcgcccggcagtccgcggccaaccgccgcccgcgcccccgctcnncgcaccgtacccggccgcctcgcgcnatggcggcccccggcagcgcccggcgacccctgctgctgctactgctgtngctgctgctcggcntnatgcattgtgcgtancagcaatgtttatggtgaaaaatggcaacnggancgcgtgcataatggccaacttctctgctgccttctcagtgaactacgacaccaagagtggccntaagaacatgacctttgacctgccatcagatgccacattggtgctcaacngcagctcntgtggaaaagagaacacttctgaccccagtctcgtgantgcttnnggaagaggacatacactcactctcaatttcacgagaaatgcancacgttacagcgtccagctcatgagtcnngtnnataacttgtcagacacacaccttttccccaatgcgagctccaaagaaatcangactgtggaatctataactgacatcagggcagatatacataaaaaatacagatgtgttagtggcacccagggtccacaatgaaccaacgtgacccgaaacgctccaatgatgcccccatccagggaatacctattccaacacgcgcttcagcaagagagaaaacacgcgtgaaccagacaaggactccccaaaacaaaggaccc

SEQ ID NO: 546350 - DNA, 149 bp, Homo sapiens
agctgcaccgcgggtcaactggctccccatcctctaccttgtccccatggcagtcgcagaaaataacggcaaccgcgaatccttattggctgccaagggaaaccaaaagaaaagccattgctgcagaggatcccagcctaaaatttccg

SEQ ID NO: 546351 - DNA, 271 bp, Homo sapiens
tgagacacccacaccttcaaaagcaacactgaacagaaaattctacccatgccacattcatgtctactcagagatcaccttcaccacccaaaacttcaaagaaaccagtcactgctgtctaaaagcatagttctccgagtgtggtcactaaaccagcagcagcatcaccacctggcaacttgttagagatggcaattccccaggccgacccaacccactgaatcagaacttctgcagctaactcaacaatctgggtttcaaccacccttcc

SEQ ID NO: 546352 - DNA, 157 bp, Homo sapiens
gacgtcttccacggcgcatttgccctcgccattaccgagaagcaggaattgcggcaggcgctgcgctttgcgtccgcggccgcagcattaaaatgcacccgcttcggcggcgcttatgccgcaccgcgacgtactgaagttgaagcgtttttgggcg

SEQ ID NO: 546353 - DNA, 406 bp, Homo sapiens
aatgttacccacagtgttcatcatatacactgcagcagcaatcagtatactttcgagagataatgtcatctctcaacaatttgaccagcatatttagatatatccaactcatctacagcatcagcatccagtaaggttgaacggtccgccacagcgccatgatagatatcagcataccgaaaaggcatcacttgctccctcaggccctgtgtgtagttctcaacttgaaaatagccacaggtagagagggcccaccacccagaccagcagacaagagggcgacaggagtagcacatcagtagtatcattccatagttctttcaatacaagcagtcggtctggcgtaggtttcggctccaccacgggaggctcctccatctttagaggaacttctgactcaatgtct

SEQ ID NO: 546354 - DNA, 141 bp, Homo sapiens
gttatagaagatactgagtgtataatgttattgatggtaagcaacaggatctcagtggaacagggtgtgtgatgaatgaaaatgtgagggatcccagctctaaccgggagggcagtgggagactggaggccagtgggagga

SEQ ID NO: 546355 - DNA, 181 bp, Homo sapiens
cgtggcaatagtacctaaacgtaaaacatccaaacaacgtaaacataaaagaagaactcatgatgtattaacatcaccaactttagtaacttgtgggacttgttcaggaaaatcattacctcaccatgcttgttcaaattgtggtttctataaaggtaaaaaagttattgaaggtctacac

SEQ ID NO: 546356 - DNA, 485 bp, Homo sapiens
ttaagatcctaacagtgcttttcaagaattaccatatccaggtacaatcatctctacatatgcagccagactcctggctcaggactgctgggagatccagaaatgcatgccaccttgttctcaaaagcttggtaatgggtgatcttatgagtgagtttgtcactaatgtttgtatcgggactggaattctcagatggttgcaagtcatttgaggtcccagaagtccagcatagagatagggagattgtgggcagatctcttgagcctaggagttcaagacaagccttggtaacatagtgaaaccctgtctccaccaaaaaatacaaaatttagccaggcgtggtagtgtgtgcctctggttcccgctaccttggaggctgaggtggaaggattgtttgagtcttgaaggttgaggctgcactgagcccagatcatgccactggactcccgcctaggtgacagagtgagacccctcttagaaaaaa

SEQ ID NO: 546357 - DNA, 1029 bp, Homo sapiens
gcagatctccacatatcgcgatcctattccaggctccaagtgatgttgctgttaccagtttctgcgatcccctctgcataagtagtatcggacgtggcgtctctggtggatgctgtgcacatacatagtgcggtacccggcgcacgaggtcacctactaagatacatgatctgttctccccaagggcagcgggagagaagtcgttcactccgttctaaattgtcaaccacacggtgcatctcccttagtccagacgataccactcagaatatagacctggcgagagagttcagtagctgcttcgcgagtccgtgagcagttggggagtgaagtccgcagttggagtgccgaagggatattgggggccgccacttagtcagcggaattacattgtaaacgagtcgctatgcagtggaaatcccagcgcgaagaaacgcggggcgcatggctctcgacagggatgtggcgtgataccaatgtaccgatgcatcggcggagtgcgtacccgtgataaccgtgctaggacagctcagaagcttcaactccctagaggattaaactcgctgactccccctccaatgagtcgggcgccctattgcagtaaacgccatacacctggtttgtctgaccaagcggttgcagaggattgactatccgcaggacaagcttttcatattcctgtgggttccctgacatggatcatgcgtaccggaagacacgtctgcggggtactggtagtccagccgaacctgaatcccgcaaatggaagcacgttgaaccctgtcgcagatccgtgcgtgctgctggaaagaagacccgctcaggacgggacgatgtcataccagcctggcaagtgggaagcacaccagctctgtgattagttcctgtgcaccgtcgaagtcggaaggaaacaatctgatactggcccggagtcacgaacttgagcgggccgctggggcgttcgcgctgggggtcatcaaaccggcgcggggcatttgccttgcgccggaggaacagaagtcaccagca

SEQ ID NO: 546358 - DNA, 341 bp, Homo sapiens
gttcactggaaaccgattatggattatataaagggtatacactcatcgagggattagtgccaggtgcagcagggtcatgcctgtaatcctagcacataagggaggtcaaggcgcgtggatcacctgaggtcaggagttcaagaccagcctagccaacatggtgaaaccctgtctctactaaaaatacaaaaattagccaggcatggtggtgcacgtctgtaatcccagctacttgggaagctgagggagaaaaagcacttgaacccaggagatggaggtttcagggagccgagattgtgccactgcactccagcccaggtaacagagcaagactctgtctt

SEQ ID NO: 546359 - DNA, 919 bp, Homo sapiens
  misc_feature (109)..(110): n is a, c, g, or t
  misc_feature (112)..(112): n is a, c, g, or t
  misc_feature (125)..(125): n is a, c, g, or t
  misc_feature (131)..(131): n is a, c, g, or t
  misc_feature (152)..(154): n is a, c, g, or t
  misc_feature (157)..(157): n is a, c, g, or t
  misc_feature (160)..(160): n is a, c, g, or t
  misc_feature (162)..(163): n is a, c, g, or t
  misc_feature (168)..(168): n is a, c, g, or t
  misc_feature (174)..(174): n is a, c, g, or t
  misc_feature (176)..(176): n is a, c, g, or t
  misc_feature (179)..(179): n is a, c, g, or t
  misc_feature (183)..(183): n is a, c, g, or t
  misc_feature (186)..(187): n is a, c, g, or t
  misc_feature (457)..(457): n is a, c, g, or t
  misc_feature (462)..(462): n is a, c, g, or t
  misc_feature (486)..(486): n is a, c, g, or t
  misc_feature (493)..(493): n is a, c, g, or t
  misc_feature (530)..(530): n is a, c, g, or t
  misc_feature (532)..(532): n is a, c, g, or t
  misc_feature (539)..(539): n is a, c, g, or t
  misc_feature (543)..(543): n is a, c, g, or t
  misc_feature (547)..(547): n is a, c, g, or t
  misc_feature (549)..(550): n is a, c, g, or t
  misc_feature (555)..(555): n is a, c, g, or t
  misc_feature (557)..(557): n is a, c, g, or t
  misc_feature (565)..(566): n is a, c, g, or t
  misc_feature (573)..(573): n is a, c, g, or t
  misc_feature (580)..(582): n is a, c, g, or t
  misc_feature (586)..(586): n is a, c, g, or t
  misc_feature (591)..(591): n is a, c, g, or t
  misc_feature (600)..(600): n is a, c, g, or t
  misc_feature (602)..(602): n is a, c, g, or t
  misc_feature (604)..(604): n is a, c, g, or t
  misc_feature (608)..(608): n is a, c, g, or t
  misc_feature (615)..(615): n is a, c, g, or t
  misc_feature (631)..(631): n is a, c, g, or t
  misc_feature (641)..(641): n is a, c, g, or t
  misc_feature (652)..(652): n is a, c, g, or t
  misc_feature (654)..(654): n is a, c, g, or t
  misc_feature (664)..(664): n is a, c, g, or t
  misc_feature (716)..(716): n is a, c, g, or t
  misc_feature (723)..(723): n is a, c, g, or t
  misc_feature (908)..(908): n is a, c, g, or t
ctcatcgctgtggtgctgcagctgtcccagcagctgtctggcatcaacgctgtcttctattactccacgagcatcttcgagaaggcgggggtgcagcagcctgtgtatnncnccattggctccgnttatcntcaacacggccttcactggcnnntcnctntnngtggnggagcnancangccngcnnaccctgcactctcataggcctcgctggcatggcgggttgtgccatactcatgaccatcgcgctagcactgctggagcagccaccctggactgtcctactctgacgcactcgtggccatctttggctttgtggccttctttgaagtgggtcctggccccatcccactggttcactcgtggctaactcttcagccagggtccacgtccagctgccattgccgttgcaggcttctccaactggacctcaaatttcattggtggggcatgtggntgtgnagtattgttggagcaactgttgtngtccctnacgtctttcatcatcttgcactgttgctccttggttntngttcttncatnttgnanntactntnaaaagttnngtgagantaaaggnnnggangcttngagtgagantngnttgngggcttncgggcagggggggagncagccaaagntgacaaggcancncgagggagcntgttccactccccctgggggcctgattcccaacgtgtgaagtcgccccagantcaccangcccggtcctgctcccagcagccctataggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgntcaaatctatt

SEQ ID NO: 546360 - DNA, 158 bp, Homo sapiens
cggatcatctagatgcagcatggagaatgctggatggagtgtgtctcccaaatcattttggtgccgatgtactcgtgctagaaccatccaacctctatcttatctatccttatgtacatgacgcaggatgtgttcattgtcttaaactgaacagaacg

SEQ ID NO: 546361 - DNA, 586 bp, Homo sapiens
ggatagactggccagcactggtaggaacctgtgcaagacccaactggtgctctacgatgacgctgaggagcttaataggagtgctggtgagctccccaaaaccggggaatcaatccacacagtgcaagagtaagtagacacgctgttgaatcaggaccaagcacaaggcgcgcgtatgcctgctaaagactttctggacagactttgttgtctagacaacctgaaagcctcactcagccaagtgggggtggacatagaaatgctcaagactgctgtggacagtttagatgcatactcagtcaacatagaaaccaactagaactatgtggaatcaggcaaagagttactagataacctgacgaatgatctggataggatggttgggaaagtggcttaaagtcacataaagggctcaaagaattgtgtgtgcacggagccgaattaaaagcccatttctcataaccaaagagtggtttatatccatgcgtcccctaacgcacaagttatttgtccctcttgagcatgttgttaccaactgcacaccaaggcatatatattttcatgcccaggtaacctaattactttt

SEQ ID NO: 546362 - DNA, 233 bp, Homo sapiens
gctgcttggactatacaatcactgaaactaaagatcaggcatattcaaaatagtgattacatggacttaggaggcagggtgcagtgtgtcacgcccgtaaatccagcactgtgggaggccgaggcaggtggatcacctgaggtcaggagttcaagaccagtctgggcaacataggggaaaccccaatctcttactaaagtatacacacacaagaaaaattaagctggggtgtg

SEQ ID NO: 546363 - DNA, 280 bp, Homo sapiens
aatgcaaagttgttgcagggactaaagataaatagttgtttaaaaaaaaaaaaaagggccaggtccgggggaatccaaaagacctttcagttcaaacccgggaggcagagaaccagcattttcaggcctttgaatagagggggggatcaggagccaggggaaacgaaagagtgaaagcctggacgggctctggctgaaagaagaggtatttgggcagaccatgcagggagcatgggggcttgccaggcagctgaaacaggggggaccaggtaaaatggga

SEQ ID NO: 546364 - DNA, 423 bp, Homo sapiens
  misc_feature (210)..(210): n is a, c, g, or t
acgtgtggactaaagaagcaagtaaagagaagaaatactttgtctagaattgcctatttctttctggtgtggtctgaatgtgttcccccaagttcatatgttaaaacttaatcaccaatgtgatagtattaagacgacaggcctaagtcctgagagcagagccttcctggatggaattagggtccttacaaaagagcttgaggaagtgtntgttcttttctgttcttctgccatgaggatacagcattcacccccctttttgcccttctgtccctcccaccatgtcaggacacagtgcttaaggtacctccttggaagcagagaccaggccgtttccagccaccaaacctgctggcaccttgatcttggatttcccagcctccagaactgtgagaaataaattttttattgtttacaaattaa

SEQ ID NO: 546365 - DNA, 419 bp, Homo sapiens
  misc_feature (156)..(156): n is a, c, g, or t
  misc_feature (187)..(187): n is a, c, g, or t
  misc_feature (273)..(273): n is a, c, g, or t
ccggaggggatgttgtcggtggtgaggccagcacagcggtagctgcctagtgggaatgacccctgagcatgcagagcccagagtcactgtccatctgcgttcccagagaacaattgtgaagagtcctagaacaggaactctgaatcagactgtcanggggcctatgttagccaaaagtgttactaanattataaaattccttgtcgtcttcaggtcttcatgcgtttgtcactcttggtccatcagcaaagactgtgagatgcggtaacagcncagtttcttatcttcttctttacatatgttgatacgtggaaagggtctttgagtagaaactttcctgactagaagatgcaatggcatgctgcacaggatttagctaagctcctgggcgggggatccctctagaagtcgcacctgca

SEQ ID NO: 546366 - DNA, 450 bp, Homo sapiens
tctggaaagggattttaactctttttccccggggcgggagtgcaggggcgctatctcagctcgctgcaacctctgcctccggggttcaggcaattctccggcctcggccctcccgggttagcggggattaggggctgtgtgccaccaggccgggctaatttttttggtattggtagtagagacagagttcacggtgttagccaggcgtggtcttgaactcctaacctcgtgatccgcccacctgggcctctcaaaggtgcggggattagaatggtgagccacggggcccagccaaagcccggttttttaaaaagaaccaaagtagtggtaatggcaatcagattttccttactaaatatctatgagtgttgggacactgttggaaacaactaatatacttaatattttttctcaatattggctatcttaaaaaattaaggattccatatg

SEQ ID NO: 546367 - DNA, 524 bp, Homo sapiens
ggggggagacaaaaaaaaaaaaaaaaaaaaaaaaaaaaatttgtgtgcggcgcgcgcgcctgggcccttgagaaaaacttttctaaacacacatatccggttgggcgcgcgcgcgcgggccccaagtgggaagggaacaatgtgggcctatagagcgggtttcctctagagggaacatccgcgggtccagaggacactagaggggcggggtttctctccacaccaatataaaaaagagcgccgcggggggaaacagcgcgaagcgcgttcgtggaaaaaaattcccgagagagggaagtcgcggaggggccccatataggggggggattctatatcaaaaggggggatctctcaagaggagagagccccagaattatccaaaaattatagcgcccccgcccgcgggggtgaaacacagaaacacactataaaaaatatgcaacaacacaataaaacaacaaacaacaaaaacaaaaaaataaataccagagacaaaactaaacaaaaaaacacaaaataaaaga

SEQ ID NO: 546368 - DNA, 257 bp, Homo sapiens
  misc_feature (146)..(146): n is a, c, g, or t
tctcagcgtcagtagctgggatacaggtgcgcacacacacccggtaatttatatattagtagaggtggggttcaccatgtaggccaggctggtatcaaagtattgacctcaagtgatccgcccacctcagccttccatagtggtgngattacaggcgtgagccactctgcccggcttatttttctttatgtattagcttcgtaagaggttctgtagagcagtgatgtgcaactcttgctgacgttgctggggaagct

SEQ ID NO: 546369 - DNA, 218 bp, Homo sapiens
  misc_feature (174)..(174): n is a, c, g, or t
cccgcgggcggggaccaaactcaggacaccgagcttgtggacaccaggccagcaggagatggaaccttccagaagtgggcagctgtggtggtgccttctggagaagagcagagatacacgtgccatgtgcagcacgaggggctgccgcgatgcccctcaccctgtagatggggntggaaaaggagggatgctgctctcagtgctagctgtccatgcaa

SEQ ID NO: 546370 - DNA, 238 bp, Homo sapiens
  misc_feature (44)..(44): n is a, c, g, or t
  misc_feature (141)..(141): n is a, c, g, or t
  misc_feature (231)..(231): n is a, c, g, or t
  misc_feature (234)..(234): n is a, c, g, or t
cttctactgtggtgtaccgtcaacactcttatcagacaatagantttaaaaaaagaataaagaaagacaagaaggacctacttaatgattaagggatcatccaaggagaggatgttactatcgtcgacatatatgccccanatataggagcacccagatacatacaacaaatattaacagacataaagggagatattgatgggaatacgatcatagtaggagacttaatanccncctc

SEQ ID NO: 546371 - DNA, 320 bp, Homo sapiens
  misc_feature (35)..(35): n is a, c, g, or t
  misc_feature (40)..(40): n is a, c, g, or t
  misc_feature (73)..(73): n is a, c, g, or t
  misc_feature (76)..(77): n is a, c, g, or t
  misc_feature (79)..(79): n is a, c, g, or t
  misc_feature (82)..(82): n is a, c, g, or t
  misc_feature (92)..(92): n is a, c, g, or t
  misc_feature (104)..(104): n is a, c, g, or t
  misc_feature (130)..(130): n is a, c, g, or t
  misc_feature (135)..(135): n is a, c, g, or t
  misc_feature (147)..(147): n is a, c, g, or t
  misc_feature (153)..(159): n is a, c, g, or t
  misc_feature (232)..(232): n is a, c, g, or t
  misc_feature (247)..(247): n is a, c, g, or t
  misc_feature (252)..(252): n is a, c, g, or t
  misc_feature (263)..(263): n is a, c, g, or t
  misc_feature (270)..(270): n is a, c, g, or t
  misc_feature (277)..(278): n is a, c, g, or t
  misc_feature (299)..(299): n is a, c, g, or t
  misc_feature (301)..(301): n is a, c, g, or t
  misc_feature (319)..(319): n is a, c, g, or t
ctcaatattaccagtattgtcttgtgtttctaggnatttnagagtttccttttaaaaatggacactacacccntgnntngantgtttattgngttcaacaaatntttctaaagaacaatattcttaactnttccnctctattatctnagtttnnnnnnnctttaaccaggaaaccctgagaagattataattcactgagagcagataaaaatatcagattatgtgtatttgntggagttgctgtgantgaanttgcctgttgngtattcnatgtttnnaggaaatgtgatcgattgagnanatgaagagtgtgaagggna

SEQ ID NO: 546372 - DNA, 356 bp, Homo sapiens
ggcctcagctcgtgagaagtagcttctcgtatcgctctctcaagtaaggttagaattgagcggttcgctgtaatctcagcactttggaaggctgaggccggcagaacacgaggtcaggagttgagaccagcctggccaatatggagaaaccccatctctgctaaaaatacaaaaattagctgtgcttagtggcacacgcctgtagtcccagccactcgggaggctgaggcagaagaactgcttgaacctgggaggtggaggttgcagtgaaccgagatcacgctgagatcatgcactccagcctgggcaacagagcgagactccgtctcaagaaaaattaagagttaatggtagct

SEQ ID NO: 546373 - DNA, 104 bp, Homo sapiens
ttgcattaatctgccaagtccagataacaggaacagaccagacttatccactgtcccaagctctccagcctggcacatccgtcagccccacggtgctcattgaa

SEQ ID NO: 546374 - DNA, 334 bp, Homo sapiens
gatagtacagaagcgtgacatgactatggatatctcagctactgtcctctccaagctgatcatcccagacacacagtcatgaaactcccttagcgaaagttccttgactctctgaactggacaccccagccagaaaagaaatatcactgtcagagcctgacaaaactgggtctgcccacgtacaatcacgaacaccacacggttgcgttgtacaacagaccatgcctgcctagactgaagtacttcttacgtcctccggttcatcacctcttcttacagacgctaataccggctacagacacaagagagcaacaagggtcaaaaattagaaccc

SEQ ID NO: 546375 - DNA, 523 bp, Homo sapiens
gtcggccgcctactactactaaattcgcggccgcgtcgacgacgaaatcactaaaaaacgtgaaaaatgagaaatgcacactgaaggacctggaatatggcgagaaaactgaaaatcacggaaaatgagaaatacacactttaggacgtgaaatatggcgaggaaaactgaaaaaggtggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggacctggaatatggcgagaaaactgaaaatcacggaaaatgagaaatacacactttaggacgtgaaatatggcgaggaaaactgaaaaaggtggaaaatttagaaatgtcactgtaggacatagaatatggcaaggaaactgaaaatcatggaaaatgagaaacagtcgtatcgatgtcgagcgatcgcgcgcccgtcgacgc

SEQ ID NO: 546376 - DNA, 411 bp, Homo sapiens
gtcggccgcctactactactaaattcgcggccgcgtcgacgaatcatggaaaatgagaaacatccacttgacgacttgaaaaatgacgaaatcactgaaaaacgtgaaaaatgagaaatgcacactgcctggaatatggcgagaaaactgaaaatcacggaaaatgagaaatacacactttaggacgtgaaatgaaatatggcgaggaaaactgaaaaaggtggaaaatttagaaatgtccactgtaggacgtggaatatggcaagaaaactgaaaatcatggaaaatgagaaacatccacttgacgacttgaaaatttacaaatcactaaaaatttaaaaaatgagaaatgcacactgaagggcctggaatatggcgagaaaactgaaaatcacggaaaatgaggtcgac

SEQ ID NO: 546377 - DNA, 235 bp, Homo sapiens
tgcgcaaaaatgtggactcaatgcgacgagatctccatctgcggctatgtggacattgccatcccatgcaagaacgaagggatctcactcagtgtggttagatgtgcgatggatgctggcgtcggaaagttctgcgcatgggttgcaccatttcccgtgaacacccatggtaggtcatgcctgatctgtacttctacagagatcctgcaatgtagcttgaaaaagaaagatgcag

SEQ ID NO: 546378 - DNA, 305 bp, Homo sapiens
  misc_feature (127)..(127): n is a, c, g, or t
tggaatgatgatcagcttagtaaagctgtacacagtgtcatgtacctgtagccccaactgctcagaagctgaagcaggaggactgcttgagctcaagagttccagaccagcctggtcaacgtagtangaacctgtctcttaaaaaaaaaaaaatcagcttaagtcatcaactgggaattcacctgtatccatcacttccagctctcctgcttaaaccctggattttccttttgctcctgcttgcggaactttctttgctttcttcataggagttcccaaatagacatgtctccgtttcaaactgt

SEQ ID NO: 546379 - DNA, 280 bp, Homo sapiens
cgcggggcccgggtgcaagctagcgaccctctcccacctgcgcgcagcccgaggtgagcagtgaacggcgagcgggaaggcaagcgaggcgtttgcgggccccctcctgctgcccgggcccggcccggttatggcggccatccgcaaaaaagctggtggtggtgggcgacggggggtttggcaaaaagtgcctgctgattgtgttcagtaaggacgagtccccgaggtgtacgtgcccaccgtttttgaaaaatatgtggccgacatttaggtggacggc

SEQ ID NO: 546380 - DNA, 537 bp, Homo sapiens
  misc_feature (260)..(260): n is a, c, g, or t
aaaagctatattgtcttgggttttaggtccattaacttggaatatccttttccattcatttattctgaggtgctgtctatacttgatattaaggtttgtttcttggatgaagggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggaaagnacctggaatatggcgagaaaactgaaaatcacggaaaatgagaaatacacacttaggacgaaatatggcgaggaaaactgaaaaaggtggaaaatttagaaatgtccactgtaggacgtggaatatggcaagaaaactgaaaatcatggaaaatgagaaacatccacttgacgacttgaaaatttacaaatcactaaaaatttaaaaaatgagaaatgcacactgaagggcctggaatatggcgagaaaactgaaaatcacggaaaatgaggtcgac

SEQ ID NO: 546381 - DNA, 302 bp, Homo sapiens
  misc_feature (150)..(150): n is a, c, g, or t
  misc_feature (176)..(176): n is a, c, g, or t
  misc_feature (187)..(188): n is a, c, g, or t
  misc_feature (190)..(190): n is a, c, g, or t
  misc_feature (250)..(250): n is a, c, g, or t
  misc_feature (270)..(270): n is a, c, g, or t
tgatggtgtgcaagttatctgcattctatagaaaccacactttgcatcccaatacaatcattctgttgttcattttcagcacagacccaatacattacatgaaatactcagtatgttgtaataacccagactttgtgttagatgattttngcccctatgtaggctaacacaagtgnttctgagcacnntntaaagagcaggttaggctaggctaagatttggggaggctggctgtaattaaatgaatgtnggagttgatgctgtcacccnacctatgatgggcttttcaggacgtcgactga

SEQ ID NO: 546382 - DNA, 585 bp, Homo sapiens
agttatgagtatgatcacgttaagatataatatgaattactataggaaagctggaatgcttgcaggtactggtcagcaatttttgggtcgatcaatattaataaattggtgcttgtgttgattgagaaaagtgaaaattatagacaattagaaatatatactttaagatgtgaaatatggtgaggacaactgaaaaaggtggaaaatttagaaatgtttagtgtaggatgtggaatatggtaagaaatttgaaaattatggaaaatgagaaatatttatttgacgagttgaaaaatgacgaaatcactaaaaaacgtgaaaaatgagaaatgcacactgaaggacctggaatatggcgacgagaaaactgaaaatcacagaaaattagaaatacacactttaggacgtgaaatatggcgaggaaaactgaaaaaggtggaaaatttagaaatgtccactgtaggacgtggaatatggcaagaaaactgaaaatcacggaaaatgagaaacatccacttgacgacttgaaaaatgacaaaatcactaaaaaacgtgaaaaatgtcgacgcggcaacgaatttagta

SEQ ID NO: 546383 - DNA, 690 bp, Homo sapiens
tttctctatcctgggaggactggggccagaggggatgactccacaaggagacagagctggctcttcctcccacagtgtagagatcatggcgacagagtctacttccacactccaggtgccccaactataaatggataggtgggcaagtcactcaccctgcagcctcttgtttgactagaacctctaggtcatccagatccttgggccgggtccagcgggactctttactctggttgttatagtaataaggtttgcctgtgtccgacttgttatttttttatttacaaaaaaaaaaaaaacaacaacatttttttttttttttactctttccaggcacattgggacaggagcagctgcaagtggatgggataggagccatcagtgggatgggcgagttctccagccagtcaggggagctaaggggacctagtgagtagaggacacaggaacctttagctaccacctggcctggttcaaactgggaaaggtggacttcttgagatcctatggaggcatttccaggaagggtgaggaatggtcagggaccttgggatcagaggaaccatcatgaatatggttagagactaagggaaggccaaggacttggaagggtcagggcagtgaaaggaagggcagaagccagttaggactctgcttggatgagcagtgggtttcccaaggatgttgcgt

SEQ ID NO: 546384 - DNA, 335 bp, Homo sapiens
gcgtcgactgccctcaaaaggaatgatagacttcttccactccacaccataaaatgacgaaatcactaaaaaacgtgaaaaatgagaaatgcacactgaaggacctggaatatggcgaaaatatggcgaggaaaactgaaaaaggtggaaaatttagaaatgtccactgtaggacgtggaatatggcaagaaaactgaaaatcatggaaaatgagaaacatccacttgacgacttgaaaatttacaaatcactaaaaatttaaaaaatgagaaatgcacactgaagggcctggaatatggcgagaaaactgaaaatcacggaaaatgaggtcgac

SEQ ID NO: 546385 - DNA, 894 bp, Homo sapiens
gtcggccgcctactactactaaattcgcggccgcgtcgacgcgagaaaactgaaaatcacagaaaattagaaatacacactttaggacgtgaaatatggcgaggaaaactgaaaaaggtggaaaatttagaaatgtccactgtaggacgtggaatatggcaagaaaactgaaaatcacggaaaatgagtaatacccactttagtacgtgaaatatggcgaggaaaactgaaaaaggtggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggacctggaatatggcgagaaaactgaaaatcacggaaaatgagaaatacacactttaggacgtgaaatatggcgaggaaaactgaaaaaggtggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggacctggaatatggcgagaaaactgaaaatcacggaaaatgagaaatacacactttaggacgtgaaatatggcgaggaaaactgaaaaaggtggaaaatttagaaatgtccactgtaggacgtggaatatggcaagaaaactgaaaatcatggaaaatgagaaacatccacttgacgacttgaaaatttacaaatcactaaaaatttaaaaaatgagaaatgcacactgaagggcctggaatatggcgagaaaactgaaaatcacggaaaatgaggtcgac

SEQ ID NO: 546386 - DNA, 716 bp, Homo sapiens
gtcggccgcctactactactaaattcgcggccgcgtcgacgcgagaaaactgaaaatcacagaaaattagaaatacacactgtaggacgtggaatatggcaagaaaactgaaaatcatggaaaatgagaaacatccacttgacgacttgaaaaatgacgaaatcactgaaaaacgtgaaaaatgagaaatgcacactgtaggacctggaatatggcgagaaaactgaaaatcacggaaaatgagaaatacacactttaggacgtgaaatatggcgaggaaaactgaaaaaggtggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggacctggaatatggcgagaaaactgaaaatcacggaaaatgagaaatacacactttaggacgtgaaatatggcgaggaaaactgaaaaaggtggaaaatttagaaatgtccactgtaggacgtggaatatggcaagaaaactgaaaatcatggaaaatgagaaacatccacttgacgacttgaaaatttacaaatcactaaaaatttaaaaaatgagaaatgcacactgaagggcctggaatatggcgagaaaactgaaaatcacggaaaatgaggtcgac

SEQ ID NO: 546387 - DNA, 457 bp, Homo sapiens
  misc_feature (50)..(50): n is a, c, g, or t
tgaatcacttagtggggagagtaaagggagtaagagaaacttaacaaaantgcagtttcctagatcccacaccaaatcttcataatcagaggcagaggtgctttaaaagtgatggctgccttgtggggcttggagcaaggaacattcactcctgtgctttagctgtttatccatcctgatttggtgtagagacattaacttcctgtcttcatctagtcacctaaactcacccctgaaccttctgtctatgaagcagagaccatgtggtgtctctggatataaataataaatactcataaggaaaggcctttgggaagggtcacacaaaaggattctaaagagaaggtggggagatttttggaaaaatattagattaacaaaaagactaaacaaagtggttcatagaaaagacaactaaaaactggaaagacaagcagtcgacgcggccgcgaattta

SEQ ID NO: 546388 - DNA, 912 bp, Homo sapiens
gtcggccgcctactactactaaattcgcggccgcgtcgacgcgagaaaactgaaaatcacagaaaattagaaatacacactttaggacgtgaaatatggcgaggaaaactgaaaaaggtggaaaatttagaaatgtccactgtaggacgtggaatatggcaagaaaactgaaaatcacggaaaatgagaaacatcatggaaaatgagaaacatccacttgacgacttgaaaaatgacgaaatcactgaaaaaggtggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggacctggaatatggcgagaaaactgaaaatcacggaaaatgagaaatacacactttaggacgtgaaatatggcgaggaaaactgaaaaaggtggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggacctggaatatggcgagaaaactgaaaatcacggaaaatgagaaatacacactttaggacgtgaaatatggcgaggaaaactgaaaaaggtggaaaatttagaaatgtccactgtaggacgtggaatatggcaagaaaactgaaaatcatggaaaatgagaaacatccacttgacgacttgaaaatttacaaatcactaaaaatttaaaaaatgagaaatgcacactgaagggcctggaatatggcgagaaaactgaaaatcacggaaaatgaggtcgac

SEQ ID NO: 546389 - DNA, 913 bp, Homo sapiens
ggggtgggaggaggggactcccgggagggaggaacatggcggtggggacctcgtctcattcctgatgtggacatcgactccgagggggtctccaatgtatgtgctgatcgggagtccattcgtctccccgctcggggctccgggtttggcagagagcaaggagatcgtgcgcggatacaaggttgcggctgaggtaccattgtggacttctacggacaaatgtgttcggggcgaactgtgcaagaaggcaaggtttggcagacttgtgagtttgtctggggggggggggcggattttcttcccaaccaggaatgttcagcgggaccaagaggaaatggattccacgtgttgtaagcggggtaatccccagtggccctaattggttcctgtgcccaaggacacggccattttccactgtttggaggaaaattcaagatggccaaaggtaaccccgggattaagggagggtccacttttgggctaaaacggggcggggcttatgtgagaggccactcccacaggcgtggggtcctgtgtttgccttcaagtggaagggcaatttaaagaagaccccctggtttttcgtttggaattcctttttggaggtggttggcgctttagctattggtccttgcggaggacggctcttgtgtagcgctgtccgtttgcccaaccaatgggcctgttgtagcagccatgtgcgtaacgctttggcgcccaaaagagatttaaactggtttgtcgccagacaaatgacaacaaagaacccgaagcaagattttgtgggggcgcctggggccaagaaagggtttataaaagccctcttgtttggggcgcggccctgtatgtaatgagcgtttgacgcagggtgtgcccacaaggagctggggcaagaatgtgttggttccccaaa

SEQ ID NO: 546390 - DNA, 481 bp, Homo sapiens
cacgatgggagcctgtaatcctagctactcaggaggctgaggcaggagaatcgcttgagcccaggaggcggagattgcagtgagccgagatcgtgtcactgcactccagcctgggtgacaagagtgagactccgtctccaaaaaaaaaaaaaaagaatttattaacctggttggttaataaattgtgtggtccctgccgggcgtggtggctcacgcctgtaatcccagcactttgggaggccgaggcgggcagatcacgaggtcaggagatcgagaccatcctggctaacacggtgaaaccccgtctctactaaaaatacaaaaaattagccaggcgtggtggcgggcacctgtagttccagctacttgggaggctgaggcaggagaatggcgtgaacccaggaggcggagcttgcagtgagccgagattgtgccactgcactccagcctgggccacggccacagagcgagactctgtctc

SEQ ID NO: 546391 - DNA, 816 bp, Homo sapiens
gtcggccgcctactactactaaattcgcggccgcgtcgacgcgagaaaactgaaaatcacagaaaattagaaatacacactttaggacgtgaaatatggcgaggaaaactgaaaaaggtggaaaatttagaaatgtccactgtaggacgtggaatatggcaagaaaactgaaaatcacggaaaatgagtaatacccactttagtacgtgaaatatggcgaggaaaactgaaaaaggtggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggacctggaatatggcgagaaaactgaaaatcacggaaaatgagaaatacacactttaggacgtgaaatatggcgaggaaaactgaaaaaggtggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggacctggaatatggcgagaaaactgaaaatcacggaaaatgagaaatacacactttaggacgtgaaatatggcgaggaaaactgaaaaaggtggaaaatttagaaatgtcactgtaggacatagaatatggcaaggaaactgaaaatcatggaaaatgagaaacagtcgtatcgatgtcgagcgatcgcgcgcccgtcgacgc

SEQ ID NO: 546392 - DNA, 948 bp, Homo sapiens
tggtgccccggctgggtctgtgcggtgctggctgctcgggagagctggctggtcaccatggcaatgcgggagctggtgtgagtgcctgaattgcgtgtggtgtgccaacccgctcatgaagctcgccgggcacttcacccaggacaagggccctatctgtgcagtgagggatttgatggccatgtgccccctgtgcccccctggaggcccctgtgactctgagtgcagtccttcccaatgcctatttgggggagctaagcgtattctagcaatgatagcagtttgtgttgtgacttgaaaatatccttagcagtgggacccatgatatttgcgagcccgctctttgtttgttcccccgatggcgccccttcgaaagacccatattcaacggaatttggacttgaccgcatccgttggggcctttgacgacgttgccagggccactggagttatggaggccagtggtccaaaagaagcagttattcccggcccaatggtggcatccccccaaatgaacggaaatggcccccgcctattggagtttgattggtcgccagtggaaccttttggtagaccactatagggtaccctatgaacgagacgcgccttagggcgtggccccccaaacgttggaaaggctgcaccttacttgggccgagaggccttcgggcacgggacctatcgcccatttgttctgggggagatttggttacaacgccagttcccaatggtcggcatcctctcactttcacacgataggacagcgaagcgttgtaacccattgtggatttcccccccccaaatcggaaaagttctcgaacatctgctccttagcagagcgggtttacactagatggaagacccccctttttggagtccctgggaagggtaccccccacgattgcccccagcgcgcttgtgggggccctcggagggggaagagctctg

SEQ ID NO: 546393 - DNA, 561 bp, Homo sapiens
aatccaatccaggttcccaaatcgcccgcacatccaaaggatcccgacgtaaaaccgaggccccccgaccgacctcgtgattaaagggatgaccgacttacctaccccgtcggttacgaaagtacttggaaggtaaccccacccgatgtagggactagaagttacctctactagccctcgatctcctcccctaccctctgcgtctaccctcgactaaatccgtcgtacggtactagacgctaaaatagacctaaaaacgacctacctactagcgaaacagacgttataaaagtcgtaaagatatttatagataaaactcctaaatagagcctgacccccgcccccgcgagactcggaaaaataaaaaactagaagtgaagtaactcaaaacaaaacaaaaacgagaagaacctccctacactccggcacgttatcctaactaacctataaactcctaacactactaaccggtacctaagtcgtcctcgacgtctcaaccggtcgacgaggacgcggaccgctaagactactactctatttcctgacaaacgcgcgcgtgct

SEQ ID NO: 546394 - DNA, 723 bp, Homo sapiens
gtcggccgcctactactactaaattcgcggccgcgtcgacgcgagaaaactgaaaatcacagaaaattagaaatacacactttaggacgtgaaatatggcgaggaaaactgaaaaaggtggaaaatttagaaatgtccactgtaggacgtggaatatggcaagaaaactgaaaatcacggaaaatgagtaatacccactttagtacgtgaaatatggcgaggaaaactgaaaaaggtggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggacctggaatatggcgagaaaactgaaaatcacggaaaatgagaaatacacactttaggacgtgaaatatggcgaggaaaactgaaaaaggtggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggacctggaatatggcgagaaaactgaaaatcacggaaaatgagaaatacacactttaggacgtgaaatgaggtcgacgcggccgcgaatttagtagtagtaggcggccgc

SEQ ID NO: 546395 - DNA, 207 bp, Homo sapiens
taattgtagaaaaactagatatcgagcgccaaactacactaacctttaccgccttattaaccagattgtgtcctccatcactgcttccctaagatttgatggagccctgaatgttgacctgtacagtaattccagaacaacctggtgccctacccccgaatacacttccctctggccacatacgcccctaatatgccattcttgctg

SEQ ID NO: 546396 - DNA, 1391 bp, Homo sapiens
gccctcccctcctcctcgtggatctgagcggatgacaggagcatttacagtcgtatcattctcagactctagctgaacgaagtgagttctttaatgagcccatgcagtcattactggtacaggctcgcaggatatgtcctaccagcagagaagaggctgcccgattctacagttcccgaagcagcgaggcgacgtggtaaacgatcttcagggggccacagaagaaagaggaaaaaacgaggagtcattggacgagtacagaaggcttccggtgctgcaagagcaaggtgtccacgaagccatgctagcgacgcaagaccccagtctctgcttgcatccctggcaaagacctcagcatccagagccaccctgtgggcatgggaacgaagagagggctactcgtcccatggtgatcccataaggtgtggacattcactcccatgggcgggatgcccgagcctgagttgctgactcgtgactcaatatgggcatacttgctcctccattacatgatgcaacgttgcaattcggccatccttctccagctctgtgctctggaatccctggatttaacacccaagacacttactacagcacgatctcctaagcccaggtcctggggcgcttatgcattcgatagccaactcgcttactcatgccagtggacacgcaacacacggaagaacctttccaaattgagtttgaggtcccccgggataaacggatgtataggctatagatgccatgtcacgggtaataccaccggttagtgcatagcaaataacttgcacaagccacgtcaatgcagctgggggccaccacggggtgcttcatactacctagccgacacgaattgccaacacttaacgcacagccaacatcactccttcatacaaacagttagtgcaaacttctcatggcgctcaatgatttctctgcacgtagagagacacagtgacacatattggaacccctgacgacaccagacatagcaaagccgttttctatgccattagggtaaccagtatgtgaatacccaggtttccacaagtccgtatgccatagtctgtctctatccaatgattgatgtacaactgagaaaacccccaaggaatcttgactagctgccaccaccatacacagtcaacagcacccttgccagaatggacaacgagagctgttatccgcataccccaatttggacaattcaggacgcgaagaatcgcgcgctagtaaaatgtaagggtaccaacagcaaagactatattctttccgcacgtgtacttgcttgaacacgcgtcctactagtatcactgatagtcgactgatcgtggtgactcatctcaaattccagttcacttgtgtgacaacagcatgtgatcgacaggcaa

SEQ ID NO: 546397 - DNA, 939 bp, Homo sapiens
  misc_feature (907)..(907): n is a, c, g, or t
ggtcgcggtgggcccattaaagcgagaggagggagagggcggcggtgaggtatctatgaagtgcaggggaagaggggagtgtgcgccggaaaatgtgcggcgaggggcaggcccagggaggaagggtgatggagcttttggatgtaacggcgagggcttgtactctgtatggtggtgggtccgagagataactgggagagcagatgaggcgaggagtgaacttggcgtggtaagtatcggaatcggggaagggggggagtgcgcctaggacggaaaggggggtgagaaagtaggcaattttttcagaaagaagcaatgggtggaaatatgtaaggtgggaacatcgtcggagcgtgactacgtgccctcagggagtataagggagtcgcgtaacacctagtggtggggaggccacaccggggggcccaggggtgtgaccaaaaaaagtgactccacctgggccgggggggtggaacccacgtgttctggggacacccacagcaggtggggccactgacctcttaaggaggggcgaacatatgttcggcgcgttataaagggaaatgccaactggaagaaaaaaaaatcaatgaatacatggggttggaacccgcgccacggtggaaatcttacatcacgaaccatcggtgggcgggggccccccaggagtacatggaacagggtaccattgtgtcaagcaagaacatcggcactgaaagtgggggtccctacaaaaaaaacacgcgggggaccagcagcgtgacacacccaggtgtgtggggacggactgagacgagacgcagtccgagcgatacatacccaggcggaggaatgccagacctataggatgacaccaaacgagaacaccacaaacaggagtgatgaaagactggtacagcccgaagcngcagagaagaaatagaggagaagctacagcga

SEQ ID NO: 546398 - DNA, 104 bp, Homo sapiens
ccgctggaccccactccaggcattactttcctgagttgtgtggttgcagtaagacgcagaaatgcacaggcataaggggcaagacagcaacacaagaagcttct

SEQ ID NO: 546399 - DNA, 243 bp, Homo sapiens
gatcggtgccatgtgcactacgccaagcagcagggggtgggtcccggtctgcaacccttcaaccatggggcccagcacgtgggccagaggtaacccacctgtataaagctgacgtctaacacagagactagcaggaaacaaaaacagcacgacaacaaaaaaacaccttcggaagcaagtcgatgacaataggtgctcgtcaacaagctcacgtaccgcagctcgacaagagcaacatcacaa

SEQ ID NO: 546400 - DNA, 448 bp, Homo sapiens
ggctgttctggaggatcccgtgcgtgttactacaaggctacagtacaaaacagcatggtagggtaccaaaacagagagatagaccaagggaacagaacagaggcctcagaaataacaccacacatctacaaccatctgatcttgacaaacctgacaaaaacaagaaatggggaaaggattccctatttaataaatggtgctgggaaaactgactagtcatatatagaaagctgaaacgggatcccttccttacaccttacacaaaacttaattcaagatggattaaagacttaaatgttagatctaaaaccatagaggaagacctaggcaataccttttaggatataggcatgggcaaggacttcatgactaaaacactaaaagcaagggcaacaaaagccataatggacaaatggatctaatggtatacatgaacacgggtaccgag

SEQ ID NO: 546401 - DNA, 1005 bp, Homo sapiens
  misc_feature (608)..(608): n is a, c, g, or t
  misc_feature (695)..(695): n is a, c, g, or t
  misc_feature (713)..(713): n is a, c, g, or t
  misc_feature (734)..(734): n is a, c, g, or t
  misc_feature (737)..(737): n is a, c, g, or t
  misc_feature (817)..(817): n is a, c, g, or t
gttttctccgcgggcgcctcgggcggaaccgggatataatgggacagcacctgggggagccctggatgggtgcgggtcgctcttggcctgacgggcttagtgctctcgctctacgcgctgcacgtgaaggcggcgcgcgcccgggaccgggattaccgcgacgcatctgcgactgctgggcaccgaccatcgatgctgttcgacgcgatcttcatccgtcgcagggtggcggcagggggttatcgggctaggtggacgctagtgtgctgggacagagacgagtcatcgctcaatcaatcccaacagacagtattacaggttgtgcatcgttcataactatcagcgtagcgaggcgtacttgttagggttgtgccttgcggtgacgacagcgtaggagccttcctggtcccgtgatagcgtagcatgagcatccgctgcgtgtcttgcgtctgcttgggtgtcttgtcttacgctggctcgtggggatcccatgtgtcgttcagtggcgtcgtaatggcattatcttatgcgattttgttgtggtaatcgatcgacacatcatagcttatcgagacgggtgaggcgcgtagattgtcgggctcgaatgntttcgcggggagatagggtcccgaagagaacaccccgtatgcggccaataggtcgtgaagcacggcgaactgtagccgccatccaancctcgagaggcgcagtgncatgtatccttcgaatcctgncantgtggcgtgttgggacagtgttggagtgcctttggccctataaggggcgcgcacatactcctggtgtgtcccctaggaanggggccccttaagaaatggtggcggagctttcgtcatgaatgttacaccgccgcgttccgtaccgtggcccaataaccccggcgacgattgaaccaattgaggacccagaagatgttgcccaagaccgcatcagcgtccgtttattttacaacgccaagatgccctcatgacctcatggtccgccaat

SEQ ID NO: 546402 - DNA, 245 bp, Homo sapiens
tggtgaaaagatatatgtatatatatattcagaattaggctgctggactcagtttagatgatcccaattttgttggcttcatgcaaagcattgttattaggagccagtcgaacatatgccttcttctgtccatcaggccgtattagggtgttgaccttggccacgtgaatgtggtacaggttgttgacagcctgtttaatctggtgcttgatggctttaacatgcacaatgaacacaagtgtgtt

SEQ ID NO: 546403 - DNA, 992 bp, Homo sapiens
tgagacgtgctttcacttccaccatgattgtgaggcctccccagcatgtggaactgtctgctcctgtggccaggctggagagcagtggtgcaatcatagctcactgcagcttcaactccaggtacaagtgatcctcctgtctcagctcccaagtggtaagactacagggcctgcaccatcacaccctgggctattttcaaaaaatttttgtagagatggggtattgttatgttgcccaggctggtttcaaactcctagactcaagcaatcctctcggccttgagctcccaaattgctgggattacaggcgtgagccactgtgcccggatcctacttctctttctttctatcatatagtcaggcagcaatgaggcacctgggaagccttgggaacaatgcctgggggccagggcaagccccacagtaaaactgcttaccttaatgattggccatccgcactggcatcaacacgtgggtcaaaagaagaaaccactttccctttacttactagagggggactgtgaaagactattctttactaccttgcgaagcacgatcaacaactagtgggtaaatctgcgcaggggcaaagggacataccttgcggcaagggcatccggccaggagaggtgagtagggtaagaagttctctcatacattacctacaccaaattcccaagcccaccacgccaagcacagaaggtcagcgacacaattggtggcattacaccgggggcttccgccagccggatctggcaaaatctgtcgcgtcacagcgagtgtagccgacttcgaaacaatccatgctacaccgatggcagaaatgcgtgacacgaacttggccacgaacgcaggccatgacccgcgtatcacacatgggcgagccggacgtcccctgctcagccgcacacgaacgcttaactcaaaagtagatccgatctcaaaacgcaacgatcgacgacgtccccacatacaacactcattaactccca

SEQ ID NO: 546404 - DNA, 429 bp, Homo sapiens
tggcatccgcctgctggaggcacagatcgccacgggcggcaatcaatcgaacctgaagagagagccacacggctgaccgtgagaggtggactacaagcgcggactcttcgatgaggagatgaacgagatcctgaccgacccctcggacgacaacaagggctactttgaccctaacacggaggagaacctcacctacctgcagctgatggagcgtagtatcactgacccccagaacgggcctgtgtctcttgccgctgaaggagaagaagcgggagcggaagacgtcctccaagtcctccgtgcgcaagcgccgagaggtcatcgaggaccccgagacgggcaaggagatgtcagtgtacgaggcctaccgcaagggcctgattgaccaccagacgtacctggagctgtccgagcaggagtgcgagtggg

SEQ ID NO: 546405 - DNA, 251 bp, Homo sapiens
  misc_feature (48)..(48): n is a, c, g, or t
tcccctccctaagcgcgatcccgaatggcggtgcaggcgccctgtccngttcgtgttgttacgtgtttgaccagcacaggggtccgtttgggaaaatgtatggcttcgccctcagttgttgctaatgctgaagtttaaatctcaaggggaagggcccacctgcattgttgagtgtctgctgctgaaacacatgattgtgtttaggtttgaaattgctcaagtgtctggctcaggtggtggttctgagacac

SEQ ID NO: 546406 - DNA, 395 bp, Homo sapiens
  misc_feature (54)..(54): n is a, c, g, or t
  misc_feature (173)..(173): n is a, c, g, or t
  misc_feature (358)..(358): n is a, c, g, or t
aagagatctcccacctcagcctcccacagtgctgggattacaggcgtgagcgcncacacccagcctattcaaaatttttttttcttagagacagggtcttttttgcccaggctggagtgcagtggtgtgatctcggctcactgcaagctccacctcccggcttcacgccattntcctgcctcagcctcccgagtagctgggactacaggtgcccgccaccacacccggctaattttttgtatttttagtagagacggggtttcaccgtgttagccagggatggtcttgatctcctggacctcatgatccgcctgttttggcctcccaaagtgctgggattacaggcgtgagtcaccgngcccgggttcattttaaaatttttgtagatcagtgta

SEQ ID NO: 546407 - DNA, 174 bp, Homo sapiens
gcctaaagtggaactgcacgaaatatttagtgtccggcgcctatccagaacatagtgtatgacatcaccaggcttaaaactgctcttgaccacagagacatcgcgttctgcgtcaaggaaacgaagaatgttcttcctatatatgaaatacaagcaaagtttttcattaacgag

SEQ ID NO: 546408 - DNA, 439 bp, Homo sapiens
  misc_feature (36)..(36): n is a, c, g, or t
tcgcgaacgtgtatccaagcacctgcaaggtcctcnctccacatttagagcattaagatgtgtggggcatggtatcaatatcctctcctgccacacatctccagagtttctttcacagaagggactaacagttcaggaggcagagtacaggaattagaagactctccaaagaggagaatactctggaggtctcaataattaggtaaaattattgagaatccactgtgtgacctggaagagttgctgctgtagccttgaaaataaactcttagctctactggcacacctattttctgtcagacaatggcattccaaatataactgatggacaagatgttcagtattagctgcttatactggtggctttcatacacattttctattatcccaattctcttcattcttttggaggagagaattgggataacacgttcgcgag

SEQ ID NO: 546409 - DNA, 225 bp, Homo sapiens
cagccacagagtcaggagctggaggggacacctcagccctcataacagataccaaggcgagggcaccctcttgtccttatcttcgcccctggggtctgctctcacacacatctgctcctcagcacgtacggactggggaggggatcgctccttaaaccccaggtggctgaccctccccacccagaccaggaccactttaggaacaacaaaaatgacactgtgggg

SEQ ID NO: 546410 - DNA, 207 bp, Homo sapiens
ggtcatggagacgcgatgtccaaggccagatcgactctacggcccgggcaacctccgctgcgctacctccattactgagtgatcgtatctctcccacttcagcaccgagcaaatgcttgaggttggcctccaagcggctagcggggaaaagattggctgcttcatcggccggaaatgcgtccacgatcgcggtgaagcactgcggag

SEQ ID NO: 546411 - DNA, 1041 bp, Homo sapiens
  misc_feature (136)..(136): n is a, c, g, or t
  misc_feature (164)..(164): n is a, c, g, or t
  misc_feature (295)..(295): n is a, c, g, or t
  misc_feature (360)..(360): n is a, c, g, or t
  misc_feature (488)..(488): n is a, c, g, or t
  misc_feature (574)..(574): n is a, c, g, or t
  misc_feature (579)..(579): n is a, c, g, or t
  misc_feature (602)..(602): n is a, c, g, or t
  misc_feature (607)..(607): n is a, c, g, or t
gggaggtttccagaagcgctgccgcaccgatcgcgcagctcttgccgtcggagcgctgttgctgcctcgtactcctccatttatccgccatgataagtgccagccgagctgcagcagcccgtctcgtgggcgccgnagcctcccggggccctacggccgcccgncaccaggatagctggaatggccttagtcatgaggcttttagacttgtttcaaggcgggattatgcatcagaagcaatcaagggagcagtgtgggtattgatttgggtactaccaactcctgcgtggcagtntatggaaggtaaacaagcaaaggtgctggagaatgccgacaggtgccagaaccaccccttcagtntgtggcctttacagcagatggtgagcgacttgtgtggaatgccgggcaagcgacaggctgtcaccaacccaaacaatacattttatgctaccaagcgtctcattggccggcgatatgatgatcctgancgtacaggaaagacattaaaaatgttccctttaaaattgtccgtgtgctccaatggtgatgcctgggttgaggctcatgggaaatngtatnctccgagtcagattggagcattngtgtngatgaagatgacgagactgcagacaattattggggcacacagtcacactagatgctgtggaatcacacgtcccagttatgtcaatgactcgcagagacggccgctaaagatgctggcagatatctgggactgtatgtgcttccgggtgactaatgagccacagctggtggtcttggctgtggtcctagaaaaattccgaagacccgtcttggtggtaatgatttacagcggggggacgtctgcgttcccatcgggaatccgacaaggcgcctttggcgggaatcccccaaggggaaccctagggggcggacctaacccgctgttggctgtacgagtctcagcacaacagcgctgtggaacactcgttcaggagcagggcaagataagacccacgaagaaagccaatgatacgccgaagcgcacgtggaaacgcg

SEQ ID NO: 546412 - DNA, 685 bp, Homo sapiens
tgcccttgacttgagtaacctcgagaggcttctcccgtcctgtggggtctttatctggatccccccggcctacacacttacctgcgctcccagatgagcccagtgagccccccgcctgtcagccctaattggggaacccggtaggtgcacgtctcatcgcacatgctggcagcctcacccacctggcccagtatcccagcatcccaccagtgcagataccttggggctgaaaaggccctgttcagagccctgaagaccaggggtaaccacccccaaaatatggactccattttcccactccccaccttcattggccgagcagctgcccagaaccaaggccgcatctcccgatacctggccaaccaatgcaagtattgcctcacgaatcgattgcttctctgaggtgcccacgagtgtattcggggagaagcttcgagaaccacacgttgaagagcgactgtccttctatgagactggagagataccccgaaagaatctggatgtcatgaaggaagccatggttcaggccgaggaagcggctgctgagattactaggaagctggagaaaccggagaaggaacgctttaagaaggaaaagaaaacggctggctgcacttgccctcgcgttttccaggaaaccgccgtagtactcccgaggagtgtgaggagacgagtgcaaacccca

SEQ ID NO: 546413 - DNA, 365 bp, Homo sapiens
agctccccctggaaggggctagtagcagaaagtaggggctgaatttagcccagacttgacgtgggccttgacttgggctgccaaccctagaggcgggcttcatgcacttcctttatatgatatagcacctgtttgcaatacacagttagatgtggcttttatggagaaactcaactgagcttggtttcatctgggcttgccacagcccagcgattctcttaattgttttagaaatgatcaaagttggctgggcacggtggctcatgcctataatcggagcactttgggaggctgaggcggtcagatcacttgagttcaggagttcgagaccatcctgaccaacatggagaaaccccttgtctact

SEQ ID NO: 546414 - DNA, 776 bp, Homo sapiens
gcttggaagtggggacatcaggatagctgaaggaaatccagacacccagagcatctcggagttcagactctcagacctgaagtaggcgcccccgggactgggctaggagttggacggaatggaggatggaggacagcgagaataaaggaagagaaatgcaacgtgtgggcagccgccaatgagtgaaaatagagggaagtgtcatgcaaagtgctggacacgaaggtcggcacggtgggacgatgctcccacagacctcctccgtcataaaacgatgcacctccaggactcagtgatccctgggtggcaggctctgccattcctcggccacacgtggctccggcacccatggtcccagtgccttggcactggatgcatcggccacgttctggcggccagatgtgtgttgctctggaatccagtcccatttccttcctggccacgcctgtccacgctgccttcttcagccgcattcagcccctacttacctggggagcccggtctggggcacgagagcgccagtggggctagggcccaaagggatcaggagaatcctctggcctggaaggtatggtgcacgcttacccaagggcggacccggtaggaggaagcccaggagctgggtcctgccgcaccaggagctgtgccctgcacaccaggccgggctaaaggacatggcatggctgggcatcctgacactggacttgggcgacctgagaggcacagggaggggacgagatgggcgaccgcgcacatggatgtcaccggcataccac

SEQ ID NO: 546415 - DNA, 864 bp, Homo sapiens
gcctccccggtccgtgggtgcccggcgcgggccctagacgcggaggcggttcctggggagagggatccgggaatcctctgatgcgggcccggactactgatctacggaggctggggtcctgcacgtagtcgccagtcggccgggtcgcgagacttcccgtgattcgctccgtgaaccgcgaaggtcgcgatgcgttcatgtctgcagcgcactcgacgcagtcgctctgaaagatcaacgtggtggcgagtgcatgagcgcgtgaagtcgctgtctgtaggaggtccacatggtcgtcgttcacgcaccatgcgacgaaggcatggtggctcaatttgcaagggtggcgagaccaacagagggtcactcactctactggccaccctacttgctggatgcaccccgatgttcagtacatgcggtgtgacccactgatgaacgtactgcacaacacgcctacaaggatcactcagcgaattgcctacctgtcaccagcgcaaactagcttacgcacgcccataggccacaggttcagtccgatgagcaagctatatggtcatcgctgcgaacggacgtcatagaccaccagtaccagtgccagtcactagggcacccgaagaagactagtaggcatgtgcccctaccgcggcaaactagtgtgcgtagactggccgacggaggtctctaccagcaatcagtcataccctagccgtctactaggccgcttgcccaagtgcttgtgggacaaggtacatccactgaggctgaacgtggaagctcagctggtcatggcctatcctgtgatacccaggtggacaacagttgtcaagtgcgtggaccctgaccgtgcctgttctagacaaa

SEQ ID NO: 546416 - DNA, 166 bp, Homo sapiens
  misc_feature (39)..(39): n is a, c, g, or t
agggatagggtatacttcctaagtgtagatctggcatcnataacgcagacacattattgttccatatatacctgtagatattctctcccctcaatatttatatctcgactaaaaaaaggaggtgcaaagagtatataaagataaatgagattttcttgctgttgtt

SEQ ID NO: 546417 - DNA, 331 bp, Homo sapiens
ccccgttttggggggggttttttgggccaaaattgggggcccccttgcccccccttaaacccccccctacccaatttttttaaataatgggccggggggggggggaaaattggggccgggggtttgggccctttaaaatggggtttttttttaaaaatttttccccccccccctgggggttttttttttgaaaccggttcccctcccccccccccggttttggtggcccgcccccccctttttttctggggggggggggaaccctttttttgcccccggggttgcccttttttttttctttggggggggaaaaaggtttaaccccgtttta

SEQ ID NO: 546418 - DNA, 1728 bp, Homo sapiens
gtccatgggtgggacacagacagcaatttgtggagggggtccgcatggaagaaatagttgaaggtagtaccggagcccttcacatcctagctcgaggatgttcacaaccgaaattgattatcagaggactaaaataccacttccactatgtttgtgcagctgcatatatagttctccacatatgaaaacagtccaagcagcgtagcatgacagggagatccgtcatgtgaacctatgcatacagaggcacaaggacaaagctgacaagcaacgactatatggaagactagagaggacagaccaagcagacataccatacatgtaacaagacaggattaagctatcgacatacatcagagaaacatgcacaggctaggtcggacaggcacaaatcatagaccagccatgacaatagatatatagaggtatccagaaaaatggatcctgcaggagacacacagggcgacaacacaagaaatgatacaaccacgaacccacagggcgtactccacaggaatagacagacatgaacacacaaggacagtacatgcattcatgatccaaggaaacacaagaaagagcacaaaacatggagacgatacggagacaaacatggacagcagcagttggaccatgcaactcgctccagggcgacacatgatgcgagatacatgacggaggtagacaccccaaggagggaaaagcaacagcgaccacaaccatttaggagacaactataatacagacacacacgaggaacgtgacacgatcaccgatcacagacaattagcatccggatacaccatatataaaacacacacgtttacaattggcggatagcgggcaaatcaacttggagacacacaaagggaggcaagtaggccacaattaagcagagaatcaattagggcacgcccaacaccgacaatggcaactagagggacaacaccaattggaaagccaaataggtcaggaatggaggacaccaaaagacaacagaccccatgggaatagcgcatcagcacaattcacatgaccccaacgaatatgggaacatggggagacagtagggacaaagagaaacatcacatgggaaacggaaccatagacacacacaaccagaggaaaacacccgcaccaaaccataagcaaacaatggcgaggcaatggaaccactacccccacatagaaattgacaaacagagacaacacaaaccaagaacatcgcgagaacacaggagcaataatggaaaaaacagcatcgcacacacctagcaatagaaccagcagcactacacgagaagaacgtgaaaagaataaacaaacataaacaaacacaagacgagcacataacagaggagacgacgagccacaaccaaagaccgcacacgccaggaaccagccaaaaggcaccaccacaaacgacaacaacgggagagcaaaacacagacgcaccgaacagtcggagccacatgcacgaggcgcagaccgaccacgccactagaccacgtcggcacgcaggacacacagcacgcagcacagcagccgaccagacgaacacacgacacgaccaccaccagccgaaggacaaggggaacaccaccacacgccggccacgcccacagctaaacaaaacaccacacacacagaccacaagactagcgaaccaacacaacgagacagacagaaaaacacgacaccacacccgaaacgcagaggaacagcgcg

SEQ ID NO: 546419 - DNA, 782 bp, Homo sapiens
taaagtgcttcagtgagcacagatatttgttgtgtcatgactgggagttagttttgcttatctttgcctagttcttaaatctcaaatttgtttcacaacttggtaatcagagaccagatcctgtctctaaagtgtaaaaaggtaaacaaaggttttctgtctgaagtaattagatttgaaaaaaactgctagggtaattgagccttgcattagaatgttatttaaatggtttaattagtatttgagatttctaaatttaatggctcttataagttagggcttagtttaaactctcgaaagctgggatcatagattatctatcattactatgtatttaatttaaaacctagttatatcaacatcaccattactgtgaatacattataaatattgtcaacattattgtaaatgtgtattattctttgtggcaaaattaattttttttttttttggaaatggagtctcactcgtgtcacaaagcctgaagtacaggggcgcaatcctcagtccatgaaacctctgctcctggtgtcaagcaattctcctgctcagctcccgagtagtgggattaagggccaccaccatgccaagtaattggattagaaaacggtttcacatgtgggccggtgttgaattctggccagtgtcactcctagctccaaggggtaatgggcaggggtgaaccgacaggagtgccctggcccaaggataggttgccctgcaaaatgaggttaaacaagatttaaacagaaaagatcggtgagaaaaacgtaggcaaaaat

SEQ ID NO: 546420 - DNA, 224 bp, Homo sapiens
acagggactccccacccacaggactccacttcacccacaggactccactcacccacaggactccacttacccacaggactccactcacccgcagactccactcacccacgggactccccacccacaggactccactcacccacaggactccactcacccacaggactccccacccgcaggactccactcacccacaggactccccacccacaggactccactca

SEQ ID NO: 546421 - DNA, 880 bp, Homo sapiens
  misc_feature (478)..(478): n is a, c, g, or t
ggttccggccacaggcttaacgttattcgctgtcgtttgcggtctcgcgcagggcggcccggttcatggtgtttagtcgtcggtatttgacaaccaccatgtcgagcacaataggcaatagaccaagacctaccaagaagcgccctcagcgtgcaacatccaatgtgtttgccatgtttgaccagtcacagattcaggagttcaaaagaggccttcatacatggattgatcagaacagagatggcttcatcgacaaggaagattttgcatgatatgcttgcttctctagggaagaatcccactgatgcataaccttgagtgccatgagtgaatgaggccccagggcccatcaatttcaccatgttcacggaccatgatttggtgagaagttagaaatggcacagatccgtgaagatgtcagtcagaaacggcctttgcttgctttgatgaagaagcagacaaggcagcctagttacanggaagaccttaacctaagagaagctgcgtgacaacccatgggggatcggtggtacagatagaggaacgtggatgacgctgtaccagagagagcaccgtgagttgacaaaaaggggaatttcaacagacatggaggtcacacgcatcctgaaacatggagccaaagacaaagatgactgacagaactttgagcgtgagaaatcttccagttagcattgtgcgttactctcatgttacatactcagacacggttcccccaccgctcatagaacctgtggcatgcaactttagtttcacagctttgcctcttcttttggatgtatttattcctagacctttctgccaccttagcacattgctataatcagatccggaaactggggatgacgggtgtaaaattgta

SEQ ID NO: 546422 - DNA, 938 bp, Homo sapiens
cggcctcatttaataaatatatataccttttacatctcgcttcatcggaatagatatatcggcagactcatatcgtcgtatatgctgagaagggataatatatcgtgtgatatagtatctcataacctcaagacattccctcttagccaatatgtgtgcctattggatattagtcagtggtggcctggataaagaaggtgtggcctaggccatactagttgctcaatcttgaacacatatggactagactagagtacagtaatcgtaaactactcaaaggctaaaatttaaatcgtcaccaaatgataatatgatagcagtgagatgagctttcgcaagacgcacataactttgacatgaaaagaaagcaccaaagtgctagatgaataagcagtcatccctcgtcatagtgttagtaaaccaacgatgctgcaaacggaccgtaataagcgtgttccgccgaactgttccatgcggccaacccataaaatccgcatcagaggtactaacgtagcgtgggtcgacccataacgacaagggacaagcaaccgcgcacttatgcaggtgagcatgctagcacgacacgacacccaaccgtcgtccaaaacgaacagtcgagaacacttcgtaaagacatgcgaatccacaggcaaggagaagcaacttcaaacagactccagacagacaggtccccaagtttggcaacagacccgagagggacaagcaacaaccagacccacgcctaccaatccagccgaagagaccctcccaccccgcgggtaccaaaacctagcggaggtccaaacacacgcagatcacgccgcaacaccagagtacacgacagagaagacacaagcaaaaagcagccagggaagagccacacagaacagaccgacacacacagcacgagagacagcacaccaccccccagcaccgaa

SEQ ID NO: 546423 - DNA, 1044 bp, Homo sapiens
  misc_feature (631)..(631): n is a, c, g, or t
ggctctccgccgatgcgctgtgcgtggaaccactccgggccgacctcgaggcctcctgcactccgcccggacccccggcctgccgtggctatccagtctcttcgttgctattcccatgggtcacaggaagacagatgaggagtttgatgctcgctggcgtaacagtagcttacaagcaaggctcagattatcgcatgcctgtggaattgctgtcatagggataaaccaccacttgttgacctatgatatggttccaggagcccaagaatcattgcatgctgtcttttgcgggccatgctacgcacgtgttagagactgacttttgcttaggtacagttcgtatcctaaaggtgtgagaggacaaatgcatggacctcataaggaaatctacccctatgtcatccaggaacttagaccaactttaactgaactgggagtctccactccggaggaacttgggccttgacaaacgtgtacaccgccatggcatgggcttccccaaggatttcttgacattgcgtacttgacgtgtgaaccagttaccttggcaaagtactgcagtgataacatattacgctgtatttgagaccagaggttcctcgcgttgattagagtacccacagacgcatgntacatgggtaagcttggtactttacttatgaacgggacaatgcagtgttgaagctgagtacctgattcaccaatcaacagagcaaacaaatatggacgggcccagcaaaaagagaaggccataaccaagagagatacgggccaaggggctgacaatcaacagagaagagcacccggaatgtcggggcccaaagtggccattgggaagcgacccttgccaagtcgttcgcacggtacacatacgggagcagctagcaggcaatgcaaaacagcgtaccattgtcatcgacgagaaaactccattcgaaccgatactaaaggggccggtcaagtcagacgcgcgcacaagaggcagggactcccagccctcacggaaccccggaccattggatggatagtgggaggcagggtccc

SEQ ID NO: 546424 - DNA, 427 bp, Homo sapiens
gaggagaacagggcgccagatctatgccagggagatctcaagcctggtggacaacaaggagcttcgaactggtgctggtgggcatgggtgccggacggggcacacagctccctcttaccacagtcacccactgggctggatggcgagcagctggtcgtgctgaccacgaggccctcccaggcacaccgtcgcatgagccttagcctggctctcatcaaccgtgccaagaaggtggcagtcctggtcatgggcaggatgaagcgtgagaaccaccaacgctggtgagccgggtgtgcatgagcccaagaagttggcccatctcgggtgtcctgccgcactccggccagctggtgtggtacatggactacgacgccttcctgggatgagggcgcctgtgcccctttgccggcttcgctcctgtgctttc

SEQ ID NO: 546425 - DNA, 394 bp, Homo sapiens
  misc_feature (34)..(34): n is a, c, g, or t
  misc_feature (100)..(100): n is a, c, g, or t
  misc_feature (189)..(189): n is a, c, g, or t
  misc_feature (225)..(225): n is a, c, g, or t
  misc_feature (238)..(238): n is a, c, g, or t
  misc_feature (250)..(251): n is a, c, g, or t
  misc_feature (277)..(278): n is a, c, g, or t
  misc_feature (282)..(282): n is a, c, g, or t
  misc_feature (284)..(284): n is a, c, g, or t
  misc_feature (297)..(298): n is a, c, g, or t
  misc_feature (300)..(301): n is a, c, g, or t
  misc_feature (313)..(313): n is a, c, g, or t
  misc_feature (318)..(318): n is a, c, g, or t
  misc_feature (320)..(320): n is a, c, g, or t
  misc_feature (332)..(332): n is a, c, g, or t
  misc_feature (369)..(369): n is a, c, g, or t
gacttcatggagaatgaatgactcggggggattnagatcatgaagtcatgagaagaaggcctttctgcgccagggatgatgtttctcagatatgcaatantcacgcttgtgggtttttttcttctatttcttcgcagcagcttattgagttcactcagttaaagtcatctattttctaacctgagtgtncggagggtgccactcggaacatgtcaagtgtttgtnaaacagcattttngacgccacctannccccataaggcggtgttctcgagccnnggtncnagaggtgaacganngnntctggtttgacnactgnangggctacatcancaggtcctttcaccaactgtaacgggagggcatgggnacatccccacaaaccaccagacact

SEQ ID NO: 546426 - DNA, 334 bp, Homo sapiens
tgacgagattgaaaaagaagagcaggctgctgctgaaaaggctgtgaccaagatggaacttcatggcgaatggactgctccagctcctgagttcactgatactcagcctgaggttgcagactggtctgaaggtgtgcaggtgccctctgtgcctatccagcagatccctactgaagactagagctctcagcatgccacggaagactggtctacagctcccactgctcaggccactgaatgggtaggagcaaccactgaatggtcttaagctgttcttgcacaggctcttaagcaacatggaaataaggctgatggaaaataaacatcagtttct

SEQ ID NO: 546427 - DNA, 171 bp, Homo sapiens
cctcacattagctgtatcatattatgtggcaaagaccatccagttatacagtgtaatatcagagcagcttggaaatatacagcatagtaatcaactgagaataaggaggagggaaggaggtgtcggatattagagaaatgaggagaagctctccacacaaggagatgcaag

SEQ ID NO: 546428 - DNA, 138 bp, Homo sapiens
gtggggaaaaaaaaaaggaaaaaaagaaaaaaaggtttttaccgctgtttgttttttaatttaaaaagaaagaaaaaagaactttgtcctggacctttttcagacttgccgtttacagccttaaagtggttcccccga

SEQ ID NO: 546429 - DNA, 345 bp, Homo sapiens
aggatcccccatcatgaccgttcctggaacgtgtcttggcgcctgtaccctgggcctccggtatgtcgcacggtctccagctatgctcggtgtagctgcagctgctgcaggaccagctcgtcgtcgagacgtcacagctctttcttttcagcattggaacggtatgcagcggataaagacgggctccgccttccctagtgcctccaatagctttttcagggatgtctggaactgggcgctgatgcttggtggctttttcttcttgtgcaggtgcagtatggacttggtggtgcggtcgtgcagagtcatgctggtcggagtctcagttatagcttgtgaggacgg

SEQ ID NO: 546430 - DNA, 247 bp, Homo sapiens
tcgatctctagcaggatccccttattcgtgttgcactaggacataccatgaatacttttgtccatggaacaaatgacggtgggaattctaaacaaagcaagttttaaacacctgtgtttcacttcacagtttacaagtcccatcacgctgtatcttaggactcggcagcttttgaaggtacagaggccacacaagaaccagcttagctgagcatcattttaggccctcatttggaattgtccctttg

SEQ ID NO: 546431 - DNA, 185 bp, Homo sapiens
agactgtggtgctgttcgtgggcctgttgttcgccagccgctggttgctgccgcgcctgttccgtgaagtcgccgcgtctcattcggcggaactgtttgtgctgctggcgctggtgattgtcttgctcaccgcctggctcacccacctgctgggcctgtcccctgccctcggtgcattcctgacg

SEQ ID NO: 546432 - DNA, 114 bp, Homo sapiens
tcgccctttttttcccagggcggatgtacctgcgctcagttgcctgggcgggctgagaggcgcgggttgaaaagtctcgtacccgagttgggagagagagagaagagcgccatc

SEQ ID NO: 546433 - DNA, 182 bp, Homo sapiens
ctctgatccggagtgtccgggggccaagtgattacttcgagtgtgcctaagatcgttcaactggggaagggacagtgttctcaccaaatgatattcggaaaatgctggatatccagagggcaagaagagtggaacctttacctaagcaccatgtgcaaaaattaacccacaatacatgaaag

SEQ ID NO: 546434 - DNA, 1480 bp, Homo sapiens
aggaagatgccgaaaggcaaaacgaaccggccaacggcgaaagaaggtggctccggccccagctgtcgtgaagacagcacggaggctaagcaacagtggtgaatcccctgtttgagaaaaggcctaacaacttttggcattcggacaggacatccagcccaaaagagacctcacccgccttctgtgaaatggccccgctatatcaggttgcacgcggcagagagccatcctctactacagccggctgaacacgtgcctcctgccgatctaaaccagctcacccaggccctgcgacccgcccacaaacacgcctacctcagcctgcatctaccgcctggccccactcaaagctaccacgcaccacgacgcaccaaccgctcacgacggacacgaacggcccgagcaactgcctcgcgccccccgcggccccgcacgacacgaacggccctgcctcggcctacaccacgcgcgcgaccgctccccaacagaacacccagtacgcaacccccggtcccctccgccagcccagcgcagctctacaccaccccgctccaacccaaccctcatgcgctggcgcaacggaaaccaccgcacacacggcctctcagccctcgcggtccgcgcagcactctcggccgaccaccgcaaccgcttgcgccaatcccacccactccccaaccctcgccgtccgctcctccttcgctctgacccccttgcccccccttgctcgcctccggcctcacccaactcgcgcgggggttctcccccctgctcaccctcgtcccactttcccctcccaccagcgggcccacccgccgccaacccgcacacttgggcgcccacccacttcccttcacgccttccccccacacgcgcgcccccggcaacccctctgcccacaccctcaccctggtctccgcgccccccatcttccgcacccacccaggaggcctcgacacacactcttcaccggaggcaaaaacggcacgcacacaacaccgcggcctcccccctctacacgacaccacttcacaaccgcctcaggcgacttggggaaacacgccgctaacttcacacgagggagcccacaacactcacacccacaacgtggacaccacagcgaattgacccgccaacatccgcaacgacaacttcccccagcaccaggccccaccaacttgccagcgagccttggcgcacaaaacttgacctaccccttgtgcgagcactcccatcaacaaccactccctggcaccgacgccagtcacggcatctacattacgccagccaagacgccctctccgggcacaacaaacacgcgcttcccacaacgcgaggcccttacaccacacgcgcaaacccctctggcccctccacaccacaaacaacctctgcgccgcgcccatcaaccaactgcgttacaccaccttggcacttccaacaagctctcatcctgtggccccacccactttcaccacta

SEQ ID NO: 546435 - DNA, 692 bp, Homo sapiens
gtgatcacaaagcggggcgcaccgcgtggcgccgggcaacgagccggtgaacgaggcgaggcccgtgtgcccgctgtgttgcaatgcgccctgcctgtgcggggagatgggtgcctgacggctgtcaggcccgtggctggcggcttcccttagtgctgccttggggctgcccttcctccgtgatcctggccgtctcgcttgcccccagctcctctgcacccccattttctaccgaacacctccttccctagtcctgtgcccatcccaccctagcgtcagtggggcctttcttgaaagaagcccgaaactagaggcgccctggtcacgcctgtgtgaaagaggacgctgggatatggcatggtgatcagacaggcagcataaggttactccgggatcatttggaaaggctatcattgaccgggaggggttgcacacaaaaggtgaggccgagtatgagagtctgctctatggtatgatggcacttgggcgagagagggacggggttggccctggaatcaaagcgctacagtacacatcccgtaccatatcgcctaccgtacggagattagtacttccgtttcgatacattggacttggaatgggattggcctggactgataagaccgggtcgttaaggaggtggacggaggatccagcttggcggaacaccaaatgaagccccagcgacgatt

SEQ ID NO: 546436 - DNA, 434 bp, Homo sapiens
tctaaggatcctacttttcacagggaagaaaaggcgagcttcgcagctacatcagatccggatctagaatctctatctcacgaacacggacgaataaagcagtggtaatgtcgggcgtttgaaacatagtggacagatatgtggtgatcatgctttgtcgttgacgtccccgctccctgaatcggactggcgtgataatatactgtgtgaccttgcgccaaagataaatctgcagacgtcacttattcattctcggatgttctattgctcacgatcttcgtcgagtggagagaagttaggctctcacgttaatccagttctaactcatgagtcaaactgagactgcaacaaaagaacgccccttttttcttttacatgattttccctttcccctgagtatacttcctgaaccaagaagaaaacaatcaacagga

SEQ ID NO: 546437 - DNA, 488 bp, Homo sapiens
gggcctgttccccctcacgggagtcctccgcccgggggtccggaagcagtcgacggcagactcctgtgccctgctgagccaccctgatgggtggtccctgtgtgcctcctgctgtgaccctgtgaatcttggtgcccatcgctgtgacccagctgcccctgccccatgtctgccgccagtgggcttccaccacgaccgcacgtgaagtgggggggggggggcgctgcagtgcacctagccatgtggcaggacacttacccgtactaacccggtgacacacggtaggacccagcaagactgtagtacagtgggccatggatgacgaacggggtagaaagggcagaatgaacctgtgcgcccgagaatctgcccccagggtgtccacccggtggaaatgccttgctgagaaggggtcaacaccacacggagccttgtggccctataagcctccaaggtggaacacacacctgtgatttccacggttgggg

SEQ ID NO: 546438 - DNA, 144 bp, Homo sapiens
gccgccgaggataaccgtgtgctattagccatggtcaaccccaccgtgttcttcggacattgccgtcggacggtaggcccttgggccggttctcctttaagctgtttgaaggaaagggcctaaggaagcagataatttttcggg

SEQ ID NO: 546439 - DNA, 491 bp, Homo sapiens
  misc_feature (75)..(75): n is a, c, g, or t
  misc_feature (168)..(168): n is a, c, g, or t
  misc_feature (173)..(173): n is a, c, g, or t
  misc_feature (227)..(227): n is a, c, g, or t
  misc_feature (249)..(249): n is a, c, g, or t
  misc_feature (251)..(251): n is a, c, g, or t
  misc_feature (253)..(253): n is a, c, g, or t
  misc_feature (255)..(255): n is a, c, g, or t
  misc_feature (257)..(257): n is a, c, g, or t
  misc_feature (260)..(262): n is a, c, g, or t
cctgcacccagccatataaaggctttataatcttctttaagtattctcacagaagactcttcctcatctttgtcnaagaggaaatactaaataaattattgcccaggcattgtaatgtaggtctcaaattctagaactgagtaaatcagttgtagttagtaatgtttnccctntaagactaagaatgtatcccagaagtggacttagaaaataatgagagccgggcntggtggctcatgcatgtatccnanantncnggnnnctgaggcagaaggatcatttgagcccaggagttctagaccagcctgggcaatgtggggaaaccccatctttaaaaaaatacaaaaattagcctggtgtggtggcatacgcctgtggccccagctacttgggatgctgaggatgtaggatcatttgagccgaggaggtcgaagctgtagtaagccgtaatagtgtcactgcactccagcatacgtgacagagagagaccc

SEQ ID NO: 546440 - DNA, 580 bp, Homo sapiens
  misc_feature (1)..(1): n is a, c, g, or t
  misc_feature (188)..(188): n is a, c, g, or t
  misc_feature (204)..(205): n is a, c, g, or t
  misc_feature (245)..(245): n is a, c, g, or t
  misc_feature (521)..(521): n is a, c, g, or t
ntttgcttattccttgtgtttttcatgggtgaatttcgttggctcacgtgaaaaatattttagacgaactaattgagaacttctcttcccgggtcctgaccgtttcctgaaaactgttatgacaatactaatgaatttcaagggtaacctatgtaagtctatctctatatagaagtaagatgcattantattctgctatcagtnntagtaatgacatacagtcccatgttttccaaacattgttngactactccagaaaattaggctgtgaatggcagcagagtggatggatttttcattcataacaggcacagatagtatatatggagacaagcatgtttatcctgagaatgtgaatgctgtggactgcaactcaagatctcccattactgagaatgggtcctttgccctctggtcactcttttttttttcaactgtcaatttttatttctttttatcatagcggcggcagcaaataagaatgctgacatcatttctaccgaggggggcggggggacgantttcatcttctaccataattaaatagtgcagctgaaaaggcattgagttggtacatttc

SEQ ID NO: 546441 - DNA, 148 bp, Homo sapiens
taccaactaaatcacagtcaaaataaatgaagagctcaagatgacatcagaacccatatgtctataagtcctggtgtagtagtggatagacaagcagaagccagattatgatgacatggtgcatcgatccaagaataatatgccacat

SEQ ID NO: 546442 - DNA, 389 bp, Homo sapiens
  misc_feature (14)..(14): n is a, c, g, or t
  misc_feature (300)..(300): n is a, c, g, or t
ccatccatagttcnaacactatgtcaccctccctgctttttaacaatattaacaggcttagggattagtgctgacttccctattagttcattaccctgttaattttaaaaagaaataataatggctgggtatggtggtgcacgcctgtaatcccagcactttgggaggctgcggcaggtggatcatgaggtcaggagtttgagaccagcctgaccaacatggtgaaaccccgtctctgctgagaatacaaaaattagcctggcgaggtggcacatgcctgtaatcccagctactcaggancctggggcagaagaatcacttgaacccgggaggcggaggttgcagtgagccgagatcatgccactgcactccagtctgggcgacagagt

SEQ ID NO: 546443 - DNA, 227 bp, Homo sapiens
ctgggacgcgaataccatactcagtctggtagtcaccctcttgagtgtcgggatggacgaagttacaacgttcgtccactctgacttctcggactcgcggcgtatggtcactcggcgtgtgcagtttggtgtttcggcgtgtgcatgcacacgccgagactccataccaccctgaacgcgcccgatctcgtctggatgctcggaagtcgctgtggacgaagttgttg

SEQ ID NO: 546444 - DNA, 406 bp, Homo sapiens
  misc_feature (7)..(7): n is a, c, g, or t
tccccgntgtgttagatgttaaattggtatcatgcagaggccgagataatctagggccttctatgctctactaaggatccatgaacaattctgtgggccagagattcttcacacatttagtgtgctccaaatcacctgacaaaacctctgaaaatgaattatttctcacattcacttcccagaaacgcagatgatcttatgctagtttgagatcgattgcattttaggcatttagatatagttaattatgtagcccgtcctctacccctgtgatattcaatataacctatggcgtgaggtatattttacgatgtgctttatcttgcttttttcacaagtaaagcttcatctcaatccacagtacggaagatattccttgacacctccattcacggcgtccgagctc

SEQ ID NO: 546445 - DNA, 138 bp, Homo sapiens
cctgactacgggagttgggaggacccgggacaacgcacagccgggaaatggactcagtggcctttgaggatgtggctgtgaacttcaaccatgaggagtgggctttgcttgggtccatcacaaagaggatctctacaa

SEQ ID NO: 546446 - DNA, 1549 bp, Homo sapiens
  misc_feature (755)..(755): n is a, c, g, or t
agcgagcgacgagaccaaggccgccgaggagcccagcaaggtggaggagaaaaaggccgaggaggccggggccagcgccgccgcctgcgaggccccctccgccgccgggccctgcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagctttgtgagataatcgaagaacttttctcccccgtttgtttgttggagtggtgccaggtactggttttggagaacttgtctacaaccagggattgattttaaagatgtctttttttattttacttttttttaagcaccaaatttgttgttttttttttttctcccctccccacagatcccatctcaaatcattctgttaaccaccattccaacaggtcgaggagagcttaaacaccttcttcctcgtgcctggtttctctttaatttttaattttttccgcatcagtattaaggttttggcatacttggcatctttattcaaaagtgtaaactttcttgtgtcaatctatggacatgcccatatttgaaggagatgggtgggtcaaaaagggatatcaaagtgaaggtgataggggtcacaatggggaaattgaacgtggtgcataacattgccaaaatagtggtgccactagaaatgggtgtaaaggcggctttntttttttttaaaaaaaagagttataaccagtgttattgggggaggcgaggtttcacaacattacagagttttgggattaaagaagaggaaagagaggaaaaagaaaaaaaaccccattccccagaattataaaaaaaaaaaacggaccaaggtttcagaggaagcttcatatttaaccctatgggagaattttgaccacttatttctccgatgtcacagcgtggtccccgatccgagggattacacagtcaaaatctcacactgtggtataagggcgtcatagggcgcaatcgcggggggttattatagacaccctacaaaaaagggtggtaccaacccgcttctaaccccgacgccagggggtgctcacacacccggggggacccactgggctctaccacaaccgacaccccggggcaatcccccacaaaagcaccccagcacgctctggccacccttctacaccacccggagccccactcctggggtaaaacatgtggacgccacctgttgcaccgcttaaaaacccgcagaatcctacacccaaccccagcgcgggacatcacgcgcaaagcggccaaggggcaacaaccagggcgccagtcctcccggaactaacggcacaaaagagcgctcatcaccacaacccgctggcgaaaacggggaaaccaccctcttacccccgatccccggaaaaccattccacacccgctcgcaacccgtaagggctgcccgagctacacagcgacgccctctacacaccgcaacacccgacacgccacatgcggaccaaa

SEQ ID NO: 546447 - DNA, 336 bp, Homo sapiens
aaaagtagacgacggtggacaaggcaaggtctcttccccacagagagagctttccaggctggcactggacaggaccggggggcagcggcgggtgcctgggggcaaggcagaggagatgagtgagcggatgtctcctctctgatggccctcccacctccagctcgggagtcgaatttctggccatggccgagcgcttcagcacggtggcgctcgggtctatgtcttttggtcatgtccccatcaatggtccacctcagggctcaaatcagcagtccatttcattccctcccatcagcaaagacacaagggttccgggcccaagcagcactttggcat

SEQ ID NO: 546448 - DNA, 1093 bp, Homo sapiens
  misc_feature (799)..(799): n is a, c, g, or t
  misc_feature (802)..(802): n is a, c, g, or t
agcgagcgacgagaccaaggccgccgaggagcccagcaaggtggaggagaaaaaggccgaggaggccggggccagcgccgccgcctgcgaggccccctccgccgccgggccctgcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagctttgtgagataatcgaagaacttttctcccccgtttgtttgttggagtggtgccaggtactggttttggagaacttgtctacaaccagggattgattttaaagatgtctttttttattttacttttttttaagcaccaaatttgttgttttttttttttctcccctccccacagatcccatctcaaatcattctgttaaccaccattccaacaggtcgaggagagcttaaacaccttcttcctcgtgcctggtttctctttaatttttaattttttccgcatcagtattaaggttttggcatacttggcatctcttttattctcaaaaaggtgtgtaaacctttctcttgtgtggtcaatctctatagtggtacatgtgcccattattgttgaaagagagagtgggtgtgggttcaaaaaggggggattactcaaaatgtgaagtgtgattagggggctcaacaatgtgggggaaaaattgtggataagtgtgggttgcattaacattgtgccccaaaaaatattgagtgttggtggcnccncaattttaagacaaaacagtggggtgggtgaccagagggccgttgctcttttatatattgtggttgctgtttttttatagagagaaaaaaagggttttttattaccccagtgttttttgtggggagagaggaggagggttttataaacaaacatctaaacagagtttgtggagatctatagaaaagagggaaggagaggaaaaaatagagaaaaaaaacgccacatttcccccgaatatttgtaaaaaagaaaaaagggggctattaatggtttctaggaggagttacatc

SEQ ID NO: 546449 - DNA, 687 bp, Homo sapiens
gggcctttcttcagtccccacgtgggatccttcccggcaactttttcgagaaaaatgcccacattcaaggcggaccgtggggtggggggtcaggaaaaacatgcgctcctggccgatcagatcctggctgggaatgcggtgcgggcgggggtccgggataatgcggtcggggtcgcgggatcatggataagcgtgaggaagagtatgtggggccccggcatgagccgacaggatgtttgcagtcgacgcacggcagatactaggaggaactcgaaggccgagtctgtgggactggggacaagcccgcggcgccgtcgggaacgcaccaccgcggcgtgggtccaagaagtgcctcaggagtggatcacgatgacgaggaccgaggagtggcccatccttggtagaaggctgccacaatgacgagcagggggacaatctattgctagaaggtggcatgtggacccgtgtacggatgaggcgtgccactatgcagatgttcatgaacaaagaatcccttccgtgccatcgtgcaccctggtatgagactcatcatgtggacattcttgaatgagaaggacagacgagacgttgaaacagggagtgtcagaaggtgtactgcttgcctactgccgccactgaccccggggtctgacatgttcggggggtccgcagggatgtcaacatgcg

SEQ ID NO: 546450 - DNA, 464 bp, Homo sapiens
ttgcaaattgcctgggatacagaaaataaggacaaggtctgggtgtagtggcttatgcctgtaatcccagcactttgggtgaccaaggcaggaggatctcttgaggccaggagttgcagaccagcctgggtaacatagtgagaccttgtctctgcaacaaaatttaaaaattagccagacttggtggttcccacttgcaatcccagctatttgggaggctgaggcgagaggatcacttgagcgcaggaatttaaggctgctgtgagctatgattgtgccactgcactccagcctgggtaacagtgagaggcctcatttcaacaataaaacccagcttgggccgggcgcggtgctcatgcctttaatcccagcactttgggaggccaagacgggcagatcacgaggtcaggagatagagaccatcctggttaacacggtgaaaccctgtctctacaaaaaataca

SEQ ID NO: 546451 - DNA, 854 bp, Homo sapiens
ggcttccgtttctggtttggctctagtgtaagggtttcgttcagcggctgctcaagatgaaccgactctgtcgggaaagcgaaacccatggctccgcagcccagccatgaggtgactgcaatggtggaagggggggtagcaggtagatgcagaatccaatgggtaccaatgataggatgtatcgtcgattggagtgctggagctcagtgagaaggatatatagtgagtcagatctagaagatgagagtagggtgtcttgcaaagaatatgtggtgcatagcagagaagccttgtgaagttttgaagcaaaagaggttgtatgaagcagcattgcggaacgagatcgtgtgctcgcaaagaagtcatgtcaatcagtggtgacaagccatagtataccatccagtctttgagaggaaatcaatgacaagtgttgatgctatgaaactgggagttaaaggaaatgatgaaggtcatacaagcaaagtgaggatcgaccaatgatgtgaggatttacaaggaccagctagaggatatgatggaaggatgctattgaacatccaagaaggcatgagtggcagttttgggagccccagaaggtggagtgacgatgattgacgaacgcagagtttgcgttgcctaaggtggatgaggcttctgggtgagtgaagaacgttcttatcgtgcatgtggccgatctgcaactggaattccagaaggtgtcccaatgataaaggagaagggtgggttccgggggaatgaatttgggttgcaatggtccggttcatagatgggtcataagcatatttgtaagcaaaccttttggataggaattttctccattgaaaaaggaggtc

SEQ ID NO: 546452 - DNA, 1075 bp, Homo sapiens
tcatgtagataaagcgatcagagagaccagcgagctcttctctagtgcttctcgttgttcatctacgctatttgagggtgttttttttatctgggcgaggattgttgttgttccctcctttagtggccctattgtggcgcccgcatagattgtggacaaggtgttactcttgtgtgctgtgtcctcgtctttctcgtggtgtttaccccctttctcagtgtccccggacattctcggaactcccaggtgtggccccatcttgcgctttgtccaaggggcgctttgcttttcgccccccggtgggcacccggagacctcgcccatgggaatgaaggtgcaactcccagcctggtctttgaccggctccgcttttacggatattcggggacatcccatagcggtccagaatattgcttcccaaaattcccatgagctaagctgtaaccccgtgattatgatgtgaattaagtagccattaaagtgttttccctggaccctgatggaaatgtatagaataatatttaggccatacgtctgcatcttctgaaatccatggaattaaagtctgaggacgagagcacccctgggagcgaaagctggccctttttctacgaatgccctaccattaaagatgggccacctatgcgccccctgccctacttccgttaccctgagagtcggcgtgtggccccactctccactgttgcctccccgcttctgggtgtggctttgagagtggaccggtatgtgtgtgaagtggtgtatattggaagcatctccctacactggccagcccagtccattactagtgacctctgcgggagatcatccggtgctaaaacattcaccagttgcccaggaggaaaatactgaatgactgcttaagaattaacccttaagacccagttcatagttaataccaggtttcaccagttcatgcctgtggttttgtgtttgttgttttgtgtttttttagtgccaaaggtttaaatttatagttgtgaaccattgcattgtgtgtgttttttctaagtagattcaccagataattaaaaattcacttttttttccagta

SEQ ID NO: 546453 - DNA, 967 bp, Homo sapiens
  misc_feature (946)..(946): n is a, c, g, or t
ggagctgaacctgccgactggtattgccatgtctatgaattggacaagaacttgaatcctatcaagcccatgcaagtttctgggggatgaagagacggtgcgcaaagccgatgtaagctgtggctgtccaggcaaggccaagaagtgaaggccggcggggaggatactgtccccaggagcacgcctccctgcccgttttgtcccgtctgcgccctcccgaccgtgcacatgttgacactgaccacatctgtagacatcttgagttgtagctgcagaggggggaccagtggctccctattgtcatttttaggcatttgtcgactgcaaccactcccttcatacgatctagtcagaatagcagttctagagcacaggttctcagtctaagctatggaaaagctccccttatccaacagagtttaaaagtagtgacttgggttttggcgagtgcttgtttactaaggacttcgggggaggaaccatgctaagccactgaccatgtgaggagaagcaacagagcctgtctgttacccatgagcggagtctggactctgttcttcgtgcagtcaggtcactgctactggctgggggctctagtcattcagtggaagacgaaatgtacctgcgtggtgatgtgacagctgttgctcctgaaccagaggatctggtctaggtgggatcaatcctgattcgtatgtgttaattactttattagacagcattggatatttatacaaaatgacctctgggttctgtgggggaaatgtgccatgtgtcttcaaaatagcctctcaatcaatatggtcagtcttgcaccgagggagagggccgcggatatcaacccgccgtgatgagaagacctgcgcaaagtcacatgacagctgatgaccccgggggtagtttaactctgtaggggagaaacaaactcgacggtccgactgtcacngtgatttttttgtctgtctta

SEQ ID NO: 546454 - DNA, 303 bp, Homo sapiens
cgggggggaaattggccccaaaaaaaaacttggttttgggggggttttaaatgggaatttttaaaaccgaaaggtttcccaagttttggggatttgaacccctttgcgaaagggaaaaaagcccggtttaaaaacccccccctttggggcggggggtcaaatcccgcccggggcccgcttttttggggcgggggggtgggaatgggggtttaaattttaaaggtttttttttaaaggcttttttggaccttggaaattacccgggaattttgggggttttaaaaaaaggttggtggaccccca

SEQ ID NO: 546455 - DNA, 457 bp, Homo sapiens
  misc_feature (75)..(75): n is a, c, g, or t
  misc_feature (81)..(81): n is a, c, g, or t
  misc_feature (122)..(122): n is a, c, g, or t
  misc_feature (146)..(146): n is a, c, g, or t
  misc_feature (150)..(150): n is a, c, g, or t
  misc_feature (159)..(159): n is a, c, g, or t
  misc_feature (184)..(184): n is a, c, g, or t
acttttacaaaaaagaaacaatgaaaaaacaaaaacacacaaattatacaaaacataacttattcatttcacccnaatatncaaatgattaaaaaaagaatttgaaattccgaaaaggcatntccaaaaaacactatttttctcangaanctttattanctaaagcctccataaaatctttcanatgttaagaagcattcctatatatgttatcaccagcacatttacatattcttacaagtatattacatccagaatctacaaggaactcaaacaaatcagcaaaaacaaaacaaacaatcccatcccaaagtggactaaggacatgtataaaaatatctcgaaggaagatatacaaatgaccaacaaacatgaaaaaatgctcaacatcactattgatcagggaaattcaaatcaaaaccacaatgtgataccacctcactcctgcaagaatggc

SEQ ID NO: 546456 - DNA, 301 bp, Homo sapiens
ctctacaggatctaagtcataggaagctcaaagcagagatgatttaccactggaccacaaaaacaccaagctctcctctctgaaaatacaggccgggggtggtggctcacgcctgtaatcccagcactttgggaggccgaggtgggcggatcacgtggtcaggagtgatccgtctctactaaaccccgtctctactaaaaatacaaaaaaattagccgggtgtggtggcacgcacctgtggtctcagctactcgggaggctgaggcagaatcccttgaacccgggaggcacagattgcagt

SEQ ID NO: 546457 - DNA, 122 bp, Homo sapiens
gggggggggggcccccccctttttccccccccttttgggggggggggggggggggtttttttggggggggggttttttaaaaaccccgggccccctttgggggccccttttcccctttttta

SEQ ID NO: 546458 - DNA, 1449 bp, Homo sapiens
tttgtgccgcggcttccttgtgttctccgcactctttgctccgctgtttcgtagggtctgtttcttatccatctctcaactatgttgtccgacggtccgctcagtctcctgggcgtccgggctctctcgtgcctctcttcttgtatggctcagggtctggtattgcgcttgcttgcctggctggagtggtctttcgctccatcctttatttaacctcttcttctctcgcccatcttcggtgttacaacggttcttgggccggcttttcgtcctggcctgtcttccataaccgcgttccgtgtattcctcccggccgttcttattggtaaggaccgcccgcttccttttttaagatgttctattgaagccgtctaaggggaggcgaccactcgctggtttggcctgtctcaacgggtaggtccgtagtgcctcttccctagggggttctccaaccctgctaagcgctggtggcgagcgcctgggcgcaccgctttttttccctctcgcgggccgcatctttctatggccgttggtctttgtgcttcttagtatatgctctagctgcttggcctgaaatggtggccctccctctagcgttcctctttatctcatagcgctccctcctggcccgcccaatggttccctctttttggtctcctcttaacagattggtcttgcctcccgtgttacgttgctcgttcagttgagttagtcccgcgtatttaccggttctctcgacctgtagtcatgtcagtactaccttgtgtaacctctctgctctgcgggttgctcgtattggtcaatgttcgaggtatcgaatcttgctcccagctagcctcctttttgtggtgcgatgattgccgttctgtcgccattaaaacgacatagtaatgtcttctcctggtatacacgatcagcttcctgttctccaaacgaaggtgtaacacggtgagcatcagataatgacagcagtgatgtctgtggtccactcttaactcccttcaatgttgccactccagcagtagtctgcttctttgtcactcattgaccctgtgcggcgttggtttgaaatctcacaacatatattgtagtataacttctcaaaggacatatgtatctgtagccgtgttgttgacactaatacagatgagttaaggaacaacagctgatctctggggaagggagctactctacacatgttatacacacacacacgctgcacacacacacacagcacacagcacgtatatatatatatattatttacagggaaatttttcagggtttacaaaagagtatgtgattggtagtaagagacacacagaatgtttatgaagaaattgcatcttgctttttcctgttacagttgaacttcctttatagtttaaatataaccgtcttgagatggcacattcctacgactgaagaagcggtctggagatccctaat

SEQ ID NO: 546459 - DNA, 2987 bp, Homo sapiens
tttctctttagaacatatcccacacttgtgaaaactagcctgtttaaaaagaccaaaagaaaaacaaacaaataaacaaaaccaaaagaagctgaacttgttttaaagctagaaaatattgaattagtctaactagttttatttattttctttctttctttgtaggtgggcaccatctaatagttttattttttagttacccttttaagaatttgtaatttaagccacacgtaccttttgttgtgttgtgatatttacacaccagtgttttatcctcactcttttctaccttctagtgttagcttccccttgaagaacacacccttaaatgtctcctaggctgtattgcttcatcaagagtgtaaacaattacagcataaaatggtacctttggaaatgaagtcatgcgtctttcttaattgctgaactcttgtaattctgaagggggtctattttagcctgtacttactcccatacttgctaacacaagcaaatgggcctacacatacagctaggaaaagcatgaatctaagggtttcttagggttccataattatgcatggaatgtgcaggagcaggaatgtcaaagtaggagtaatcatgatagatttagaaagggccttagaggttagttggtacaaaatattttacagtgaaggaagctggaattaagcaggtctgggtttcttcttcctagcttcccctcccttcgtcccattgtaatatatggctgtcaggatgacgtttctacagcaaatttgatgtgcataaactttgctggcagctttccacacttttagaataaagttctgatttctaaaggtcacatatgaaggccttttgggatgtagtttttgcttgtcttggtagcttttctcaccacttgtacacatactgcctataatgatcaaattccttggtggtcttatctttttggaccatactgcttgtaattctctaattccttgatggttttatctctttgaccactctggttttatctcatttgaccatgctttcacacatgatattctttctgacaagaaggcgccctccaccttcccccaagacacacattatctagttcagaggctttcaacaaattttttcttttagtatgaacccagtgtggattgcaattacattatgaccatatacatatataggtgtgtgtgtatgaatgtacatgtgtgtatgtatattatacgtaatatatattttatataaaaatctaaataattgttatgaacatacttatttttatatgtgatatacttaactttgatattagtaatatctgccctttgtacctgtgcacaacagctttggtgttggaagcctttttttgagctccaggtctgattcgatcatcttcacttgctgagtcacacgtcatagtatttacttgttttgttcctctcactgcctcagacagctcttgagggtagagactgtgtctcacttgtcctagcacacaggcacagacctaataggtgctcagtaaagagataatgaagaaactggacccagtgttctgctacaaattgatagccaaaatcgcaaagacagaaaagagccccatatttctcgattctcaagacagagctatgcatcagaatttttcatttagagtaggacttggagaatggctagacataggatgaattattttttttctgagggggaaatgtgagaagacactatcatatatactcttagttataaaagaaaaaacccacaaaatacaggtattgagacttaattacatacagccaaattcacactttttaatatacaattgttttgaaaaactacaattgtgtaactgctatcaaaatcaagatatagatcatttctatcaccacataaatttttttaatgcctcttcgtagccagcctcttctccaccccccaactgttgccaccactgatcaattttctgtgtctataggttcaccttttccagaatgctgtataaatggaatcgtgcaatatgtagcctgttgcatctagcctcttttacttagcataaggtgtttgaaatcatccatattgttgcttgtatcagtagtctgctcctttttgtgctggataacattccattgtatagacataccaaaatttctttatccattcactaatttaggttgtttccagtttggggatatatatacacatatatatgtgtatatatataattatatatattattatatattatatttatatataatacatatatattaaaacatatataattatgtatatataatttatgtctaggattgctgggtcatatagtcataagtatatgtttaattttataagaaattaccaaactgttttccaaagtggttgtaccatcttgcttgttgccaacagcatatgagagttccagttgttccacatctttatcagtacttggtattgtcagctgctatttaaaaaaaatttagccattctaaaagttgtatcatgtctcattgtggtctgatttgcatttccttcgtaactactatgaacatcttttcatgtgcttatttgccatttgtgtatcttatttggtgaagtatctgttcaaatcttaaaagcccattttaaaatcagacttttcttattattgattataagagttctttctacattgtaatataaattctttatatgttttgcaaatatttcttcccaatcttttttgtgttgtttcattttcttaacaatgacagcacagctttgaaagtctttgaagggaatatcctaaaaggtactaaagtagaggttttaccagcctgggcaacacagtgaaacctggtctctacaaataataataaaataattagccaagtaaggtggtgcttgcctgtagtcccagccacttgggaagctgaggtgggagaattgcttgagcctgggcagttgaggctgcagtgagccatgattgtgccactgcattctagcctggggcaacaaagtgagactccagtctc

SEQ ID NO: 546460 - DNA, 170 bp, Homo sapiens
tccgagatcacgcattatagccactagttgtcatcattatcagcatcttcatcttcttccccttcttcctcaccctgcagtagcagggttggcagcggcggtctcctcctgctgctgctgttgctgccggtgaagctgctcacaggcagcccgcttctccctctgcttct

SEQ ID NO: 546461 - DNA, 95 bp, Homo sapiens
aaccccactctgtctttgttcaatgctcagcttttggatgtgaatcctataagcccccgcataactaaaataaacaagcccttcagtaaaaaaaa

SEQ ID NO: 546462 - DNA, 148 bp, Homo sapiens
ttcaggcttgttctgcctgctcgaccgctgccctagcatttccccgacactcagttgggtgcgcaccacgtacttactgaacttaagagatccacggtcgggcagactcatgcctgtaatcccagcacttagggaggccgaggcaggt

SEQ ID NO: 546463 - DNA, 187 bp, Homo sapiens
attatgttggttgggaataagaaagacctgcatatggaaagggtgatcagttattaggagggaaagctttgcagactcttgaatgcagcctttttggaatctctgctaagaaactagacttctgtgatgttttcgaggatattttgagacagaaaatgacgggacagcttcacatggcagtcttcat

SEQ ID NO: 546464 - DNA, 914 bp, Homo sapiens
agcgggttctcgccgcggagacccggcagttgggggatgcctgacgccaggccttgaggatgttgcggaagctcaccatcgagcagatcaacgactggttcaccatcggcaagacaggtgaccaagtgtggatgcttgctggtgcgctgccagcccgccattccctgtgcaggtgtgcgtgccatgtgtgaggaggtagcagaagccaaggactgtggacacaccggcagctaggtcaccgcggaccacggcctcacggactctaggaccaaaagactcctggccctgtgccagagactgattgctgttgcctgatactgtggtcacctcaagcacgaacatgggaagcgtccatgcaacgtacgacgctcattatatcacgacgaaaggtaacacagaacactgcatacgacaagcccacaaaggacgcgttgcactgtacgttggtcagcacgtatgtaccgaaacacagaagcacaagtagaggaccaaggtgttccaacaggcacacgtacatattagtgcagtaaactttacacgacatgtgatgcacagtgtcattccccacggtgaccaaccgttacttacaagctatcgctgcattaattgccatattacagctcggactacgcaaggacagacggattgatgatcttatggatagacaagttaacttcccgatggttgatatatcccatgtgggaccaccggagaacgcagcgataaaagaggccaactcagagctcgccagacaggtactactctagggacacacataccgatacaagaggctacacgaccaaactagacagcacagaggagggtcaaccacagaacaccgagaaagcatacggcggcaagcgaggcactcggcacacggaggcatccagaacacgaagccgatgcctggacca

SEQ ID NO: 546465 - DNA, 764 bp, Homo sapiens
agagacgctggctaggacgccctcctcactgttaccaacatgaagctgctcgcagcaactgtgctactactcatcatctgcagccttgaaggagctgtggttcggagacacgcgaaggagccatgtgtggagagccgtgtttctcagtactttcagacagtgactgtctatgtcaaggacctgatggtgaaagtcaagagcccacagctttaggccgaggtctagtgttactttgaaaagtgaaaggagcagctgtcacccctgatcatgaaagctggaacagaactgggtaactcattgagctctttcgcggaacttggaacacagactgtcacccactgtagtgtgcataccatagtgttgcaaccccagctggactctataacacccactggtcagtcctagagctgctgtgcctacgcactctgtgctacaatatatgctgagtgaatccccacaaaaaagtctgagtggatgaacagcgcatataatgcatgaaaagagtattagacaactcttctggggggggccggggccccaataagccctatattgagtggaactacaatcacctggccgccttttacacacgcgatgttgagaaaaccctggcgtcaaccaccttaagagcgttgagaccatgctgctttctacaactgtagtaataggaataggctctcaccacaagacattcacacatgtgtgcaacctttattgtgatagatggcaacacgttcttctgttaccgcgttgattatttgtag

SEQ ID NO: 546466 - DNA, 263 bp, Homo sapiens
tcccccatcatggggtcctggaggctcctgcattgcattactgacagtgacactgagtagtgctagagctccccacatggctttggctggggacaccagaccagcctttcttggagtactctacgtctgatctgtcatttctgtcgaatggggacggatgcggctgcgggttcctggaatatgatacttcgttataacccaatgcacggatgctacgtgacgcttgttcgaccaggcgatcgatgcggggatgcttgccgggg

SEQ ID NO: 546467 - DNA, 688 bp, Homo sapiens
  misc_feature (41)..(41): n is a, c, g, or t
  misc_feature (62)..(62): n is a, c, g, or t
  misc_feature (125)..(125): n is a, c, g, or t
  misc_feature (171)..(171): n is a, c, g, or t
  misc_feature (235)..(235): n is a, c, g, or t
  misc_feature (282)..(282): n is a, c, g, or t
  misc_feature (298)..(298): n is a, c, g, or t
  misc_feature (330)..(330): n is a, c, g, or t
  misc_feature (361)..(361): n is a, c, g, or t
  misc_feature (402)..(402): n is a, c, g, or t
  misc_feature (434)..(434): n is a, c, g, or t
  misc_feature (484)..(484): n is a, c, g, or t
  misc_feature (559)..(559): n is a, c, g, or t
  misc_feature (569)..(569): n is a, c, g, or t
  misc_feature (587)..(587): n is a, c, g, or t
  misc_feature (625)..(625): n is a, c, g, or t
  misc_feature (671)..(671): n is a, c, g, or t
tcactggtcctcagggcaaggaggaaacttgggcaggagangattgctcaatcccagcagantcttagaatctcacttggacccgaaagtgcatctgcttggtggcattgttcttcattcctgtnttcagcatccattttgatttcatcctttggacatactgcatgtttngctctcgcataagagccgctcctgtgctgccagttcatcccagggctctgtactgcttgaagtnctcggcccacggccttccgatttttggcaactgccacagctcttganaagccaaaacgctgtntgtagtatctttatcaaggagctatgacccantttggcaccagaaggcagaatcaattccatngtttcatcatcatattccaagttcttttctgagggcaactnctcagctcttattggggttctccccttccttntttatctggatatctactcctaaaatcatagaattttgctaattccaaancagcttcgccatctgttaagagcttacagttgctttttttatttatattttctttttcagcttctgtttgagttnaagtgacttncctttctcgttgcaccanaagcaaattttgccaacaccaactttctctcccaagtntttaatcagtcccttaataactgaaagaaatactatatcaggaatnaagaaactgtggtcttt

SEQ ID NO: 546468 - DNA, 1837 bp, Homo sapiens
  misc_feature (1)..(1): n is a, c, g, or t
  misc_feature (1298)..(1298): n is a, c, g, or t
nccgtcgtctgtcttctgtcgtgtctatagattcagacacaacagcccgaagaacacacgacgcaggcaccagatcgttgctatctgtgtattgcattactacaagggttggtagtttcgtctgtcagtactaacagtttgtgtgttgtcttgcgtgcttattaggtgggtcgcggtcttcttgcgcgactgttcgtgcctcacatcggttgatctggggtggtcctacaatgcctgctttaatgttaatcttctgtccactttgtgttactgctccctcttgtggtcttctttgatcgttttgttgctttcgttcccgccgaggggttcagtcgtctcttaattttttctgcaccccctcggggggtgtagtatttgggtcgcccctcgttcttcgctcgctaccgagtgtgcgaagaccactgatgtgtgggcagtccgccctctccttcataggggttgtacttccttgttttatgatggtaaccttggtgagtgagttgtccacagaaagtgtttcccaccgtgcgtccacccaggtggtgaaacaccagtttctttgaaggatggtgttctataaaacaaacgggggtaattttggtctgggggaattcatcataatatgtgcggggcgactcaataaaaagggggggtctcatttcgttcgtgtggttgcttgcgcactcatccgcgagggagaactgtttttcgtggctttttttaactggtttgaggggaactcctgttttcccccctgtgtgtgcgccccccacagcgcggtttgtgtgactgtgtgtcccccacatggtccttggcctcttggtcccaaacatcaagtgtctgtctctccagacacccctttgtggcccacatggtggcgcccagaccacacaagcgtttccacacacaccccgcatgcctgtgtgtggccgatggaggatggcttctcgtcccactgggtgtttcccctcctaatgggaaccaagtcacctttgtaaaggttgtttggcgggcctctgatcaccgtggatattatgcccccctctatttgtttgtaagtgtctaaatatataaatagagtggcttctaaaggcccccctcttgtaaatgtcccagggacacctctcttggacacttgtgtttgtgcgtataccacccccccctgtgtgcgcgcctcgcgcctctcctccacgcgatctttaaacgaagacccccagatgctttcccccaaagttggacttcttcttgaatatagctcactatttgtacattctgtactctccatgtcccgagatagngatgtttccccaaccatactacaaaaagtctttgacacccacatgtctgtgccatatatacctctgcaaaaagtgtgcactctcttcccacatatgcctctcacaaggctctgtgctctgttggtgttcctaatactgtgattcccccaccaccggccctcgtgcacactgtgaccaccttgaccacacacacttgagtgctccaaagggcacttcttggacaagtattgttgacccacttctgcttgaagatatatggcggggagaaaaattctttgtaattggcatctttgcgttcccagacatctcccatttcccaaacctcagtaaacaataccagtgaccctttgcagccataccccagatcccgtttctatcacctgttgcctgtccccgttactcacctcccccccaacccctatcctttccccctcctacccaaaccaaatttaccttacttgaggaattaggtaggtaagcgaatgatcacccatggagatttgggatttacaaccccctaacaaaaattaataaataaa

SEQ ID NO: 546469 - DNA, 706 bp, Homo sapiens
ggtgggtggttaaggttttacgccggctcttgaaaacttttttgtccacaaaatagcttcttatttgggggggaagttcaggttggaaattggtgaggtggcaaactttcctttcaatttttgggcacgagcaatgtgccagaagttgcttttctatgtctaagcgcaagatttgattccaatgtgcccatgtagggaaccttatcaatctggaaccgaaacgtaatactgtttcagacgacctgacgggaaagagcaagagttcgcttaattggtccacaaaccaggttgttgacacgcaattctatagatactgttcagtagcggcatctcacgacctggtcgattcgtttcccaatctctatccctctatacgtgatcatcataatcaaaggtacacagccatgttatattgtccaatataatacaaagctttatgggcggaacaaggtcaggttacgtacgtgatgagctcaggtacagtggttgcacagtcttcttcatgtagaggacatggtgcatccgttctgacaccttgtggacgctctaggtcctctttacagaatcgaaagcaagaacagacccgccacgattccaccagaataaggtgatcctgaatgtgaatgaatacatgcttcgccatcagtttgacaggtgttaactgggctgccaatattaacagacgttgcgcccctttaaaaaaaga

SEQ ID NO: 546470 - DNA, 275 bp, Homo sapiens
  misc_feature (61)..(61): n is a, c, g, or t
cctacatcgaccctctgcagcttcgccttctgaacgttgtccaacgaggtggtcaagctgngcaccagccgcccgtcagctcctcaaccggcctccaccacctgcacgtcaactgcagactgcaagcgcccatgagaccgggctggttgcgacaggtgccacgtgcccgcatgttgcgttccaccacgtgtcagggtctctcgtgtggtccagggctgcgcacgcggccacctgcgcacatcatgaagtggctggaaggcgctcccactgtccgc

SEQ ID NO: 546471 - DNA, 430 bp, Homo sapiens
acgtgctactggaggtaagactcgaagattaatcagcctattttgcccagagtctctgggactaaagtagtgatggctatcgcctatgagactgtaagaacataggcagggggtactagagaaagattaacactgcctattttaaaaactcttggtttgagattatcataaatgaaccacgtacagattcccaggtaggatggctggagtatacaagaacttacaagaatctcgaggtggtacctacgtagactaaaaaggtcccagaactaagatgctagtctctctctcactaactacgatttattctccaacagttccctgatctctagtgatctggttactatgagcgtaaaaacctagtaagtcacccctgagcatccctcttctcttgctatcttttaagccagtctcctatctctacctctta

SEQ ID NO: 546472 - DNA, 321 bp, Homo sapiens
  misc_feature (18)..(18): n is a, c, g, or t
  misc_feature (195)..(195): n is a, c, g, or t
caggggagggcatggacnaaatggagttcccccaggcttaaaacaacatgaacgaccttgttttttagtatcaccagtacccggatgcccccccaaaaaaggaggaggatttcggttaggaggcccaaaaggaggcctaaggcaaagcccccctcaccccagggttttcagttcccttaaccgttttaatcaaangcccccttccccccccccaaaaattggggttgcggcccccatcttgttttttgtttttttttttgggggggggtttaaaacagggcccggcccaaaataggcgccccaaaaaaacttgtttgttga

SEQ ID NO: 546473 - DNA, 467 bp, Homo sapiens
gctcccggcgaggcccgggggacagagcgagaagcggggaccatgtaccgacgcaagttgacggctctcgactaccacaaccccgccggcttcaactgcaaagatgaaacagaatttagaaacttcatcgttatggcttgaagaccagaaaatcaggcactacaagattgacgacagagggacatttaagacacatccacagcagcgactggcccaagttctttgaaaagtatctcagagatgttaactgtcctttcacagattcaagatcgacaagaagctattgactggcttcttggtaatagactgttagacttgacatactggagataatgctgaaaaatacaaggattcagatacctgataattcaaacagctgctgacaaatgcacacatacaaaatgccaggaaccatttgatcaattcggatgtaaaatacatcctgattctaccggctggtgtgatgg

SEQ ID NO: 546474 - DNA, 895 bp, Homo sapiens
gggtagtctccatggaggtcatgagtggttgcggggggtttcggttagtgcggtggcagctctgtgctggctcggtaccctatggagctcgcgctcggattgagggcttccatcacgtcgtggatttccgaaggctgctgctcctgttcgacccagtggagaccatggggaataacgactatgtgtcatcagaccttctagcattctatgacaggcgtttgttgacgttgttgagacttctacgaattgccattgactgggattccagttagcagtttgcatagactcgtggtgatctgtattcgattggtcgagctgaactagcagaaattccagaaggtctatgtcccagaacactgggtaatatttattgaagttatcccatatcagagtatggattgcacgtaatttctatgatagtcctgagatagatgtgtgagagaacattggcgtccttcagattgagagctgaaaaggggtgagattgacgggtacaggagctggaggtgcgatgattgatgcatgtgagaggagatggagcctgggtatgctatgaagagaattgacagggaattgtgatcattctccggatagcagttcctgacatttaagcggttttgtctccacataacgagttaatgccttgatggggatccgtatactattttcgatttggtctccggaaaacacgaggttcgactggcggctccaggggtcccaagagctcggtgggagaggttcacgcccaaagtgaattgtgtttcacggggaagcactgggcgccccattgggctgagacgtgtgccaccggaggactaatggccgactattgctcaacgcccagcttggcacaaccctcttttcgtccaacaaaaaacacgggaggacacactcc

SEQ ID NO: 546475 - DNA, 159 bp, Homo sapiens
aatgtgcttaaacagccagtatttggtgtacagactgataagctggaaatcattcaagaatatcaagcagtattacccctgagaatttgaacgcaccaagccatactgctatgtaaagtactctattgccaactttaccaatttgaacccgataggaca

SEQ ID NO: 546476 - DNA, 102 bp, Homo sapiens
aatgataatgaatcattgattacatctgttccatgcattcatccggcgtagatggaggaaagcaacttaaaagataaatcctcaacccagtttagctacaca

SEQ ID NO: 546477 - DNA, 695 bp, Homo sapiens
agagatagagagagagagagagagagagagcgagagagagagagagagagagagagagagagagagagagagcgactgagagagagacagagagcctgacacagagagacctacttagccctacctgtgctccctgacagccccgcattatcctgcctttcagcctgccatcctgtggaatctatttcactgactggctcctcgacccccaattcaatcgctcattaccatacgctctgagcttccagccaccttctcttgctcaccaactgaccttactgcattcatatgctcgttacacagttctatggcccacttagatcatcatgcagttgtaattgctgatccggaactaatgtcactgtctggctgtactgcctgcaacgtatacaccgtcaatctagttcatctgatcgtactcgcacactaatccacttcaggacttaacgaccagctattcaagatctacactggctgagatagacacttctctcacagctccatctaactcttagaactcccatgacctgggtattcctgctcagtcctattatcttatcggaccgactattcgtcagctagtataccgactctttcacctcaggcttctcatggaggggcattctgagtcatccgactggcctctgcgccattccctgcctgtttaccacttggctttcccatcgctttgcccc

SEQ ID NO: 546478 - DNA, 344 bp, Homo sapiens
ttttttatattaataatttttaactaaaagaagttccatattcggcagcattttagttttttaataggacttattagcatccaccctcttgataatccccaagggaaaaattaaaaaaacctaggctgccataaacccttaaattggattttcagagagaatttagaagcaatccctacctttctcgtttcatttggggaaccatgcagcataggccctgtggtacatcatctttacgctttgggatttgaacttattacagaattttttttttaaattggatggttctttatatggccttggaaactgaagtgattttagcattaaacaaaaaagctttttga

SEQ ID NO: 546479 - DNA, 848 bp, Homo sapiens
gggagtgggctggcggggtagctgtgcgcccgcttggttgcgtgaccgcgggtccggtcgtccctccaccttcgcccttcgcccttcgcctcgtcccggctccgcggccagaaggcgtcatggtgccgtcgggctccctgcgcggcccgtgagcctcggtgcgggggagcgcggtcgagatcgccatgcctacccgagtatgctgctgctgttccgcttgtgcgtcctcgctacaaacgcctggtggacaacatattccctgaagatccaaaagatggccttgtgaaaactgatatggagaaattgacattttatgcagtatctgctccagagaaacctggatcgaattggttcttacctggcagaaaggttgagcaggcatgtgtcagacatcgtcctgggtatgtggatgctatggaggcacctggaccaactcctcatggcttgccattctcacagcataagccattgtagaaagcttcttcatatggtggcacagctgctggaatcgggggaacaaagcttcaagttctggaacaaatctttgtcaaagtttgcaactattgaagaagacacaccatcctatcacagacgtatgattcttgtgtctcgatccagtgcatgtgccattcctgtcatagtgatccaaactacgaaccgagatcgaattgtggacttacacgtatccacggtggggtcgcaacacaagtcaccatgacttcgggcaccatggactcagccaaggtacttgtccatcctccgttaactgcacgttacactgcatcatgccctttttcttgatggaaaaaaaccgggcgggacgccaaacgtgggccctggaaaagggc

SEQ ID NO: 546480 - DNA, 1238 bp, Homo sapiens
  misc_feature (550)..(550): n is a, c, g, or t
  misc_feature (1238)..(1238): n is a, c, g, or t
gctctctgggcggagtccgaggctctggaatgtggcacgctccttattcatccaagcatacccgaggaagaataacctgaatcgacaatccctgatagtatcttcatgaggtgggtgtgcttcaaccaaaggtgtctgactgcgttgtgctacgaggcccgtagcaactgccagactcatccgttgcatcagtctggctatcacgtacatacatgcatgcacgaagctagttggctgttgaccacacgcagggctctctaatgatatcgtgctatccgtacgtctgaagctggatcgagcaccaatcctatcggcggagtcgtgacacccgaccattgatctcaaggtcgaccactgagctgagtgatcatctacctgaccttgcgtttccctggaccagctcaatgctgaccctccagcgagacgtatggaaagtcaagcattggtcctccgttcctcacgagtatcacatttgctttgccaatgccattgagcatattggtcgccgtcatcacgcgagagcggttgtgaatggcaaagcaagtaatcngaagctcatcgccaagttggtcccgaaaaggcatcaacctcttagccaagagattcattgcggaatagcactaagagagggaattgaattggtcgtgcgcatgtgtacactccgccagtcgcaactgggcccagtgatgagctcaaacacgggtgtgccatgacttgatcatttctccgtggtgtgtcgggacactcgatccgaatgcaaaagggaagggggttcccgaatcaggaaggccaaggatgtggacttttcaaacccgggtttgtcgacgccatatcaacattggagatccaagggcacacccataaagacttctcttgggtggcgtaggaattggggaattctcaccccaaaaacaaattgcttacacacgccaacacaaagtcccaggttgcgtagctcggtaccattttccccataaactccctttctggttgtggcccctttctaaacagcaatttgggggccattgcttccaattcgctttttgcagttctcgtggggcaaaaaataaaaggccaatttaatggaccctattttcccaacgtggcattgacatatctgtattacgacacgtgacgtgccaatatccttcctggggaaaagtcaaaaatttgccaacatggggcgccttttgtgttcccctggccccgggaaaagagggcccttttcccttcccagn

SEQ ID NO: 546481 - DNA, 194 bp, Homo sapiens
cgaattcgtctcaactctgaccgaggcaactcaattactgatcttatatcacgaaagtgatgaactaacaattggacaaaagaagactacggtattcatggtcgtcagtctgataaggtgaccaattcacaaatgatggtaatttcgctccgtacttcgtttctcgactcactcaggagacgagaggtctcctg

SEQ ID NO: 546482 - DNA, 288 bp, Homo sapiens
cggcacgaggaatcttggctcactgcaacctcctcctcccgggttcaagtgattctcgtgcctcagcctctcgagtagctcggactatggacttgtgccaccgcgcctggctagtttacagtccaagctcttaacctcaccagcctgcctcaaccaccaggggccagactgctgatcttgaacaaggaagaagaaaatccaaatggtttcagtgcctaaatgtcctcctttcttgcctttggtaacaactttttctgtctctgaatatcattgctacttctctggcca

SEQ ID NO: 546483 - DNA, 144 bp, Homo sapiens
ggccgatcctagaggatcccctcgctattcatcggcacctcgctattcatcggcaccccacctaagctgcacgtcgttcaatgctcccaagatttctctctcttagcatgtgccgatgaatagcgaggtgccgatgaatagcga

SEQ ID NO: 546484 - DNA, 209 bp, Homo sapiens
  misc_feature (9)..(9): n is a, c, g, or t
atcggcggnaatccggcacacggcagaataccaggagcactggttttactttgaagctaaattggcaattttacgttggaggagaggaaatccagttaaagatccagaaataaagcctgtttccccgacattctggtagcagaagagagggaaaagactctacaggaatgtggagtcacggaagtacgagggggaagacgaggccacgt

SEQ ID NO: 546485 - DNA, 1591 bp, Homo sapiens
  misc_feature (1591)..(1591): n is a, c, g, or t
caagtgacagcacattacacaaaagcggcttgcgagaagccacacaggaaaataccacgcgcacgggtctacccccacgggcgcccgaacacggcctcaagcacagtacaggcaggcacaaaggccaccactaaatacacgaacggcctaaacccgccacaaggaaacacgacccgggtacatacaacacactacacctcacaacagagacaccccccaagtggattaacacccatcgagcacagaaaagcaaactcaccgcggcgaaagatgccccaagcgcctcgggacacaaacaacagaggaatcatgagaccacaagagcgaaccaaacgcgtcatccccacaacaaacaacccacaccacaagggtcacacacacacaaacatcccacacgggccaccactgtagcatccccccagcgcccgcgaccacaccgcctgcacatcacataaacaatacacaccacaccgacgcggggccgcacagtgcgccaccacaaccatccgcgccccagggccgccccacagtaaaacaatcaaccgatgaatccaccagcagaccaccactagacacaacatcacaacaaggcgcccacccacgagaggaacacccactccgcaaggagactaccacgcacagcaaccaagaacaacctacgacgacacacataataagagcagacgcaagctgcaccacatccacccataacaccgagaagcaccaacacacgcgcgagaacgaagtgtagtcggagcacaccaactagtcgaccaccacatgagacgctacacacaacgaggagcgagaagaaaacgcaggaaaacacacggtcaatccgcagcaaccaagtgcgagaaacaacacccccccaacaagcagcccaccgagctacaaccaccaaacggcagaacaaaccacactttgcgatggtcatcaaccatcacaacggaggcgaaacacacacacagaaaaccacacacaaaaagccgagacgcattcaggcaccagcaccgaagccatacctcgctagttaaactatctcaccacacagacacgaacagatcgaagcacaaccaccaacaccaggagcgacgccccccagagtgtacacacgcacccgccacagctagccagccacacaacacaaagcataccacacgcggcggactacgactaagcaccacactctaacaaacagacaaccaacaacaacacaacaacacgaaggagcacatcatcacatgcgtccggagcgcggcccgagccgccgacgctagacaccaccacgaccgcacacacctacgcgacacaacaccacaccagactacctccacacccgccgccagcgcagtacactagacagaccacacaccgagcaacacccaacaacagacggcaccaccaacccacacacccccaacccatcctgcccaccgacaaccacccccgcgacaccacaccaggcacgccgacaccgactaccgacagtgcgccaccgcacaacgggagcagagacgacacgacccacgtaacgacacagaaccgaagctgcaacacaagcaaacacgagagatcaaaaccaagactn

SEQ ID NO: 546486 - DNA, 282 bp, Homo sapiens
  misc_feature (1)..(1): n is a, c, g, or t
  misc_feature (141)..(141): n is a, c, g, or t
  misc_feature (246)..(246): n is a, c, g, or t
naattgggccccgcttcccccagcctcgcccccggcccactgtgcgttcggcagctcaggttaaaactgaggggagggatacattcagaccgcaggccccaaggctgcgcccagccggtggcagggagttttgagccgagncagagccacccactgggttttgttgtcccagcaagccaaccccgacccctccgttcgggagcagcagccagaccacgccagggccaacgggcgggtccgtcccgnccgaaactaacgcgccccccagccctccagcccccc

SEQ ID NO: 546487 - DNA, 144 bp, Homo sapiens
  misc_feature (16)..(16): n is a, c, g, or t
cgggtcatagcatatntaataggctttcatactaagcttcatagccaggagtcccagagtctgtgcatttgaacgccactgtggagtggcctctggggtgctgatacacagaggtgtatgctgtagacaggagagtgccatcta

SEQ ID NO: 546488 - DNA, 255 bp, Homo sapiens
ggaactgcagacggcttctagaacttgagcgcagcctgcagctgacaaccagtaagaagccagggccctcagtcacacaaccacaaggaaatgaattctgccaacaacctgagaggtggcctccagatgagaagacagcctgacttaaaccttgatagcagttttgtgagaccctgagcaaagaaaacagataaactgtgcgtagactcctggtctacagaaactgtgagataataaatgtgtcttaagaaaaaa

SEQ ID NO: 546489 - DNA, 666 bp, Homo sapiens
attcggcacaggggtccgaattgtctgaatcatattccgttctatggccatactgcatgtcgtttgcccactcatctatggatggacctgtgagacgtcaccaccttttggctgttgtgaatcgtgctgctgtgaacatcgtgctcaagcttttgtgtggacctatgttttcagttctttgaggtctctgtcttcaacgctggagtgcagtggcgcaattatagttcaccatagcctcaacctcccgggctcaaaagattctcccgcctcagtcttctaagtagctgggatggcagcatatgtccatttggagaggccccatttcaagtgctcagtggctgctggtggctaccgaatttggatacgttgagctcaacggtgctctcagaagcgcggtggctcatgcctgtcatcccagcactttggggaggctgaggcgggtggatcacttgggggccgggaagtttgagaccagcctgggcaacatggcaaagccccatctctacaaaaaatacaataagtagccaggtgtggtggcgtgcacctgtaatcccagctactcgggaggctgaggcacaagaagtgcttgagcccggaaggcggaggtagcagtgagccgagattgccaccgctgcgctccagcctgggcaacacagcgagactcgc

SEQ ID NO: 546490 - DNA, 105 bp, Homo sapiens
  misc_feature (96)..(96): n is a, c, g, or t
acggccgtgtattactgtgcgagaggtgagtattacgatattttgactgtttattataaaaccggagatgcttttggtatctggggccaagggacnatggtcacc

SEQ ID NO: 546491 - DNA, 847 bp, Homo sapiens
attaatcccctggcacacccgtcatctactctaccatctttgcaggcacactcatcacagcgctaagctcgcactgatttttggacctggagtagggcctagaaataaacatgcgtagcttttattccagttcgtaaccaatgaagtaagagccctcgttccacaagaaagctgcgatcaagttatttccctcacgcaatgccaaccggaatccataagtccttctagatagctatcctcgttcaacagatatactctccggacggatgaagccataaccagatactaccaatcaatacgtcatcagttaggtaatcataatggctatagcaataagaagctaggaatagccccctttcacttctgagtcccagaggttgacccaaggtcgacccctctgacatccggccatgcttcgttctcgacgttgacaaaaactaggcccccatctcaatcatataccaaatctctccctcgactaaagcgtaagccttctcgctcactctctcaatcttatccatcatagcaggcggtctgaggtgggattagaccaaagccagctacgcaatcttagcaatactcctcatatgtacccacataggatgaatagatagcagttctacccgtacaacctagcataaccgattcttaattataagtatatatattatcctagatagtacggattcctaattatcaacttgaagtcccagcaacaagaccttgtaatgtttcgaacttgaaacagtaaatggttacaccttattctccaccttctctcctaagggcgtgcccgtacaggttttgccagagggcgctcaggagccagaaaaaggctttttcccta

SEQ ID NO: 546492 - DNA, 109 bp, Homo sapiens
gggtcgcctctacgacgactccccgacggggactggctctcacgacgcctctgtccttacggacgaccgacggggggtaccgacgctcgacacttcgtaactcactggt

SEQ ID NO: 546493 - DNA, 422 bp, Homo sapiens
gggggacccagccctcgttcctcccctgccctgcgtacagggtctggggaagccaggggcaggggtgccatgctagcactcaccactacacagtgaaagcatgtcacttccggctggctgctaaaacacactacggactgagcatctagcacgagccaggtcctcagagctcccatgaaccctctgccagaggggggcagccctaccctttccacacacacaggaagccaggcaccgagtgagggtgcactaagtcctagaacctgtttctgctccaaagccatagctttcctggaagccctgggatcagagcccattctgtctcccagtctcagctggcaggggcagggtcagcctcctgggggggacgggtgctgccacactgagtgtcaatgacagactgtcgccccacccaggagggg

SEQ ID NO: 546494 - DNA, 129 bp, Homo sapiens
ggaagggtattttaaccttttgggccagttgttgtgctagaccccttttcagggccttttttggggtgtttcccgttccgtccccccttttatttcttcttttaattttttctttgtttgttaaaatga

SEQ ID NO: 546495 - DNA, 1159 bp, Homo sapiens
  misc_feature (289)..(289): n is a, c, g, or t
  misc_feature (410)..(410): n is a, c, g, or t
  misc_feature (419)..(419): n is a, c, g, or t
  misc_feature (435)..(435): n is a, c, g, or t
gatctcaaaaaaaaaaaaaaaaaaaagctggcagagactaaaaaaacttcaatggtttgagtagacaaaatatcacaaaagcatgtccctgtggatgggcaaatttttgtttgaaaaagctttaagcccttggtgtgaagccattccctatgaaggaaagtttgcacgacagaagtgaggcaggcaaggaaatctaagcggactagtaaggggatgaactagcctagcctgtgtggcaacgagtagttaccagcaccacaagcgaaacctttaagagaattcagcgggnacgaattccacgcctatttagagctctgatatgaacccgaagggcagctaatccgaggcatattcccccagaaaagacagctctccacgagaaatactctcccagaacagaaaacacagangaaataacnctctttccactagagnccagagtttctctcccaggtcggcgtgtttgtgcaagagaaaaatctgtggttcatagagaagaggaagaagacaggcgccctaaaaataacgctagactattccgcgttaaagagacgagcgtgctcccagaggccgagggcctatggggggggactaccacaaagaggcctcgtgggacacagagaaaacgcgccttagaacactccgagggagtgaccccaaaatggtggtgcgcacaaaccaaccgaggccgccgagggcttatacccactgggggtgctacaaagaaggccccaggggtgctcctgttggtgtcggtggtctacccgcaacgagcggccacaacaacacagcgtcccccccccggtgggagggctcccctctaaaagtagagagaagacgccagaagagactcttccaaaagaacaatgattgttgtgggcgccttaataaccccttagtggtgtggctgttctcctagtagggcgaccaacaacccacaccaaacttatagtggcaggaaaaaagggcggctattctaggacggcgtagttagaaatgttgggcggccccccaccttcctgtagtgggtttcccccctgttggggaaacgacttcaccacacggttcatgtactatattcctccgctcttaaaaaacttttggcacacactgaaaacaatatcactcgcctgtggtgggcacaacggagcgagcaact

SEQ ID NO: 546496 - DNA, 639 bp, Homo sapiens
  misc_feature (1)..(1): n is a, c, g, or t
naaggaacgaacattcataaagggctctgatgtgtacgaggcatctttcatgtatgtatattcacttatttattagcaacaaaccctgaaaatacttgtcataataactcattatcactgatagagcaaactgacattgagagaggataaatagaattattataataagcatacaatcagtaaagaacagagctagagactggagtccaagtatgtaggtatgtttctcttttatctgacctacaaagtccagtacttgaatcctctacaccaggattaaggagagcatatgaatatatgttatatctggagcccttgtgccacagagcaaatgtccaaagatataaggtttctttttgtcggtacggaagctaagtgtgttctataaacggcatattgggacctgcataggtgagtattaggaccaaattttgaaattccaagtatcttaacactgggaaccagactttcttctcatccctaaggagaatctcactcagatgttcctctatgtgctgggatataaggaaggctttgcatttttccagacaatttacctgtggtttattcacgtgatgcatgatgttattaagggttgatgcttaaactccttcagaatatgcttactttactagtacg

SEQ ID NO: 546497 - DNA, 630 bp, Homo sapiens
  misc_feature (570)..(570): n is a, c, g, or t
  misc_feature (617)..(617): n is a, c, g, or t
gtctatcatggcaagctcggactggtcatacggccttgagaagggtagtctcgggatgccgtccgaagtcggcgacagcggccggggcgcaggcgcccgtgcggaatggcagatatttagcttcctgtggtatactgatgagcagaactcttccactacatacctcaattttgcctaaggagatatgtgcacgaactttcttcaaaatcactgcaccattaataaacaaaaggaaagaatattcagagagaagaattttaggatattcaatgcaggaaatgtatgatgtagtatcgggagtggaggattacaagcattttgttccttggtgcaaaaaatcagatgttatatcaaagagatctggatattgtaaaacaagattagaaattggatttccacctgtgttggagcgatatacatcagtagtaaccttggtgaaacctcatttagtaaaggcatcttgtactgatgggagacttttcaatcatttggagactatttggcgttttagcccaagtcttcctgggctacccaagaacttgtaccttgggatttttcaatttcttttgnatttcgatcacttctacattcccagcttgccacactcttttttgatnaagttgtgaaaca

SEQ ID NO: 546498 - DNA, 519 bp, Homo sapiens
atggtcatagctgactctagaggataaacctaaggctgggacccaccgatcaactacaaaagctagatatctgagtgaagcattaaaagacaaacataaagtaacttcaggttttatctagcactgcagaatgaatactaaaattagtggcaaaaaaacggagccagaatagctaaagcaatcctaagcaaaaagaacaaaacttggaggaatcacacttcaaagctggaggagtcccttcttcaaattatgctacaaagctacagtaagcaaaacagcatgatatttgtataagaatagatccatggaaccacatagagaacccagaagtaaagccacatatttatagccatctggtctttgacaaagttgacaagaacacacactggggaaaggatacccttttcaataagtggtcctggaaaatttggatttccatatgctgaacccctaccgaacccgtctctcaccacatacaaaaatcaacaaaaatcaacaaaaggtgggtcagaacataag

SEQ ID NO: 546499 - DNA, 480 bp, Homo sapiens
  misc_feature (20)..(20): n is a, c, g, or t
  misc_feature (78)..(78): n is a, c, g, or t
  misc_feature (134)..(134): n is a, c, g, or t
  misc_feature (360)..(360): n is a, c, g, or t
gttattgtttatatttatangttgtgtttgtaagaatgtaaagtaaagggaagaacctagtttcctccaaagcatcanactcatgttgtattactagaacatcaccaggaactagacaagtgaaaaatttaggnggtattgtaaagacgaagaaatgttgtcttcctaaggatacccctcaagatatcataataaaatggcatgaaaaaacaattgtgggtgaattttgaccactttgaagacaggattgttaattcaaagagtatttataagaatgatgaattgtatttttatgaatatttttttaaagaccccccgcaccgttaacctgtcgcacaagtcctacggagctccacttcnccccccaagccagtacgctttcaccacgaggctccccccccccctcccccacccctcgcattaacctaagtttcttgtcttcatatgtgctcttccgccctccccctcaaattcatctta

SEQ ID NO: 546500 - DNA, 709 bp, Homo sapiens
  misc_feature (68)..(68): n is a, c, g, or t
  misc_feature (93)..(93): n is a, c, g, or t
  misc_feature (127)..(127): n is a, c, g, or t
  misc_feature (142)..(142): n is a, c, g, or t
  misc_feature (204)..(204): n is a, c, g, or t
  misc_feature (211)..(211): n is a, c, g, or t
  misc_feature (220)..(220): n is a, c, g, or t
  misc_feature (222)..(222): n is a, c, g, or t
  misc_feature (232)..(232): n is a, c, g, or t
  misc_feature (242)..(242): n is a, c, g, or t
  misc_feature (452)..(452): n is a, c, g, or t
  misc_feature (454)..(454): n is a, c, g, or t
  misc_feature (456)..(456): n is a, c, g, or t
  misc_feature (458)..(459): n is a, c, g, or t
  misc_feature (461)..(461): n is a, c, g, or t
  misc_feature (463)..(463): n is a, c, g, or t
  misc_feature (465)..(465): n is a, c, g, or t
ggcaaagaattctgcatctctctttactgccagtgattacaagtggcttctgctgagtaccaccgcanagccctgtgagcgtctacagacagntcaccattttgtcctgtatctgtaaacacttttngttcttagtcttttncttgtaaaattgatgttctttaaaatcgttaatgtataacagggcttatgtttcagtttgtntcccgtnctgttttanancagaaaatanaaggagtgtnagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaacgccctgattcctagtgccaaaggttcaacttaatgtntntncnngnananccatgcctttgtgctctattttttttttgtatggtgcttgaagtcaggccatcctctgcaagtccatctatgttgtccttaggcatactatctttgctcaaatagttgaaggatggtgacttggttcaaggatatggaattaagttgtatgtacgttctaaatgatagaggcatggattatgtgtagcccaggttttgggttgattctggaatggtttcgaatttataagattgttataattcg

SEQ ID NO: 546501 - DNA, 210 bp, Homo sapiens
atattctgactgccttccagaagaagggggctgagaaagaggagctgtctaatggctgtctgtgattttcctgagtatggtgcgagtagggaggagagagttaacctgctggctgtgagtcccttgtggaatataagggggtagtgggaaaagtggtactaacccacgattctgagccctgagtatgcctggacattgatgctcagcgct

SEQ ID NO: 546502 - DNA, 790 bp, Homo sapiens
  misc_feature (68)..(68): n is a, c, g, or t
  misc_feature (93)..(93): n is a, c, g, or t
  misc_feature (127)..(127): n is a, c, g, or t
  misc_feature (142)..(142): n is a, c, g, or t
  misc_feature (204)..(204): n is a, c, g, or t
  misc_feature (211)..(211): n is a, c, g, or t
  misc_feature (220)..(220): n is a, c, g, or t
  misc_feature (222)..(222): n is a, c, g, or t
  misc_feature (232)..(232): n is a, c, g, or t
  misc_feature (242)..(242): n is a, c, g, or t
  misc_feature (533)..(533): n is a, c, g, or t
  misc_feature (535)..(535): n is a, c, g, or t
  misc_feature (537)..(537): n is a, c, g, or t
  misc_feature (539)..(540): n is a, c, g, or t
  misc_feature (542)..(542): n is a, c, g, or t
  misc_feature (544)..(544): n is a, c, g, or t
  misc_feature (546)..(546): n is a, c, g, or t
ggcaaagaattctgcatctctctttactgccagtgattacaagtggcttctgctgagtaccaccgcanagccctgtgagcgtctacagacagntcaccattttgtcctgtatctgtaaacacttttngttcttagtcttttncttgtaaaattgatgttctttaaaatcgttaatgtataacagggcttatgtttcagtttgtntcccgtnctgttttanancagaaaatanaaggagtgtnagctccttttctcatttcaaagttgctaccagtgtatgcagtaattagaacaaagaagaaacattcagtagaacattttattgcctagttgacaacattgcttgaatgctggtggttcctatccctttgacactacacataaaacattcagtagaacattttattgcctagttgacacattgcttgaatgctggtggttcctatccctttgacactacacattttctaatatgtgttaatgctatgtgacaaacgccctgattcctagtgccaaaggttcaacttaatgtntntncnngnananccatgcctttgtgctctattttttttttgtatggtgcttgaagtcaggccatcctctgcaagtccatctatgttgtccttaggcatactatctttgctcaaatagttgaaggatggtgacttggttcaaggatatggaattaagttgtatgtacgttctaaatgatagaggcatggattatgtgtagcccaggttttgggttgattctggaatggtttcgaatttataagattgttataattcg

SEQ ID NO: 546503 - DNA, 1245 bp, Homo sapiens
  misc_feature (710)..(710): n is a, c, g, or t
  misc_feature (866)..(866): n is a, c, g, or t
cttctgtgtgcgcgcgttctctgttgtctttccttttctttgtgtttcttctttttttgcttgtcttctcttgttctgctctttcgtgtttcttcttgtttgggggttttttttctcgtttgtttaccgttttttctggtttcccccatgtttttttctggatacactaatttgtgggatcttgtcgcttgtgtcttttttttgttgttcgtcgtttttctctttcttacccaattctctgcccctttttatgcttcgtttccaccgtggcttccttggggcccggtattctcaattgggttttgttctcgtgttttaatagggccctccttccatttgggaagtttccttgctctcggttgtaccttttttctcccttgtacttgttcttatccccttctgtgtggaaaattgttcgggcccctgttagaagggatatcctgctggggggctctctttgcccctattgcatcctgtccaactgttttaccagatttggctgccattcctaattttccaccaatggtcaactgagacttcttggccgctaaccaatgcccatgcccacataatttagacatatatgaggccttttcccagacttccaggataaattgcgttggttcccttgtctaccaagccgccaaatcttgtcccaaggcatgccttggggagaccatttggagtaagaatatggccacacccagacntgatgatcccgcgtccttactcgagactccgcgggtcccttgttgcctcccccctttcacgccactttttggttctatagaccacagtgtttcacaatagtggaataccacagaaagttttctttcgcttggcacaccccaggaggtcccaatggnccaccctcttgcctcgtggccactatgaattttgcctcccacgagactgtaatggaagtataagatcggccactggatattggaacacattccttatatgtccaagcacccggagtatcgccacatgggaaacacatgttgggtgccctccctgagagattcttgaggcacctggtgaaaatttaagtgtaagacacttgaggccacccaacactggaatctcttctttgtactggaatgtccaccttcccctaaagtcttagatttgcacccccttaccaaatctttcccaaaggtcacactcttatgaaatggatgttggttataacttttaatggacatttacattcctaataaagtattcagttttttaattcca

SEQ ID NO: 546504 - DNA, 417 bp, Homo sapiens
  misc_feature (205)..(205): n is a, c, g, or t
  misc_feature (272)..(272): n is a, c, g, or t
  misc_feature (288)..(288): n is a, c, g, or t
aaggcccaagaccccatctttcatactcatggaggatggggtttttttctcaattacttattttttaatgtgtctatctatgaactgtgtgtgtctggtgtcttggagacaagatgggaatgtcagatcccctggaactggagttataggcacttgtgagctcccatctgggtgctgggatttgaacccactttctttgtaagancatccactgctcataatgacttgagtcatctctccagcccagatatgtgtgttttgaccgtcacagntaatgacattttcttntctgcttccccaggacgatcctcactcgtctttgtgctgagtacaaatgcactgttcttggaagcgacccgtgctcctgtccgtgcatgagcccatgcccaccacagcctctctggggtgagtcaagga

SEQ ID NO: 546505 - DNA, 1752 bp, Homo sapiens
  misc_feature (1070)..(1070): n is a, c, g, or t
gtcgttgtactgttggtttgttgttcgctcatctctatcggttggagtcgatgttgtcgtgctactcctgtttgttgtgtttcgtcgtagctcaagttgggatcttcttgctggcgcggtctactctttgagttgtccctcctcatgtgggtcgcattctccttccggtgcgttacttttttgttcctcctgtggcgttcacaagtttgtggtccccctctgtagggggtgattctcccctcctgtagtaggggggggtctttctctccgtgggatttttgtgtgcacccctctttgtggcatctccttgtggggggaccctcatttgttcttgtagaaagttgttttttttgtagacatctggtggggattcgagccccccgttggtggcttcccgctgtgttggatcgaaattgatgcgcctctcgggctgctctttctcctcttgggggcccccctcaataatgactctcctcctcattgatgacgggtcttctctctccctcggtcaggaggattgtgttccccgcgtgggtgatctctttgggtgagaggaaccccccctcttccttgtttgttttgcggcgtcgttttgtggttgtttggtgtccctccatccacatcgggtagattttctggggcggacccccaacgaggctgcccccacaagtgttgtgttggagtgcccgctcccgcatatgggtgccccggttttgtttgtcataaaaatattcgtctttgggcgacatagaggctcgcaaagcagacaccgtggttctacacaggcgttttttttttggcgcttcccactgcttttcgaaggcgccctccccacaggcgctcatctttcttcttcgcacactagtgttctgcgcgcaccacccccgggggagaccctctcaatggcccccactcggagggagacccctccgggggggtcactcggggcgtgtgctgtgtgtgggtggtcacaccaccctctgtggggacacacacaaggagacacacacacctcacacagttgttgggggagacactactacactaccgagtaagtagacacaacacanagggcaccacctcacagcagggacgcccatctggtgtgtggcgcacacacagtggtctcacactgctctgtgtggcaaaacacacagggaggcggcgtgagagtgtgtcacacacagcgagaagtgggcgtgcacacacagaggtgagagagacacagagtgtctccccgctgtgtctctcacgagacactctcacacacaccacagtctctctctcacacacacacacacagaggtctcacacagagaccctatgggggtcacatgtgagacagcagcagaatgtgtgagaaggtcacacacagcggagagaaagagagagatataaccccgtagacacctcccagagaccccacagcggcgtgagaacacatatggtgagacgtgcgctctctgtctcccctccacacgccctgtggccattggcgttttgttatagcctaattttagccctgcacaggggtgagagccacacgtcgttttctcccttgtctcccacagcacatcacactccccaaaaggagaagagagccacacatgttttccacacccacgaaatccctttgttgccgagccccttagtttcctttggtccacacccagacattgtttatccagacttttcagggccctgggtccaccatttagaatataaagggtagttaatttagagaaaaaaaaa

SEQ ID NO: 546506 - DNA, 885 bp, Homo sapiens
  misc_feature (107)..(107): n is a, c, g, or t
  misc_feature (161)..(162): n is a, c, g, or t
  misc_feature (164)..(164): n is a, c, g, or t
ggggaaataacggcgctgtgggctgggcgtgggcaggagctgccttcaggcttctggtctccagcggcggggaactcacacctgccgctgtgaaaatgcagacccgnggggcagtaattccgagtccagcctggggcgcgtctggaatcttgactcgcttnnanacaccacggcggattcggagacaggtgagtagagaaatgagcctcagtccctcccagggccgccacggaattccaggatccggaaactcttcctgcttgctggtcaccccaggaaggcagcgcccgcctctgggccggtctgatggacaactggcttccggccgccccagaggaaaacccaaaactaagggggccaatgaaaaaagcctccattggtcccccgcttacaggtgaggatcctaattttatacccccgagtggtggccccccatcaaaggtctgcagttgaccagccggaagacgcggtgactccacgcctgtaattcccgggaattttggaagaccaatggcgggcgaaatcacgttgaaggtcaggagttcaagaccacagttgtggcaacatggtgaagccccttctctaactaaaaatacaaacatttacgcgggcgtgttggtggtaaggcgccaggtaggttcccagatactcggcgggctgaggcagacaaactggggtgaacgcggggcggaggacagttgacaggagccgagaccgcgccatgcactcagccggggggaagagcctacctctcacaacacaccaacacaatgtgaaggcgtcccgcaaggtctagacggggagggccagagcgtgggacaaagtcggaggcgccgcgtattaatccgcccggactgcgtgtgcggggggaaaggcaccagcgag

SEQ ID NO: 546507 - DNA, 214 bp, Homo sapiens
gtgaagctggcggagagttaagtgatggatcgagcagtctgaatgccagaactggataaccgattagctacagcatatgtaattgcttagtgtgcttagcctcatgtgtccacgcatctacatggcagcactacattgcacagagtcagtcgcatgactatcgaagtccagcttcaagataactatcagtgatttgacttatagggatctagcg

SEQ ID NO: 546508 - DNA, 218 bp, Homo sapiens
ttctgatttgaaggttttatttatcatactctggatactagtcttttgttagagatgcagttggccctccttagctgagagttccatatctgcagattggaccaaccgtggctcacgcctataatcctagcactttggaaagctaagccaggcagatcacttgaggctaggagtttgagaccagcctggccaacatggcgaaacccagtctctactaa

SEQ ID NO: 546509 - DNA, 908 bp, Homo sapiens
taaaaaagaagcgacctgtcttgcttccttcctctcctttgccctgtccaaaggtgaatgatatgagtcgggcggggtgctgtttcccaaaaaaaaaaatgaggttcagatgtgatcggtgtccccggggagggggtgcctcataacatgtcagacattgactggcaccgaaaagctttctggggctgtcttcaccgtctgtgtctgggcttgggactcctgagctgcacaataaggatgtgcatggtgctgctgaccgtatgttcccccgaagttccaggaaggtgcagagtgcttgacagccagccctggagcttgcccttgccagtgcttactctcagaactgactccgtgagggagggcaagtgtctgaatggactttctccaggttctcactcttaggaagatgcggggggagcttactcggtgattctcccctgttaggatcagtgtctctggggatgccttccccttccttgacctccagtggggccttccttcaggtgatcactcagtgttcctgctcccagcgaggggtctgatctcaaagggttctgcatagagaactgcgggccaggcacaactctccggggggatctccctcagaaagtggccctctctgccgaaaatctgtacgcgccggaggtctcggatgtgggggacatgctgggtgtactgagggcttggggccctgccggtgccccgaatgctggttggcagccgggtgtcgcacctggtgacgccgggttctgggaaaagcccactttacccggtgtataggccgaaagataggtccagggcacaccacaacaaaaggcggtaaatccggggcccgcgcccctttacaagcctagattaaacacgtaagggagcacgttgacccgggcgcccaccaattgtctccacca

SEQ ID NO: 546510 - DNA, 189 bp, Homo sapiens
gtcactgcccattcagccatttcagccagcccttcatttcacattcatttcaacatccattttcatgtttcccatatttccccaacgtgcccccatattcatgcaatcccatgcacatcccacttgcacatattttcttgttttgtggctgccctgctgtccccactctggggtgctcctcgtcgcagt

SEQ ID NO: 546511 - DNA, 389 bp, Homo sapiens
  misc_feature (1)..(1): n is a, c, g, or t
  misc_feature (45)..(45): n is a, c, g, or t
  misc_feature (102)..(102): n is a, c, g, or t
  misc_feature (164)..(164): n is a, c, g, or t
  misc_feature (173)..(173): n is a, c, g, or t
  misc_feature (187)..(187): n is a, c, g, or t
  misc_feature (232)..(232): n is a, c, g, or t
  misc_feature (297)..(297): n is a, c, g, or t
  misc_feature (317)..(317): n is a, c, g, or t
  misc_feature (335)..(335): n is a, c, g, or t
nacaaacccctttttaggcttgctgcctaggcaacatgctgtgtncctgcagtaaacctgctggttctacccccttgccccctcccccagggtgtccctggncacccaaattgctgtccatgctggcatctgtagcttcggtggcttgacattctccccagggnacttccctnttcctagttctttntccagctcctccccactctgtggcgacctttccaagccttccctnaccctccccgccagcaccctctttggggagcaggaacttaatctgctgacagagctacacctttnataacaggctcagatcactnagctccctgtgacctttntattcacccagggttcttctcagtagctctagctgggggaggtgtcagctgggt

SEQ ID NO: 546512 - DNA, 94 bp, Homo sapiens
ctccgtgccttgcgcccagtgccgctgcccctgcctccgtcgacctcaagcactcggacgggacgcgcacttgcggcgaagctctatgacaaga

SEQ ID NO: 546513 - DNA, 234 bp, Homo sapiens
  misc_feature (223)..(223): n is a, c, g, or t
tctacacggatcccgacctagacgtacacaggcaggagaaatgttttttccagcttcctccttgtggctccgacatcctgttttcagagcggttgtttttgtttggggtgtgtgttttatcatgtgaattagtctcttaaaagatgggcgtcagacttgcatacgccgtatattagcatccttcgctgtcccttagctactttggtagcttatttgatactgnttataggtgtg

SEQ ID NO: 546514 - DNA, 273 bp, Homo sapiens
cctcatgatgagggtgggtgagcgcacacttggacactatgatgaggctagatgatgctaggtgagcgcacactgggacactatgatgaggccgggtgagcgcacactgggacactatgatgaggtaaggtgagcgcacactgcgacactctgatgaggctgcttgagtgcacactggggcactatgatgaggcctggtgagtgcacactggggcactatgatgaggccgggtgagcgcacactgggacactctgatgaggctagtggtggtg

SEQ ID NO: 546515 - DNA, 100 bp, Homo sapiens
cctaacgtcctcaggcacttcgcctccttcccggactctgtcgccacagctcccgctccgacacaccttgccaagcatgtttgttcccggcacatagagt

SEQ ID NO: 546516 - DNA, 844 bp, Homo sapiens
gacctccagcctttggttcctcaggcagcaaccgaggccccttctccaatctctgcttggtcctgcctatcaaggaatccctagtcacttaggaaggctgaggcggggggaaatcacatgaggtcagcgcagttcgatgactagacgcatgaatcgactctatgggtgtaaaaggcctgttctcgtaaatagaaaattacgacatataatgtatgctgggccgtggatgtgttgcaatgccttgtaaatccctagctttcgtcgagagaggctgagagtcaacagaggatatccttttgaaactcgccgggaggcggaagattggccaggttgcgccgaggatcgagccattgctatttcagacgtagggtttgcaaagagcgaaccttcgatctcacgaaattaattacccaataggaagggcaatgctttttaggaattgacgacatgaaggggtgactaaaaactagtcttaagaagcttctagcgttgttagagagaggtcggtgagcgctggaattaagagataaatttcgaaggggcgatcttttgagtcaaccgagatgaaaaccggggggggtgaataaaagaggacctggaaatccatgacgcaagggaggacgtggcggtcaattcaagagcctagtaaacgccatccaagtaggacgcagacgaacaatgaagggactcaatcggacaggggtacgatgaaaccacctgaagaaatagaccgccgggggacaactgaggacacagtcgggaaggggacgacagatgaacgatggaatcgaagataaaaatcccgggaaacaaaaacaaaaaaaattgcgccaccaaaatagcc

SEQ ID NO: 546517 - DNA, 522 bp, Homo sapiens
  misc_feature (19)..(19): n is a, c, g, or t
  misc_feature (67)..(67): n is a, c, g, or t
  misc_feature (95)..(95): n is a, c, g, or t
  misc_feature (97)..(98): n is a, c, g, or t
  misc_feature (138)..(138): n is a, c, g, or t
  misc_feature (141)..(141): n is a, c, g, or t
  misc_feature (146)..(146): n is a, c, g, or t
  misc_feature (152)..(152): n is a, c, g, or t
  misc_feature (160)..(161): n is a, c, g, or t
  misc_feature (172)..(172): n is a, c, g, or t
  misc_feature (181)..(181): n is a, c, g, or t
  misc_feature (185)..(185): n is a, c, g, or t
  misc_feature (193)..(193): n is a, c, g, or t
  misc_feature (206)..(206): n is a, c, g, or t
  misc_feature (212)..(212): n is a, c, g, or t
  misc_feature (215)..(215): n is a, c, g, or t
  misc_feature (222)..(222): n is a, c, g, or t
  misc_feature (227)..(227): n is a, c, g, or t
  misc_feature (519)..(519): n is a, c, g, or t
cagtggttttgcttaggtnaggacatcagagatcattcccctgggtggcaccaactctggacaaagnaaaaaaacatgcatcaggactacaggananncttcaattcagcatcaatctctgaatcacagtaaagaggnggngagtntatggnacagcagnngggggggaagnctgagcgcntgtnaaccagcnttgccagtgccgngggtgnggnatcaggnaattntgcttttagtcgctctgccagttttttcttgtactcagtaaatgtattttctgaataatctgcacatagttcttgtcccttgtcaatgaaagaagatagttccttctttagtagagggcccttagcattaaaacaggtagttgagtcttcaacatcacagcattcaccaaggctttttagggttggctcaagtaccttactgaggaatacttccggaagatgagtccttctgcttagttcaaatgtatacttatccatgactttggtgtttcctggatcacacacatctttnttt

SEQ ID NO: 546518 - DNA, 134 bp, Homo sapiens
ggtctcaccctaccatgtatgcaggcacactcatcacagcgctaagctcgcactgatttttttcacctgagtaggactagaaaataaaacatactagcttttattcccagtacttaagcaaaaaaaataaaacc

SEQ ID NO: 546519 - DNA, 896 bp, Homo sapiens
gcttttttgcctgccgccatccacgtaaggtatgattgcccctcctgccttctgccatgatgtgaggcctccccagccacgtgaaactaaggagagtgcatgagattatataaagactcagagaagagatacagctcctcccgcaccagagaaatgcagctccgtgagccccgatggagccagcatgctgctgggtgctgaggagcaggcagaggcacccaggatggcggtccccaaggagaacggaggcacagaacaacgcatgaggggccacatgacttagggccgggatcggtcactcagccagcaaaaacactggaagaaaacaaaacaacttcagactctatgctgcatttccgtaatatatctgcccaaagactggacaacaagggaaaaggaggctgatgaggaaacgaaaggatccgtggttcttggctcgctgggtggctcatcaacaaagccccagcatcactcctgcagatgccctagcctggctgggctggatgggcaaaattcaccatgggactcttgttcaagagagggagatcaaagccagaaacacttacccagaatggcatgcagactaaaattcccaatcctaaaaatacttttaaaatctaacgtacaacaaggaagcgggacaatatccacacaggcgacagggcagaaaattcaaccaacgacctcaggggaatatctgggtcgggttacagagcggtaagctcagcaaggtacacgacctaaatgaccgacacccgaaaatggccctaatacggggcccacgaaatggcccaaagacgggcgggatcggcaccgggccgggcacaaaaaatggtagagccccacggaactcagggtcccaactacagaggggcaacacacacggcgggccgcac

SEQ ID NO: 546520 - DNA, 839 bp, Homo sapiens
  misc_feature (220)..(220): n is a, c, g, or t
  misc_feature (389)..(389): n is a, c, g, or t
gaaacaaaagctgaaaggtccggcgtacatggggccctggccatttaatccaggagccgcagaagttaaatcctgttgttggcctccaccccaccctgtagggcctgcatgaagggtcccgagggttttggcccccagaaaaggagcccatgaaccaaggttaaaaggttttgcggccaggtatggtggctcacgcctgtaatcccagcactttgggagnctaaggtgggcggttcacctgatgtcaggagttcaagaacagcctggccagcatggtaaaaccccatcttgcctaaaaatacaaaaaactagccaggcgtggtggtgggcacctgtaatcccagctacttggaaaggctgaggcaggagaatctcttgaacccaggagncggaggttgcagtgagccgagatcgctccactgcactccagcccaggtgacagtgtgagactccatctcaaaaaaaaaaataagaggccgggtgcggtggctcaagcctgtaatcccagcactttgggaggccgaggcaggcagatcacgaggtcaggagatccagaccatcctggctaacacggtgaaaccccgtctctactaaaaatacaaaaaaattagtcgggcgtggtggcgaacgcctgtattcacagctactcgggaggttgaggcaggagaatggggtgaacccgggaggaagagcttgcagtgagccgagatcgcgccgctgcactccagcctgggtgacagagccagactcctgctcaaaaaataaaaaaaagaaccggaggggggaactaggacggcaatcaaaggggcctggagggcgttgggagtggagagggagga

SEQ ID NO: 546521 - DNA, 172 bp, Homo sapiens
tccaccaccctaggtcaaagccactatcatctgaagtgtacgggataggtaactgattaggcagaaataaatcagctcccaatgtgaacccacggaaacaaatacggtcccaagaaaaaaaacgggagctatttcacagagctaagcctctgccacaattcattcctcaaac

SEQ ID NO: 546522 - DNA, 106 bp, Homo sapiens
gtacccactgaataccttccatgtatctgctatacttgcaaggtcacacatcatcagccaatatccaactcacgtagacttattcgtaatagctcctccctgcctt

SEQ ID NO: 546523 - DNA, 231 bp, Homo sapiens
ccccaggccctggcaggggggggaaggggggggcccaaatacccccccccccccggtttcctagcaatgaaaatttaatatttttttttggggccccggggggggggggggcggggccccccgtcaagggcccccccgcccggggtcggccccccccctgccccaaatcggggttggggggggggccccccccccccggcccccccccccccccggggttgggtttttttt

SEQ ID NO: 546524 - DNA, 164 bp, Homo sapiens
tgattcttaggttttacaggtaggcagttttattgtctacaaataatgacaattataattcttccttatgtccttcatctggctgtgcagggtagtagtgcggacactgctgatatagctgccttgctagttctgaacttaatggatggcgtcgctgaccttaa

SEQ ID NO: 546525 - DNA, 438 bp, Homo sapiens
agacacaggtgacagagggtatcttgaagtccccaaagccattagtacaccatgtatcttaggccctatttattcctgcctttctccttcagaatgttctatagaaaagaactgcattttttatcctttgtggatctgcttagtattggctgctgaggatagataacgcatgcggcttacaaaaaatgtgttccgtcccagattttcttggcctttcctagttgtactctgcaatttctctcccatacctccctcacatttcttcctactctcacttcctattcacttcctattttctactaccacggccattatttcaacatttaccatcacaagatacctggaagtgtatggtatctgagcaatatctagtcacatcctcttatctagagaagtgacctatttatttttaacgatgactacagaacctatttttag

SEQ ID NO: 546526 - DNA, 585 bp, Homo sapiens
agcgggcaatcgatgtgaccccgggcccctgcggtctcccactcctccggaagctgccccatgcccacactgtggcagctcccgtaatctctagagcccccaaccagagtcctccagacaccgacccgcggaggcgtcgaagcagcctgacgactgcaggagcccagcatagacaggggacacagaaccaacacgtgtggacagcaaacaccagtgacaactagaccaaacgcagcgcgaaacagcatacgaagcgagaaacaacaagaagaaaaagaaaagaacacaaaaaagatacgcaacaccaaggcaacaagcccaacacaagaggaacaacaaaacgaacaacaaagaagcacaaagaaatcacaacagcacagccaacacaaccagccccccccccacaaacaccccacacagacagaacaaacaaaacacaacgacaacaccacacacacaagccagccccacaaagcagtacacacaatcgcaggaatcacaaggcggcaaaccacacagaaacacacacaaaacaacaaacaaaaacaaaaaacaagcaacacaaacaacacacgacacacacag

SEQ ID NO: 546527 - DNA, 437 bp, Homo sapiens
  misc_feature (437)..(437): n is a, c, g, or t
ccgcctcccgacgcgggtggccgaggcgtatggctgcgagccccgcacccctgcgaacatggcgctgagagtggtgcgagagcgtgcggtccctgctctgcaccctgcgcgcgagcccgttacccgccgcgccctgcccgccgaggtcatggcagatgagggtgggcgccgagcgtccactgcgcactggaacagctctgatctaggtgcgtcaattcacagagaatcacgaatggggatcaacagagcatgacattgcaacagtgctgatgagcaattttgcacaggaagcgatgtgagatgtcgtgtattgccaactccctgaagttgggacaaatatgtacactcatgactgagttgctgacttagaaagcgaggctgctagtgtactatattagtctttatcagcgagacagaactgagattatggctcttgn

SEQ ID NO: 546528 - DNA, 403 bp, Homo sapiens
tcctctgcatcacgtctgtccctagtgcctgcaggagcaggcgctcagcacagatcatgatgtgctagctggccacgatggcctggctggggtgcggtgcaggtagctcaccacagtcccggtcaggaggagggctacccacgcagctcacctgctgggaaaagtgggccgcctgtcggatggtggtgagtcaccaccaagtctcacagattaccctccactttttactcttcaaaaggggaaaaagcaaagggtgagcctcaaataggaagtgcccaggaacccatcaaagctgaacctggaatgtgggtccaggccccaagtcacaccccagcatgaacagtgctccaaggtttgtgcgcagcatggtcaggcatcagcctccacagcaaagtgcaggact

SEQ ID NO: 546529 - DNA, 655 bp, Homo sapiens
caatccctgacgcaccgccgtgatgcccaggtaagacaggtcgacctggaagtccaactacttccttaagatcatccaactattggatgattatccagacaatgttctcattgttgggagcatgacaatgtgggctccagagcagatgcatgcagatccgctatgtcccttcgtgggtaatggtctgtggttgctgatgggctaagaacaccatgatggcgcaaggccatccgagggcacctggaaaacaacccagctctggagaaactgctgcctcatatccgggggaatgttgggcttatgtagttcaccacaggaggacctcacttgagatcgagggacatgttagtctggccaagtaacggtgccagctgtcatgcccgtgtctggctgccatatgctcccatgtgaatgtcactgttgccagcccagaacactggtctcgggcccgagaagacctccttattccaggctttaggtatcaccactaaaatctccaggggcacctattgaaatcctgagtgatgtgcagctgatcaagactggagacaaagtgggagccagcgaagccacgctgctgaacatgctcgaatctcccccttctcctttgggcttggtcatccagcatgtgttcgacaatggcaggatctacaac

SEQ ID NO: 546530 - DNA, 412 bp, Homo sapiens
tagagagtctgtgttacgagtcataggacgacgtcaggctactgtcatgacagggttttcaagatgaagtttcactcttattgcccaggctaaagtgctgtagcttgatctcggctcactgaaacctccgcctcctgggttcaagcgattctcctgccttagcctgcggagtatctgggattacaggtacccgccaccaggcctggccaattttggtatttttagtagagacgggggtttcaccatgttggccaggctggtctcgaactttttttttttttttttggaaagggagtttggctctgaccccaggtggaattggcgaggggcgcaaatctgggttcataaaaactttggcctccgggggtcggagcagatactcgggcttggcgctccgagagacagggggtca

SEQ ID NO: 546531 - DNA, 432 bp, Homo sapiens
aatgaagaaaataaattaggtaattgacaagaaatgtttcaccgattacaataggctataacttagtatattatgaataaaatatatggcacatcatacattttaacatcacagattcagtgttaaacagcaattcagacatgataaagcttagacttgacaagaatgatgtaaatacaatgaggcaactgaaactgaaatggcatgtgtaagtaaaattaatccccaaattaaaggcattccttagatagggcacataataacatcttctgagtacactttggtcaatcactggtcattaagataaacgccattcacttttagttacaaaatcagttttctgctgtagtttaaatacaaagtacaagcacacagtgtcataacacataataaaaaccatcttaatattgcttacatcctaatactattagt

SEQ ID NO: 546532 - DNA, 338 bp, Homo sapiens
  misc_feature (97)..(97): n is a, c, g, or t
atagtctcaggtttaaccttggaatcggccgggggccccttcgccctattcttcatagccggatccccaggcctatttataataacaccctcccccngttcgttcttcctggggacaacatatggcgcactctcccctgaactttacacaacatattttgtcgccaaggccctacttctaacctcccggtttttatgaattcgaacagcatacccccgattccgttacgaccaattcatacccctcctatgaaaaaacttcctacccctccccctagcattacttatatgataggtctccatacccattacaatttccagcattccccctcaacccta

SEQ ID NO: 546533 - DNA, 1021 bp, Homo sapiens
ctagttctagatcgcgagcggcgcccttttttttttgtgtgtttttattatcccctttcttaaaagacaagctagtatactggaaaaagaaaaaaataataataaaataaaaaccaagacaactttattaccctcatctttattggggaaggggagggggaatccgtgggtcgcccaccctcacccgtggctcctcccttctcagctaagctcgtccctcggtgccccccctttgggtgggcaagtgggagaggaccagggtgggcgtggaggtgtcgtggaactagcaaagggtggtgaggtggggcaggtgtggaggtgggagcataccgtgggacccggggtcgggggaaactcggggtgcccaggacgggaaaggggcagctagcattgcgtgcatgcagtaccagggtgaaagggctgtggcccaggcagactggtcggttacactatgtccaaaacgggggaagggccggggctgctgcgcttcgaaaggtctggctcccttgggaccgggtctcccatctgaccctcaaggccttagctaggcctcaatgtcaggacaggtatccacctaaccaggctgacaaggggaggaggagggaacccgggaatggggtcaggaagaaagctaaaggtggccctggcaagctggagctggggcccccgcaagacggcacaaccaataaactactacgggagctacagcaaatccgagacccgaagagatcatggcgccaaacaataccatatagtaaccggagcaacaggtcaaccccaagagacaaccaacaaaaacacacaagagagaacacagaaacgagagacaccgacagacacaaaagacagacacaaaaaaacaccacacgaaaaacagaaaacaaaagaagaacgaagcaaagagaaaaaaaaagacaacaaaaccacagaaaacaaagaaaagcaaagcaacgcaaagaaagagaaacagcaaagaagaaacacaaagagcaaacaagaaaaacagcagcacgtgaacaaa

SEQ ID NO: 546534 - DNA, 971 bp, Homo sapiens
  misc_feature (871)..(871): n is a, c, g, or t
  misc_feature (886)..(886): n is a, c, g, or t
gtaaaccatggggttaatattcaactcatataacagcaaaaaagttaataatataaagtgagcttgtagaaaccaagaataaaaaggtgcaactcattataaaaccaggcaaagtatatgaacagatagttcacaaaaaagtgaactcaaatggccattaaatatttctcaaatctgcccccttgaaagctcagagactagggttttcaaagataatttggagggcagggggctaaggaatgggtgctactgattgcttaggaatgaaattatagagatgtgagaaatgtcttcaagtgctgagtttgtttctgggtgaggcagacacaggacaggtaaagtcagttccttgctgtagaatcacaggtctaggtagtgtcagtaacttttccagaatgcaaatgtctgaaaaatatctcaaaggtcagtcttagattttacaatagtgatgttaactacaggagcaactggtgaagttacaaagtgtgacttctggttacatgactcctaagcagtaagcaagctagggaacaatggctggttattgcttaactatgcttatagcttagcagaattgagacccctaccatctaccataattctaatgctgtggaattgcattaatttcacaaaggggtttaggtccctgaacaagaagggagttggtttcaggaagagactgttgtcatccttgctttaaagttaaattataaactaaattcctcctatagttagcttggtctatgcccaggaatgagcaagaacaaaatacaaatctttaacaactctattagcaaggctgtgaggaaacagacactctcatgtgttaccaaaaagtgctataactctgatggaggcaaatttgaaatanctaataaaattgctnacattgttgtaaggattttgcatcattactctcaaaatatgatctgagaaaccctgaggatacatgagaatctttcaggggatag

SEQ ID NO: 546535 - DNA, 453 bp, Homo sapiens
  misc_feature (82)..(82): n is a, c, g, or t
gggtttatagctttcatatttctttattattgtaaatgggggctgtggaaggtgagaaaacacatgctttcttaaaacagangctctctccttcattaatttaaatatttttatcggctctagaaaatgcataaggttagtacaagatcagtagagagaaagtcaaagattacagaagtgctgaagcagaccattcttcctttcttcccaatgtctattaagatcacacataggtaaactgttacaaatccagaatggtgaaagagtccaacaatggctgagggaagtagaggttaagatatagctcaacagtgaaagtagcagggaaagagctgggcaaggccaagaccatcttttgtaccgttggtacagtaggctaaaggtacggtgttccatattaaatacagcaatatgaagaaaaataaattaagtcccttatacctaaaaaaaaaa

SEQ ID NO: 546536 - DNA, 967 bp, Homo sapiens
ttttcatcattgagagctactctgaggacgatattcaccgttccattaagtataatattggtgcagcacagagccatggtaaccacagagactgggatgctgcttatcgttcacatgaacggtaaaggcacccgattacattgacttttcagtgtcaacggcagtggaacacttctgtggtggtggcagaaatgatagatctgtggtgtgactacaacgaaatgtgtcaggtgtgtggtgcccaggtagtaaaatggcaatggtgtcgtttggatgtcaggtggatgttttgtgagaggacgtttcccaatagccaagtgggaatacattcgtctatagaacaatgagaataaacagtgagccaaatctagggacactcaggaggtgcctctggaaaaggctaagtcaggtgtgagacagcattatgagtcagagtacaagtcatcgacgccacttccagttgagattgactgctgcacaactatgagaaatgccttggagggaacgaagaaagtgttccaaaggaacggtgaaggtcgtgggaaataaggaggcagtgctagagaggactgagaaaggttgcatctgtatgtcctagagagggaaggatgagcttggaggagaattaggacttttttcttgagtttacggactttccgagacgaatggagaaactggcggtaacgttttggacttcacgaaagacgtaggacttactgtcaggaattcactatgacagaagagatatacacaaaacttcgtgaggatccggagaaacggtcactatattggcttgttgggttcagacacaatgcgtgggtaggtgaaacaattatcgaattaaaacaaaaggtcaaggttatgtaacacttcccacctgagtgcgtaaccaggtgagttgccccacaggggatgtattacgcaaatagagagactaataagaggagacagtcaagaaaaatagaat

SEQ ID NO: 546537 - DNA, 347 bp, Homo sapiens
aaaatgtgggacttgtatcttctttgtttttaatgcacacacatacatgttctgtgcatgtatgtggttactgtgtatatgtgtatgagtgttgtatatgcatgtgtgagtgtgtgtctgtatgtgtgtacaactaaagaagctgcagaaactttgtaatactttgtgaaaaggattatattataaaggtttgtactgtctgagtgcacagctactggaataaatttagggaatctcaggaacaagcatataatttgtccaagatttatttcttctcagaagtgtaagtgcagtttttaattctgtatattatttaatattttaccaataaaataaacttctgacat

SEQ ID NO: 546538 - DNA, 459 bp, Homo sapiens
  misc_feature (9)..(9): n is a, c, g, or t
  misc_feature (53)..(53): n is a, c, g, or t
  misc_feature (66)..(66): n is a, c, g, or t
cagaacagnaaaaggggccccctaactgtggtagggaagtggcccccccagantccagggaggccnggatgaaatttaaaattcctgccatgtagggccatattttggggagtgatgggattatgccacacccttcaggtgtcaagataaagagataaaacccagagtttgtacagaatgagcttgctgacacacagcctaaatttgtaccgcatgtttcatactaactccctctgagtttgcacatgggacccatgaggaggcatgaagaggtaactgcccatgcccgaggattttccagcccttccttttctttctgtcaatcacctactaatcacagaatccactccctacaccttttctactaaaataactctttaaaataagtacaatgggacagatttgagctgggctcctgtctccttgttaatcaaattgcaataaaatgttttcttttgt

SEQ ID NO: 546539 - DNA, 233 bp, Homo sapiens
ttgtgggaacaccacacgaaattgatctggaaacacatgtgagagagacggaggcgctgtaactacaggaaactacacgccacgtatcttggaggagcaggctcctgacacgcgggctctgtgacaccagacggtctatttgttcaccataactgaagggcatctaagaattaggtacaggtaaggcatcgacagcttgcttggagaattgggcaccagaaccggcttgcgtc

SEQ ID NO: 546540 - DNA, 286 bp, Homo sapiens
tcagcgatagacaatggcgcaggaaagaaaaggaaaagaccttatcagataagttgatttaacagaaaagagagagagagagataaagtgggtagattttcacaagtgtatacagccgaaaagaggacatcttttgccgtgaggtcacgggaatattgtaaagagatatcaagaagtccctattgttgcatgagttgccacattcacaaattctcgtgcttctctttcgacatagccaaaataattttgcttgagggaggagcgcataggagcaagtcattgtggg

SEQ ID NO: 546541 - DNA, 187 bp, Homo sapiens
tctagaggatccctgcgatgttctcaccgaacactactaaggggtgtgtcttgtccataccttttttcttgttctgttttttgttttttttaccccggtgcgataacctttcttttttttagcccctcccttgtgtatctaaaagtcttaacaaaaccaaaaaaaaaaataaatggttttggggccc

SEQ ID NO: 546542 - DNA, 861 bp, Homo sapiens
cttttatcggcttgtcccggggttaccctaaggcctggtgaaccagaggggggggcgaatcaaagagtcttactagttagaggcctctaagatctgggttgcatacttgccggcggcatcttaaaacgcggggacccagttgtttctaatatagcgaaagctgcgacccccttttgacgcgatcccattcacggcactttgtccacacaagtctgcacacttatattaccaccttggggggtgcccatctttacgcacacgtgggtgctctgccacccgtttgtttcgtcacgcaactacgcgagaacgaactcttcatgatttacttctacatgtcacaatcccaggcacctttgggccccaatttatatgcccttttgatctcgcaaggatctgacgcccagtagtcaccacaccgggtacccaccgtgtcagtaccgttgcccgaaagagggtagtgtctcagaacattagtcatcacaggctttctaacagatcctggatattactgcccacgccagggccccttcgcacacatatcttcgttgtatagcccgaataccctccacaatttatgtataatgaaacaacacctgcacccaacctcacatatgcttcactaggcacaacaatgatgtacgcaactctcgccctgtactctaccacaacatttttttgtcaccaagaccctacttgtttacctcccctgcttcttatgaattcgactagcataccccccggattccgctgcggcccatttatacacctccgtacgcgtacttcctcgcatcaccctagcattacttatagatatgttcccatacccattaccatttccagcattccccccttcataaccta

SEQ ID NO: 546543 - DNA, 457 bp, Homo sapiens
  misc_feature (2)..(2): n is a, c, g, or t
  misc_feature (181)..(181): n is a, c, g, or t
angtctcccttctgcaacccctcctcaacctctgtccctttttgcaggcccctgaaatctgtttcccagctagctttgtccctcccacactaaatgaggacccaagaaaaatcaacaatgattcctaagcgtcatggagacttaggtatgctctcaaaagtgaaacccaggccgggcatgngtgtcacgcctgtagtcccagcactttgggaggctgaggtgggcagatcacttgaggacaggagttcgagaccagcctggccaacatgatgaaaccctgtctctactaaaaatacaaaaactagctgggtggaatggtgggtgcctgtaatcccagctaattgggaggctgagacagaagaatcgcctgaacctgggaggtggagggtgcagtgaaccaagatcatgccactgcattccagcctggatgacagagcaagactccattaaaaaaaaa

SEQ ID NO: 546544 - DNA, 313 bp, Homo sapiens
ctgttggtcgtctctagagtaatccccctgcctggttgctctactgcactcatacctatcttgcacatgagcatcaaccctctgtgtgtggctttgtccacgtatggttacagtgacctatgactttgtcatgccgaaaggctgtgtggtgggaaccacgaagcgggtgctcaccctccgcaagtccttgctggtgcagaccaagcggcggcgctctggagcatagattgacctttagttcattgaccccacctccaagttgggccatggccgcttccagaccataccagaataggagtatagcaaccggcgg

SEQ ID NO: 546545 - DNA, 296 bp, Homo sapiens
tgtcacccaggctggagggcagtggcacaatcacggcttaccgcagcctccctgactcagatgatcctcctacctcagcttcctgagcagctaggaccacaagcgcccgctgccacacggccaatttttgtattttttgtagagatggggttttgccatgtttcccaggctggtctcaaactctggggctcagcgatccctctgcccaggcctcccaaagtgctaggattacaggtgtgaaccaccatgcttggctactttatattatcataaccatattgttggtaaattttttg

SEQ ID NO: 546546 - DNA, 482 bp, Homo sapiens
  misc_feature (52)..(52): n is a, c, g, or t
  misc_feature (71)..(71): n is a, c, g, or t
  misc_feature (106)..(106): n is a, c, g, or t
tcttaagctttccccccatagtgcctatagttcccaaaggaaacttaacctncctgggtaattaaccttanttttattagaacactgcagttggactgaaaacatncagatgcactggaagagaaccttgtgctgaggtaatggcctcccactgccgcctgagtgctgaaatgagcttgaggtgttcttcaaagccagtgtcactgtgtgggtcactgtgaggtgactgcatggtgcctggccctggcacagctggtgacttcccttgtagagtgtttgcgtagtggagtggctgtggctcaccaccccctttcccaagtgctttaatgaagacacctcccttgtgtttcaaccaatcagaaactactttaactaaatgtactaacctttttccctcctaatttgctttgaaaaagtttagtaattcaattaagcgtgattctatcttagaagaaataaactcagtattaattcatgtctaa

SEQ ID NO: 546547 - DNA, 113 bp, Homo sapiens
aattacaattgtgaagatgatagtgtacagggaaggttaatggttgatattgctagggtggggatcaatagagggggaaatagaatgatcagtactgatctataggagtggtg

SEQ ID NO: 546548 - DNA, 286 bp, Homo sapiens
gatgggatataactggacgggagtaaagaggtgttgtgactagtataccagatcatgcgtgtaaaggacgaggattggtagtacgtggagagtcaagcaggagtggagctcgatgctggcctctgcccaggagcagccagccaacagctcccttcggtcttcagcccttcagggaggatgcgctgcacaaagaagagcgggcctggccaagggcctgttctttagtatccagagtgaccacctcccttggtcaagggcccgagagtagggcccgagagcagggccc

SEQ ID NO: 546549 - DNA, 610 bp, Homo sapiens
cccccccctacccgcaaaagggcgctcagacacgtccactaatagaaccacaaacccagagaacaacctgttcaccactcctgggtgcatgattgaaggtgaggcgtccaccaacacttcaaggggtccatagtattttttttttttgctgcctcaaagtccccaaagccttccagcaaaagtggcagtagatggttgccaatcagccaatgcagactttcactgggacaacaagaaagcacatcttctgggttgtggagggaacttggcactggagacattcagctgatgcattatataccccgtcagagcacacttgtatcttttaccttgcctttgccccatgcccccaaactgacttaggtgttctctgtccctctactgggtggtgacgacgagatcatatacaaacaggcgtcttttgctaaaaaaaaaagaaactggacctccctgccctcagggcgggaaactatccgcgcccgtcccctctacccgaggttaattgcatgaccctccgtgcttgcctacgttggactcggcaaccccgacccaacgatccatcgtgaggtacgctcaagcgccgcacccacggtctccaccctatggcgcg

SEQ ID NO: 546550 - DNA, 257 bp, Homo sapiens
  misc_feature (5)..(5): n is a, c, g, or t
  misc_feature (14)..(14): n is a, c, g, or t
  misc_feature (124)..(124): n is a, c, g, or t
  misc_feature (131)..(131): n is a, c, g, or t
  misc_feature (142)..(142): n is a, c, g, or t
ggagncgagcgcgngggctgctcgggccgctggcatcgggtcgggtatggggccgggaggtttccccttggggctttgttccggaactgtgtccccgccttttcccgacggtgattcagaggtnccgacgncgggttccggncagtcgggcctccacccgttcgagtttggtaaaagaaaatggcccgaaccaagcagacttctcataagtccacctgtgggaaaagccccccaaaaaaagctggacacgataagac

SEQ ID NO: 546551 - DNA, 419 bp, Homo sapiens
ccaacatatgaactgcagcatatcactttttctttttgggcctcaggttcctcagctgtaaaattgaaaaatatatgtattaataatattattaataataataatgggaatgtagtacttgtttgtaaagcactttgagatccttgggtgaaaggcaccataagactgccaagcaatataatgaggccaaggcggttatataaaatgggaagttcccaaacgccacgaaagcaaggggtcgattcaacgtcacagagtcacccgtaagatatacagtaggacagccccatatatagtggccattgaaacaagcagaattatatacaccgggctgtaaaaaatcaaagctaccctaaggggcttcccccaccggccaaaaagtgccacttaataaaacgcccaaaatttcttctacggag

SEQ ID NO: 546552 - DNA, 1457 bp, Homo sapiens
  misc_feature (629)..(629): n is a, c, g, or t
  misc_feature (992)..(992): n is a, c, g, or t
cggccctacacacgtgggggcaaccaccagcgggtgtgggcgcctctttgtgtaccttcgagggcccccagggtgtccagacagccgggcgtgtgttcttctcgcgcccttttatttatcccgggtctttaaaggtttcacagctcttggggttgcgagattttcgtgcccccggacgcgggggggcgttttaatgggtttttcttaagagtgagaccggggcataattgtccctttcgaccaacgaccaatggggtgcccccggagacttctctttgaaaagtggggacccggttggaaccctccaaacttgtgtgtaaactttgttttatggaggaaagcgtttttagtgggcgccaccgaagaaagtttgccttgtcgcagacacgcttctttggggtggtacaagagaataggggaaaagagggtatatattcattggggtccgtcacgagaaataccaaaagtggggtgggggaaccccgaccccaaaacccacaacggggtgtttccccccccccacgtagacaccacaaggggggtgtgtgccctgtgacacccccacattggggcccccgtgggcctccccccgcagctgggcggtatgcctggagaggtaatataggggnccgccacattgttctcctctggggttatccagagagccccaccacagggagggaaatcctcgggagagatataagagaaagagagggcatatacttcacgctttgtcctggggtgtggacacctcttgtggggagagaccacaaaatatcttgagagcgctgtttcttcacacacttggggtgtatgttttgtgatacataaatatagggagagagagaacagcgaataattctccctcgggggactcggagcctttgagagtgtctacacacactggtgctcttttccccgcctcggggcgctcccccaacaagagagtctattgcacatgagattcccgctcaagactgttgtgcacaatnttctctgtctatataagagaggagtgagaagtgttctcccccagcagtaagtttgtgtaagaaatagacctcctttaaatataagaagagaggtatagaaaacacttatgggaccccaagccacctcccagagaattctagcgggtctgttgtgttacactcccacggtggtctcctgccagccactcaaacggcggcggtgatatgcttctgaagaaaaccagcggtaccccagaaaaaataaaagaaagagaggctcgccagaaataatagctaaacattttggcccagagagaaatagaagaggaggcttaaaggagaaagcccccagaggcaccaatatgcgaagagaccccagacatttcctcttctgcgagcgttttacattttaagatttgaatacccgtccaggaataaagatatttttggggggcaccaaataaaataaagatccagacttctgga

SEQ ID NO: 546553 - DNA, 144 bp, Homo sapiens
tttgttccgcatcgcagtctccccggctcggccctcaccgctgtcctccccgccctttgggcggccacgcccggcggctcccttgaggtccaggcatttcgcacatagcctggcaaacatggtgcaaacctctctcatcacact

SEQ ID NO: 546554 - DNA, 127 bp, Homo sapiens
cttcattcctaccatggatattctaacagagtgcagaaagccagatctcagatctgcattcaccgtactcacacctactagtctgttacttcggcaagtaccccatgcagcaccccttgggatatga

SEQ ID NO: 546555 - DNA, 390 bp, Homo sapiens
aacgatggtccgtcagcttcacttgtcatgttgcaagctgcagcaggatccaccaagcagttccggcactggcagtgccagtgtgtgcaatcatctgattactataacctccaactcctgtgtgctcaagcaatcctccctgcctcatcctcccaagatagctgtgggctatagtcaccaggccaccacacctggctagatttttcacttattttgtagaaacggggtctcaacgctggtcctccactctgtgggttctgcatagtggcttcaaccaaccgcgtatcaaacatattcaggaaagaaaatgacacgttgtgtctctactgcacatgtagactttattccttggccatagttccctcaaacacataccatataaaacactat

SEQ ID NO: 546556 - DNA, 1112 bp, Homo sapiens
aacactacctcgtcccaaccattatattactaccagcggacatgactttccagaaaaacacatagatttgaatcagacacaatcctacccacagcctaacttattagcatcaatcccatctactcatttctattaaacgctacacattcatgcaatcgaacctatttagactgtttcccctaatccatgtttcctaccgtaaccctcctaatcaatcctcctcctcctatatacttatacttaccttgatctacctatcactccttcaccaactcactgagctaagccttcaaactgtccaagcgtgtattccatgtcgtacatccgacatactacaacgtagtacaatatacttctactcgtctacatactactaaagttctcccctttacccaaagaatgcttccacatatagcctctcattacacccaatttctagcgagccgcaagacaagggacatcggtaaatcgcactcatttcctgataggtaattcctcatcttgtgtcgaaaagaacacgtaccaacgtggtcattcacgcccgaaccgttctgaggccctcacttccaattcccactcccgcattcgaacggtggctcacacctcacagcctctaggagaataactgaacccggtggtaccatatgaccaaggtggccatacaacataactccttgtaccacttaatccaccttaacgtaaccccccttaatgactcaagaggacgtcctcgacattagacgcaacaccttacactttccaacatcggtctgagacttacaatattgtcatcgaacattaccaggctaaacacacacctccacttcacggagaccttcacccataggtaacaaacacagatctcttccggttacccttgaagcatatcacaagctttcctgtccaaacgtaggaccccccgaactgagacacaccgtgaattcctagcaaaagcttaccccattggcaagggcccccaacacccactaatcgatcttaacgttgatctgcaacgttgatgtggctctgaacctagacacaacgttaaggcacgttggatatacataaaggataccaagagaggacgggccgcctatcagttgataaccagg

SEQ ID NO: 546557 - DNA, 786 bp, Homo sapiens
ccacacccagctaattgttgtattttcagtagatacagggtttcgccatgttggccaggtgaatctctgtctcttgacctcgtggtctgcccacctcgggctcccaaagtgtttgttttcctttttgatacaggcatttattgttataaagtaccatcttagtactgcttttgctgtatcccataggtttcagtatgctgtgtttctactaaatttccttcttaaattatttaattcatccagtagttattcaggagcatgttatttaatttccatgtatttatatagtttccagagttcctcttattgatctcttcatgttttctattttttcatggttcaatcttggtaggaattttatgtcccgggatttttatgtccaataaatgcttattgatttctagtttcattccattgtggtcagaaaagatacctgctatgatttggatttttctgaatttctgagacttgtgtttcggcctaacatatggtctaccctggagaatattttatgtgcccatgagaagaatgtgtattattcagctatcgaatgaaatgttttgtaaatgtctattgatcaatttgttctgtagcgcacattaagtcagatgtgtctttgttaacttttctttctaggttttttgtccaatgctgaaagtggtatgttaacttagcattcccaactatcattgtgctggggtctgtttctctctttatctctaataatatttgctttatatatctgagtgatccagcataggttataatatattacagtcttatatc

SEQ ID NO: 546558 - DNA, 129 bp, Homo sapiens
ttcgaactctgtatcagtgatctgctgccttggcctcccaaaatgctgagattacaggcatgagtcaccaagcccagccttctttcttttttttgacgacagagcctcaccctgtcacccaggttggag

SEQ ID NO: 546559 - DNA, 351 bp, Homo sapiens
gaagcacgccagcctccgagtagctgagatatggcgctgcaccacgctagccagttcttgtacctttagcagagacaggtttcgccatgctgaacaggctggtcttgaactcctgaccttaggtaatctgccgtgccttggcctcccaaagcaatgggattacagacatgagccactgcacgcccagcctgaagtgctgtagtgtgatcttggttcactgcaacctccgactcacaggttcaagtgattctcatgcctcaccctcccgagtagctgggattaaaggtgttcgccaccacactcggctaattgtggggcatttaattatctattttttttattttttttttt

SEQ ID NO: 546560 - DNA, 378 bp, Homo sapiens
  misc_feature (49)..(49): n is a, c, g, or t
  misc_feature (57)..(57): n is a, c, g, or t
  misc_feature (81)..(81): n is a, c, g, or t
ccaccctaaagctgacctttgaatctagactactccagcagcccatttntaatcccnccacctccaatctccaaaacaaancagaccttaagctacctttattcagccaaactcctgcatgcctaaatcagtctcagggttcactgctgcctctgccttatgtaactcctactaagtcttatttgcctatactatactgcaggcttcttaggaggcaagtcctccccgtccatcccactgcagccccacatagtttgtcttacccaacatctaggaattttttcaaaagaaggttttacattggtagacatccaactttaaaaggagtaccttcacaactctaagtgaataataaagtgcatttaggctcgtgccgaa

SEQ ID NO: 546561 - DNA, 132 bp, Homo sapiens
tgagtctagcctgggagccaggatactggggtccttttcccagtcttccactgactggctgtgtgaccttaggaagtctctgcccctctctcagcctccagtgtcccgaaggccccgaagcattccattctc

SEQ ID NO: 546562 - DNA, 125 bp, Homo sapiens
agtgtatccacaaacaggaggataaaggaggtgcaagaaaacctggctgagtgtggcggcgcatgcttgtaatcccagctgcttgagaggctgaaacaggagaaccactggaacctgtttgtgga

SEQ ID NO: 546563 - DNA, 101 bp, Homo sapiens
tatgggaatatcagtagtggaccgcctgctggtcacaggggtccctcctcatctcccaattcttacatgtcaatatctcagttctacatcacaaatacaag

SEQ ID NO: 546564 - DNA, 125 bp, Homo sapiens
ctcatacctattattcgtgtgcattagctgtatctcctagtgcacagctctaaacctccttattccagccgagctgggccacccaggcaaccttctaggtaacgaccacatctaccatcgttatc

SEQ ID NO: 546565 - DNA, 288 bp, Homo sapiens
actctagcggatcccttatatgctgtctcaaaaaaaaactaaaaattgctgggcgccgtggctcacgcctgtaattccagcactttgggaggtcgaggcaggcagatcacgaggtcaggagttcaagaccagcctggccaagatggtgaaaccccgtctctactaaaaatacaaaaattagctgggcatggtggcacttgcctataatcccagctactcgggagggctgaggcagagaatagcttgagcctggggttgacagagcaaaactccgtctgagaaaaaaaa

SEQ ID NO: 546566 - DNA, 780 bp, Homo sapiens
agcgtgtttccgcttttacattgcttcttaagtgatttttacttatttctgtttgtttaattctaaatatgatgttttgtattttaagtacttttataattggtgttttttcatacaaatgttcagttattatgggttttttaggtgtattacatactcatgaagaagatatactgggtatagactccatctgacacacatacagatttctatcagtttaatagctatcacaccgccagagcctgaaccaatcaggagtaccacagagagtgtaaagaggactcctctaagaacaagaagtctagcatccgagatgaacaagcagaagagcaacaagcaggaagccaaagaaccagcgcagtgcacagagcaggccacaggtggactacgacactcatctgcagaatggggactagctccaaaagagacgctgagaacgcggcagcagtcccttgggggcttctcttgaaaggccgtgggaccaaagcggatgtttggatgctcaagtgcaaaacagacccagtatccatcggaccagttggcgaatccaagtacacagggaagtgcgtcttataccatgtcaagtaagagagtggcctgttgccaggaagtggagcgtattgagctgaaatggcggccactgcgcgacacacacagcacgcacacacacgcgcgcacacacagaacacacacacacacacctcccttccagttcccgctgccggtgcttcttgactggtaacgccctaaagtcttcattcaaaagggcagtgcccccta

SEQ ID NO: 546567 - DNA, 174 bp, Homo sapiens
tagagtattatgaatccttaggggacctcgtagaagtaatcatttttaagaagctgcacatgagtaaaggagataaatgctattagatcctctcagtggaagctatagaaaagttgatcttgaatcctgaagttggaccagaatggaacatttgtaacaaagggctggagaggg

SEQ ID NO: 546568 - DNA, 975 bp, Homo sapiens
gcttgtcctgtggcgagcagccgagctgatcagtgagcgtggctgtctcctctctccggccatggacgtgtgctcgcccattgatatcggtgtactcctggaaaagggggagtcatctggcaagaatgtcactttgcctgcatgtgttcaaggctgcctaattcgaccagatgttgtgacactttgttcactggcaaacttgcatcataaacttcacagcacagccctatatttgtccagttgaatgagtaggtcaatcagactagtgctgagtctatgggggtcactggctagatgctgtgtgctcgaatacccagagtacgaggtggtgggactcgacgctctggccatgagctgcttgtggaaaagcatgtgtccgtggagggccgctatgttgtgcaccaaccaaaagcctggcgccgtgtggcgatcgttaagtgaacgactaacccattcgaacgagtacgccagtctgtgcctgccctggcgtgctcacgctcctacgcagcctactggtcagtgtctagaaggtcatcgtagtgaggaggtccctgagacttcctttggtagtcgaagatatgttgagggctacaggaagagccaggaagctgatttgctccttaagataacttcaggctgtcatgatatcacgaggtcgatgcctctcagcggatagaggtggcaatgggaagtgtaagacgacgcgagaccagggcagggccggcgtcccttttatgagagaggggtagcaaggcctcaaaaatccttgaatcctggttagtagcattgacacttgaggtggcccgagacagtggacgtcactattgagcaatggcacggagagaagaatacggacgcgagacgcccaaataacctccaaaattagcggtgagttagcccataatttcccatacgtcactacgagttccacaaagtgtatggtcgcttgctagaaatcaactcccgctccctccg

SEQ ID NO: 546569 - DNA, 239 bp, Homo sapiens
  misc_feature (9)..(13): n is a, c, g, or t
ataaaagannnnnttccgggcgacatagctccaccgtttgaggccaacgacgccaaatgtttattttgccaaggttgaggactctatccgtgacggagcggtggggaagtcctgacaacatgtgcccagggtgggcagggcacagcttggttttatatttttaggaggacataagacatcaatcaatatatgtaagaagtacattggttcggtctggaaaggcgggacaactggaatca

SEQ ID NO: 546570 - DNA, 690 bp, Homo sapiens
  misc_feature (533)..(533): n is a, c, g, or t
  misc_feature (574)..(574): n is a, c, g, or t
  misc_feature (623)..(623): n is a, c, g, or t
  misc_feature (635)..(635): n is a, c, g, or t
  misc_feature (661)..(661): n is a, c, g, or t
  misc_feature (690)..(690): n is a, c, g, or t
ctgacttcaagaatgaagttgcggaccttcacggtgagtgttacagctcttaaagatgacacagacccaaagagtgagcagcagcaagatttattgtgaagagcgaaagaacaaagcttctacagcatggaaggggacccgaacaggttgttgctgctggctggggtgaccagcttttattcccttattggccccgcccatgttccatttctgtcctatcagagtgcccttttttcaatactccctgcatttggctacttttaggatcttgctgatcggtgcattttacagagtgttgattggtgcattttacagagtgctgattgttgcattttacaatcctcttgctagctacagagcactgattggtgcattttacaatccttttgctagctacagaacaactgttggtatgtttttacagagcgctgattgatgcattttacaatccccttgcgagctacagagtgctgattggtgcattttacaattctagctacagagtgctgattggtgcgttttacaatcctctntgtagacagggaaatgttctccaagtaccaacccaaatgtncatcaatgatacactggattaacaaaatggagcacatatacaccatggnatactttgcagncatggatgagttcttgttccttgganggacactgatgtagcttgtcatcttctgn

SEQ ID NO: 546571 - DNA, 405 bp, Homo sapiens
  misc_feature (29)..(29): n is a, c, g, or t
  misc_feature (37)..(37): n is a, c, g, or t
  misc_feature (46)..(46): n is a, c, g, or t
  misc_feature (82)..(82): n is a, c, g, or t
  misc_feature (127)..(127): n is a, c, g, or t
  misc_feature (389)..(389): n is a, c, g, or t
gagatgccccagaaaagaccaggacatgnacccgggnacgacctgnttcaacaccaatgaccacgattgcggccaaccctgnaccgctgcctgtgcccagcactgcccggaaggccatgatctgcgntcattgccaatccggttaattccaccatccccatcacaggcaggaagttttcaagaaggcatgggagtgtacaaccccaacaaaatcttcgggcgtggacgaccctgggacatcgtcagaggccaacacctttgttggcagagctggaagggtttggatccaggctcgagtcaacgtccctgtcattggtgggccatgctggggaaggaccatcatccccctgatctttcagtgcacccccaaggtgggactttccccaggnccagcttgacagcact

SEQ ID NO: 546572 - DNA, 301 bp, Homo sapiens
ggagttcaaggctgccgtgagctatgattgtgcttctgcagtccagcctgggcgacagagaaagaccctgtctcttaaaaaaaaaaaaaaaaaaaatcttagataagaggatgcggggcctcccggggggtcttcagtcacccatagtccgggcaagagaggagggccaggagagagcttcacccacctgcggtcctgcccatgtgacatccgcaggtgctgccagggccacgatggtggttacactcgagctgaggaggccggttgagcccaaagaaagggcgcccaatgcaggggcaat

SEQ ID NO: 546573 - DNA, 175 bp, Homo sapiens
agtacggtgttccactacggtctagggtaaaatgggggcaggatatagcggaagtggtgggccaaaggcaatttcggggcgcacaaacaggaatggctgtcctcttttagggccactggtctatcagacttgagtagtggggcatttgcctggggatctgccctacttctaccca

SEQ ID NO: 546574 - DNA, 319 bp, Homo sapiens
ggtctctgctgagaaatcagctgttaatctgataggttttcctttataggttacctgatgcttttgtctcacagctcttaagattccttcgtttggactttagataacctgatgactatgtacctgggtgatgatgttttgtgatgaatttcccagaagttctttgagcttcttgtagcaaggccagagaaggaagttttccccaattattccctcaaataagttttccaaacttttatatttcccttcttcctcaggaacaccagttattcttaaaatatatacttttttatttttatgagacagagtctcgatctgt

SEQ ID NO: 546575 - DNA, 123 bp, Homo sapiens
gaagatagggttgggacagggtgctttggaatgaaagagtgacttagagggctcttgggcctcaggaatgctcctgctgctgtgaagataagaagggctcttactccagtaatgatgagtgac

SEQ ID NO: 546576 - DNA, 239 bp, Homo sapiens
ccaaggaatccttactccgttttctgaaggatagatttagctggtgactgattgtcggtttagaacttctggactggcagcacactgttgttgcccaacgtaatcaccttgcaggagaacctcctgtcgctaactagcatgcgaatgaaggagaccgcgcagttccaccttcccaccagttgctcactctgaaagacgagtgggaggagcactgccaggaggcacataacgtggaggaa

SEQ ID NO: 546577 - DNA, 333 bp, Homo sapiens
ccgatagcttatagtagcaaaaaaaaaaaaaaaaaaattccactcttcagaatttggacctggtggttattctggtccagactggccgtaacagaataccatagatgggggtgggcttcacatatttacacaacacatatttatctctcatagttctgggaggctgggaaagcccatgatccggggtacgggccaacgtggtcccgggtgcgggccctttccctgggcttgcagatggcctcgttttggctggtgttgccacatagcagagagtgtcgcaggcaggcaagccagctctcgggtatctctggtttcaagtacactattaagctt

SEQ ID NO: 546578 - DNA, 174 bp, Homo sapiens
  misc_feature (2)..(2): n is a, c, g, or t
  misc_feature (102)..(102): n is a, c, g, or t
  misc_feature (148)..(148): n is a, c, g, or t
  misc_feature (161)..(161): n is a, c, g, or t
cngccatgcggtctcgcaccagtgcccatccccaggggcttggtgctggtcacgatgccatccctgccttgggctgggcaacggcggcacacgctgggacanaggaagtggaagtggacggtctgacggcctacgtggcaggtgagcnccctgacccactnggtcccaggtccc

SEQ ID NO: 546579 - DNA, 259 bp, Homo sapiens
aatgaggccggtacctgttgctaggtgcggtgcgtcatgtgtgtaatcccagcctttggaggcgaggtgtgtggatcatgaggccaggcgttcgagaccagcctgccaagatagtgaaacccgtctctactaaaattacaaaaaattagctgggcctggtggtgggcgcctataatcccagctactcgggaggctgaggcaggagaattgcttgaacctgggaggcggaggttacagtgagctgagatcgtgacactgc

SEQ ID NO: 546580 - DNA, 113 bp, Homo sapiens
  misc_feature (63)..(63): n is a, c, g, or t
cccagctatacacttggaagtgccgagcagaggatcacttgaagccatgagttggagagcagnccagacaacatagcaagaccccgtctcgtacaaaaaaaaatgaaaaaaaa

SEQ ID NO: 546581 - DNA, 572 bp, Homo sapiens
agactttcaaggacaaaggtaaaggatgccattcatgggccttttgcttcttctttctctcgctcccttttcccccgcttctctctctgtctctcatctctgtctcttttttaataaaagctttattgcatataatttacataccataacagttgcccttttaaagtgcacaattcggtggtttttagtgtatttacaaaattgtggaaccatcaccattgtctacttccagaacaattttatcaccgcaataagaaatcccatgcccattcgacattttggtttcttttaaaatttattgcaatattacttgaatgtaatcccagcactttgggaggctgaggcaggtggatcacccgaggtcgggagttcgagaccagcctggccaacatggtgaaaccccgtctctactaaaaatacaaaagttagctgggcatggtgacgcacgtctataatcccagctacacgggaggctgaggcaggagaatcgcttgaacctgggaggcagaggttgcagttacccaagatcatgccactgcactccagcctgggcaacagagggagaccatctc

SEQ ID NO: 546582 - DNA, 108 bp, Homo sapiens
  misc_feature (94)..(94): n is a, c, g, or t
ctcaggtaatgtgggtcaggttctcctcagcatcgcacgtcgctgctctccatgtgaatggtgggtcgaggttcccctcagcactcgcatgtcngcctgctcttcatg

SEQ ID NO: 546583 - DNA, 305 bp, Homo sapiens
  misc_feature (219)..(219): n is a, c, g, or t
ttttgcggtgccctttccatagtgtggctccacagagttttgttcatgcccagcctccttcatataacaggtgtgtaatgttctggctcagaacactcttttggatgtaaaagttttgggtcagaatcttaaggttgaattttgaggtgtagaaacatacccattttctatccctaaacaacacttagggatagaaggcattagtgaggaatgacctgngaatacctacatcttcattccaatcttcaggcccccactcctcttgttgcagtcctccatgcactcgtcccatcatctgggtcaaa

SEQ ID NO: 546584 - DNA, 285 bp, Homo sapiens
  misc_feature (43)..(43): n is a, c, g, or t
agcgaagacatcccaggtcgggtgaatcttccagccctggggngtggaggtagtaaacggccatggaccattgcagaacaatcttttgcccggtggaaatctgtggacgtccatggggctaagcccctatcggtggcaggtggacactgcacaccgggcctaagggcccgatttcgcgagcatgctggtgtccacagtggggctttccagcagggttatcttatgaagggcttgctgggggaaaccgttaaacgcaggaacccgggaaaggaacccaaaaaaagg

SEQ ID NO: 546585 - DNA, 302 bp, Homo sapiens
cagtgttatggtgccacacacttttaaatgatcagatctcacaagactcataacgaatacagcaccaagccacgagggatccaccccaaagatccgatcatctcacagcaggccctacctccggcacgggggattacaattcaacatgagatttgggcagggacaaatatcaaacagtatcagaggtggtggacggcgggctggagagcaggtggtctgggctatctcttgtttccagaagtgactcaccttgcacgctggaccagtcacttcatatccacatgcctcgacttcgtcctctg

SEQ ID NO: 546586 - DNA, 664 bp, Homo sapiens
gacaccacgcgagagacgcacggcacgaccgcacaggaaaagcaaggacacacagcaacacgcagaacaagaccacacacaaagcaaccaccccctcactacccacacaacagcacaacccacacttacaaccccagcgcacaacagcaggcgcgggacggaggagacgacgatggcggacggaacgggccgcggaagagagacgaggcgagagggagcgagcgaggcgcgcgcgacgcggcgggcagagggcacaggacgcgggcgggacggggccgcgagctcgcagcagcgggcgcgcggcgcgagagagtagcaggcacgcgcgcggagggggggagcgagagagaccagagacgaagcgaggagggggacagcgagaagggcgaaggagggcgaagcggaagtgacaggagagaccacgcgcagagaggacgacgggagcgcgccacaggacgcgacagcgaggaccggcagcgggggcagcggggcggacggtaggggagcgagcgaaggcaacgcggagagacgccacacgcgtgggagcgagaggcagacacggcacgccaggacgcagacagctggcggcagcacggagacaacgagaggatcagggagaggcgccgcgggccagcccagccccatccagggcacgcagcactcg

SEQ ID NO: 546587 - DNA, 165 bp, Homo sapiens
cattggcagagggggtcgcatttgggcaggcacacaggtgtggctcataacactttgttactgcaagcacagcaccagcaggcattcttcgtgacattgcagcactttctcacaatcactcaccagtggaggcagctgccccatgaatgtggctgcaccttcatt

SEQ ID NO: 546588 - DNA, 247 bp, Homo sapiens
acacggacagggacagtagggaagatacgtgtcccagcgcagctaggtaaatggagaatgcattgggagattgatcacaaaagaggaacgggaacagcaatacagatggggatagtgaagagtgatgaggaacgaggaaaagtgatggacgaaacacctaagatcttcacatgaagaaatcataatctgcactaatttgggagacgtgaatgtatctgttatgggtaccagagctcgcaattctgta

SEQ ID NO: 546589 - DNA, 221 bp, Homo sapiens
ttcgcggccgcttttttttttttggctttaatctctacgacattatcttagtctgacatgcgatatatatcatactatacgacaatttacccaaaaccatgtgtaaacgtaacgagtacagatcaatgacttaaaacctaaagagtcatacgagtcaaacatctctagtgttgagcatatgtaattcattgtcaatcagtgactagtcacgcaaaactcta

SEQ ID NO: 546590 - DNA, 371 bp, Homo sapiens
tgaacaggaaggattcttgccaggttaccaggggctttggtgatagaagtgaagtggactaactacgtatccatgttgaatccacaggccaagatagtcaatggaggtgcaaatctaatgtcctctgcctttcgtgaggccaactcaggaagtgaaagggcgattcgtattcccgctgcgaatacttttgtggatgtgtgtgcacatgcagaggcaggtgtcagagcgccaccagccatcaatgccaggatgccctttaacttcttcttcccgttggaatgtcattgatctggtgcatcgggtcgtgagtagacacgtgaaatttgaaaactgtacgtgcggtgagagttaatttcatatgctgctggcga

SEQ ID NO: 546591 - DNA, 109 bp, Homo sapiens
  misc_feature (43)..(43): n is a, c, g, or t
acctcggcagtctcgggataaggtttttggaagagctgtcctngtgccacacctggaaggaggcctctggtttaagctgggctaggcctctgagactgcctcgccaaat

SEQ ID NO: 546592 - DNA, 239 bp, Homo sapiens
cacggctgagagacaggattttcgccatgtggccaggctgctccctaaagtctgacctcatgtgatccacctgccttagatctcacaaagtgctgggattacatggcgtgagccactgcgcccagccgatagtgggagactttaacaccccactgtcaatattagacatcaacgagacagaaaattaataaggatattcaggacttgaactcagctctggatgaagcagacctgttaga

SEQ ID NO: 546593 - DNA, 1179 bp, Homo sapiens
  misc_feature (422)..(422): n is a, c, g, or t
  misc_feature (1152)..(1152): n is a, c, g, or t
ctagttctagatcgcgagcggccgccctttttttttttgtggccccccatgctgttgatggctaattgtaacagtctgatcgtgacgctgaataaatgtctttttttaaatgtgctgtgtaaagttagtctacttctataacccactctgggttaaatttcccccaacacgtgtagacggttaagaatcgccttcagggttgattcgccagggttcatattggcgaattttatatacacccttgcttgtgggtggaagaacgccatgtgtcttcgaaacacctgtggtgtagtgagacctgatagtacactggtggtaacacctggaaatttccaccatattaaaagggggtattcaccccagagcaaaaatatctatgggcatatgggtgttctatcaacagatgtctgtatctgtgttgngcgcacactataccttaattgccaattctattatcgtcacatctgcgggattcaatggctgtccccgagtatacaatattctatatacgatggggcgacaagtgcaaagccgttttggtgtattactccccatttatctccagttgtgttgctcaatctccaaattacacgccgcgaaatgaagacattctccctctatgtgcaacaacaaacaacatcaacaacacaacgagggggggggcgacgccgcgtcacatcgataaaaaaagtataacacccactcaagaaagggggcgccccacaaaggtattatacacagcgcgatctaacccccgaaagtacatatctaagcgttgtggaccccacaaaacgagggtgggcgcccccccataaactaataagcgagacaagcccaacgaatacataacaacacaagaccgctcaaacgaagcaccacaatgtgacgccacccgctgcgaagttctaaatacaaacacgagagggtacaactgggatgaacacgtgtgggtacaacaacaacacacgagacgcaacactaccgatcggggagaacaaccatcgtgtggtgggacagaaaacgaagagaaccacccaagaaacacctacaccgttcgaggtatgaagtgagtgtaaacacacaacaaacaggcggaacaacaacacagcaaccgccaacagacagcagagagaaagattcaaaccgacagcngtgtcagcaggcgggcagaccacctaa

SEQ ID NO: 546594 - DNA, 103 bp, Homo sapiens
agagatgaggccaaaaagaaggtagagcagccagtcatcgaggagcagctctgaaaaggaagtataagcgttgaggaagtatatgcgttgacgaggtatccag

SEQ ID NO: 546595 - DNA, 113 bp, Homo sapiens
gccgagtagttacacactgaggggtctaaaatcctgtatcctattctatttagatcagtttttttttatgatttaattaaaaaaaaagaaaagttatctacccagccattctg

SEQ ID NO: 546596 - DNA, 371 bp, Homo sapiens
aggttttccaggcttcctgtgctgtcttggggacctgctcagaggctggaccgcgtcatgctcagaaggccctgttttctttagacgctgactcctgctgtctaccagatcctcgtggtacaatgactggtgtagactggcttgttgaagtcactctctggatctgagcaacgctggctgagccgtgatgaagtattcctatccatccactatgcttcacagtgggaatctctcactgttcatcaccgctgccctagcaccgcaggttcaagagctgctgggatatagcagttaagagatgaaccctgcagcctgacttcctttgctagaatcctggcactgttacttattccttgtatgtctctagggat

SEQ ID NO: 546597 - DNA, 462 bp, Homo sapiens
atcgggcgatcaatgtagatgtaggcgtagagactgctcgcgcactacactaagatgcccgcaatcgagcgggcaacataagccataaataccagtcagatttgaaggttctcacaggactgtcctaaggacgttaaataggagaacggctacaaaacagttagcaccagtttgcagtacttagaaatctatcagagtacagctagtacccttccgtactgagtcctctggtattacataaaaatcagatgagaaatcaatagcaaacataattcctcatcagatttcagataaaaacccaactccattccctgggttctctaaatcatgcacatctgtcctccacctgcttctgaagctccaacctcctccctcaccatattgcagccatagtagcctttctcatccaaattatgccaactttctatctcctcatgagatatttgcacctgccgtacccag

SEQ ID NO: 546598 - DNA, 410 bp, Homo sapiens
  misc_feature (399)..(399): n is a, c, g, or t
aggagtggagaagagaatctctgtggttgtttgtctatgagcacatgtcaccaattatgattttctgcaactattttcctaagaaaacggatccttacgaatggcagagacttttccagggagcaattcttttcaacatcttctgtcattcacagcctccagatttgttttgccactacaagaatccagttctcatttctccccaattatctccagggcttgtggccgttcctgccccatgttagaaaagcaaacccagggacagagccctccccccggcttacaaggcagttagtgctggatttgctgtatttgttcaatatttaagggttgttccagtttcacactcattcccctggcaccattcttttcccttctggattctggcccacacaggantaggaccagtg

SEQ ID NO: 546599 - DNA, 621 bp, Homo sapiens
  misc_feature (107)..(107): n is a, c, g, or t
  misc_feature (116)..(116): n is a, c, g, or t
  misc_feature (121)..(121): n is a, c, g, or t
gggagaactgctcgaggccaggagttcgagaccagcctggtcaacatagcgagacaccccccccatctcaaaaataaataaatcaaaataaaacaactaaaggaggnaggccgggnaaaanaaaacaaacaaaaaacacaaaacacaccaccaaacacaaaaacaacacaaaacaaaaaaaacaaacaacaaaatgtggcggcggcgcggccgcggcgccccccgagagaaagttttaggaacaccctccgcggtgtggcgggcgcggggcgccccacggtaataagggcacacaggtgcgcgacagcgcggtgttcccacgagaaaagcaaccacggcggcgtacaacgaagagcaggctggtcggggggctgtctctctaccccgctaaataaaaaagacagcgccccggcggggggacaaccaagccagcagcggcttttagagaaggacgaaacacacaccaggaaagagaggagtccgcttgggcaggcgacaccaacctcaacgggggggagccaacactcaaccagagagcgagggccactaccaagacgagaccgcggcacgtgaagtaaacaatagattagacgcgccgcgcccgcccgtgcgtgggcgaga

SEQ ID NO: 546600 - DNA, 815 bp, Homo sapiens
  misc_feature (37)..(37): n is a, c, g, or t
  misc_feature (62)..(62): n is a, c, g, or t
  misc_feature (497)..(498): n is a, c, g, or t
  misc_feature (672)..(672): n is a, c, g, or t
  misc_feature (703)..(703): n is a, c, g, or t
  misc_feature (709)..(710): n is a, c, g, or t
  misc_feature (726)..(726): n is a, c, g, or t
gtgaactgtttgtaactagcgcgcattgtgttggtanacgggatattcggccattatggccnggggacaatgttttttattcatggggtgcggtcgtagatgaacactactgcgttccaacggaccctgaccataaaactctacccatcatattgctggagctcgcatgcgaactttcgaataggatggactttcaagacttggggaacaaagtagaactgacaccaacccttttttccaccaggtgagagggttgagcaaaacaacctctccatttacaatacaatgcttttaaaggtggactcatttccacacaaattttaggaaacgatgcacatgaaactgccagtgtacatcactaaacgtacccttttccatgccgatccaatttggcctggataaggaaaacaaattctgacccttggaaagcttttagatgtacaatgattacaacatttatgtttaacacagtcgataattggctaaaaaactgtagnnggaaaacctctttgaaaaccttaatgggtgcctgaacaaatgaggaaggtagggccccttttctgacccatacccccttttttaaaaaaggggaataccaaaaaagggttgttaaaccgccaatagtacaaacctgcggtgcctgaaaacgttttcggcttaattccccccttnaacataaaaaaggcccccaaatccttcctgncaaaannttctaattaaaaaacnccccaaaaaaaaaccttttaatacggggaccccctttaaatgttcgttgaacaacttttacaaaaaaacttcccctcccctcccccttt

SEQ ID NO: 546601 - DNA, 502 bp, Homo sapiens
  misc_feature (53)..(54): n is a, c, g, or t
  misc_feature (64)..(64): n is a, c, g, or t
  misc_feature (66)..(66): n is a, c, g, or t
  misc_feature (69)..(69): n is a, c, g, or t
  misc_feature (71)..(71): n is a, c, g, or t
  misc_feature (73)..(73): n is a, c, g, or t
  misc_feature (82)..(82): n is a, c, g, or t
  misc_feature (84)..(85): n is a, c, g, or t
  misc_feature (87)..(87): n is a, c, g, or t
  misc_feature (98)..(98): n is a, c, g, or t
  misc_feature (118)..(118): n is a, c, g, or t
  misc_feature (135)..(135): n is a, c, g, or t
  misc_feature (147)..(148): n is a, c, g, or t
  misc_feature (416)..(416): n is a, c, g, or t
  misc_feature (431)..(431): n is a, c, g, or t
  misc_feature (433)..(433): n is a, c, g, or t
  misc_feature (435)..(435): n is a, c, g, or t
  misc_feature (440)..(440): n is a, c, g, or t
  misc_feature (444)..(444): n is a, c, g, or t
  misc_feature (455)..(455): n is a, c, g, or t
  misc_feature (460)..(460): n is a, c, g, or t
  misc_feature (466)..(466): n is a, c, g, or t
  misc_feature (469)..(469): n is a, c, g, or t
  misc_feature (499)..(499): n is a, c, g, or t
ctgctgacttatttgtagaagttgcatatctttagatttattgtaaaaactannggcatatgantngtntntntcatgtagncnnanagtaatctttnccttaatggatatccaattnttaaatggttcatattnttagctaaattnncaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttcctattacttaagaaatgcaaggaagcaggacttcttaattacttacttgaagaaatattagacaaagttcattcaattccagaaaaactcatggatgagactacttcagaatcagactatgaagaantcgggagtgcacttntngnctgtngatngttcgaagacncattngtaaanttncaagcagcaatagagaaaaaaattcatgcntct

SEQ ID NO: 546602 - DNA, 818 bp, Homo sapiens
ccgacaaagaggggccccctctaggaatttcgccgccaccgcgctcgcgcgcgaagcttgcaaagaagatctctcccgcggtattggggcggcgcgacacaccccccccgggtgggcgcaagaccccgcccaccccctcgtctctcgggcacgcacggacacagcaagccctatatagagcgccgctctccctccccgcggtgcccccaaacgcggagatctgtatcgctatcaagcatcgcgcgcgcgtggagatctgccccagaaatacatcgggggcgctcccacgcgcgggaacacgcaagttttggttccccccgctagagtgacacattaacacggcggcacacactatcgctcatttctttcaggagtggtcctccacacaatctcgacgcctaactcacagggtgtttttactccaaagacactcctctgacaggctttctgcggagactcacggagagacactattcccccccactgtgagtgggtcaccgccctctctgtaattacaacagagtgttctgtttgtgtgtggtcgcgcacggcagagtcccaacgtgtcctgacacacggatcttgaacgctctcaatactccgtagtttatactccacccctcctgtttttctctaattaagtccttcctaaatttccccacccccgtgaccactcacaagccatcccaaataagaatcatatcgccctcctttcctcctcaagccagcccctctccctccttcaacaaggacatctcctctcctacatcttggttttaaaccccaccaccccaccccaaacccgggctttcaccaca

SEQ ID NO: 546603 - DNA, 526 bp, Homo sapiens
  misc_feature (3)..(3): n is a, c, g, or t
  misc_feature (21)..(21): n is a, c, g, or t
tcnaccccctcctccgaatancccaataactgccataaacaaaaactgcattcaaaatttgagaatttaaaatagtcttgtttacaatcttgtgtgcccagaatttgggaaggactcagctgggcagctcatttctgcttctcatggaatgagctggtgtagctctacaggtctggagaattcacttcccaaggtggctcacttccacggtgcaggctgctgggtagggagccctgctggggctatcgtctggggcgttggttccttttcacgttggcctctcctatggcagccaggtgtctagagcaagtgttccaagcagacaggccagaaaccgtgtgtcctttttgacctatgatctataatatcagaagtctcaaaatatcacttgtactgcattctgttgttcaagcaaggcttacaaaactcagccaacactcagggagaggggaactaaactgtacttctcaatggcagatgcagcaaagactttgcagacatctttaatctatcacaaccgcaaaac

SEQ ID NO: 546604 - DNA, 103 bp, Homo sapiens
ccgaggtaggcagcagcagaacgctgaacgcaggggatacttcctattctacagcctagtaggctccttcccctactcatcgcactaatttacactcacaaca

SEQ ID NO: 546605 - DNA, 255 bp, Homo sapiens
  misc_feature (7)..(7): n is a, c, g, or t
  misc_feature (12)..(12): n is a, c, g, or t
  misc_feature (211)..(211): n is a, c, g, or t
gcaggtnctatnctcattggcaacatggcaaacagatcacaggagtcaaagggccttgctcaaggtcccagcttcagcccaggcctaagcagcgtcagaacagtcaatctgcatttttcatcagtcattctatagtgacatcatcccagactgccttctgtaatccctgtgtacagtctccctctgttctaaggttagaagtcagaggtgntgtgttctcaattccacagccaatgggggaagaggtaagctagg

SEQ ID NO: 546606 - DNA, 120 bp, Homo sapiens
cgctcctttcaaagcggagatctgcggaaggagaaacgctgacccgggtgatggaggttgtagtgagccaagactgcgccattgcaccccagcctgggcaacaagagtgaaactccatct

SEQ ID NO: 546607 - DNA, 124 bp, Homo sapiens
atagctgccagcttgagcgaatacggctcgcagggctgcgatagctgacccttgccatgaccgacctggagatcagatcgaagcctgaagaagacgtggctacctgaagaagaaccatgaggag

SEQ ID NO: 546608 - DNA, 860 bp, Homo sapiens
cagaggaaggaggagtgcagaggttcccaggaagaggccgggggcttgcagtgtacccccagacagtgtccctgtgaacgctctcatcaaaggttctgttccgttgcgcaaagaccaattttcttttcaaacatagcttgtgatggaaaccccgatttcggtgagcccctctgtgcaggctccgagactcgaccccaccatgccgagggctgacaggctctgccggtgtccatggactatgtgacacaaggcacacggctggacatataagaggtatcctgtctttatgtattaatagaaagaaatggtgtaggggagtgctagaaaaccaattttaggtcgctcctacaatgattcaccactgtgcaactttactagtagcaccaatatttgtcattcttaagaagaattaaatcaaaaggacctgtagaagtctaacgtgaaggctagggactcctgcgcgtgtcttcccttcaggcagcctgtctgtgcctccttctccggcagatgctgctgggttgggaagtcggctcctggcagccgtggcttctgtagagcgagcaccagctggacgttgtccatgaatatgtcacgagttctgggtgtttcctggtctgtagtcgcggaggtccctgccatcggtcagccgatctcacggatggcaacgaggagacaaattctgaggtagcctccctaggtagcctatgggcttttcctccgccctcttctgtaagcatgatggacaagtgccctggggatgttccggggccacgccaggtggcggggggccatgcttcacgaagcagttgcctgccggtttgcattccccactggggctgcttcttctccttggggttgtg

SEQ ID NO: 546609 - DNA, 924 bp, Homo sapiens
  misc_feature (40)..(40): n is a, c, g, or t
cacggcatggggctacggccaggacgacggcccctcgcantggcacaaggctgtatcccatggcccaggcagatcgccaatcacccatcaagtatcatctccagccaggctgtgtactctcccagcctgcaagccactggagctttcgcgtagtgaggccttgcagtgtcctctcagctatcaccaactaagtggcgcacttcatgatccatggtagaccttcgattgacagcgatgaccgaaccgtggtgactgggggcccccctgggaagggccactatcagtcctcaacgcaagttgtcatttccagctggggacaagcaagcacgatgtgggttctgtagcagcagcggctggacggcaagtccttccccagcgagctgcatctggtgtcactgggaagtgccaagaagtacagcactatgggggaggcggcctcaggcagctgatggcctggctggggttggtgtaggattggcacgacaggagacgatgcagcctagtcagtgaatcgtctgactagatgcgcgtctacatggtccggttcaagggcaccaaagccccagttcaggctgcttcaaccccaagtgcctcctgcctgccagccggacactgactggatcctaccgcgggctctctgacgagtcccccactcagtgagagtgtcacctggattgtgctccgggagcccatctggatctctgaaagtgcagatgggggaccgtgccggagcctgctttttacctcggaggacgatgatcaggatccacattggtgaacaagttccggtcaccacagccactgaagggccgcgttggtaaaggcctccttccgggcctgagctgccatctggctagccggcactaggcaccatcttctcaagggcttcaatgtcagcagaaacaaaccatctgagggttctcc

SEQ ID NO: 546610 - DNA, 271 bp, Homo sapiens
acaaggtatgttacctaattagtctttacgtatacctcccattcttaatggctaatttgtcaagcccagggaatctttcctttactttgacttcccgagtttgttcattcataccattgacacattaaacttattctggcattcttgaaatcttccttcgaatttcccatcacaaaacccgaacgttattcttgccactggtcattattcctccaagcatacccgatacccatccatccaaaaggcatttgtatgcattaagtttcgtgcc

SEQ ID NO: 546611 - DNA, 135 bp, Homo sapiens
gggctgactgcgaccgtaaggtagcgtactgtctccctcttactactcgctcaactggaggtgtattcctttgtgtggaatgctgtctcccacatacccacaggactctcttcctccctccacgtctttctcaga

SEQ ID NO: 546612 - DNA, 974 bp, Homo sapiens
gcctgagctgagtgccggtgcagctgctggaccctgctgcagtgagtgagtgctggcgtgggacacctggctgagatccccagcagtgtgcccctgtggctccctgtgaagtgtctccagccacctgcccttcccgagaagagagagctctgggccttcttcctgccagtctggtcttcgatgtgcgttcaggacagatagaccttggcacaggctgacccgagattcctgcgacgctgatctgttccatgccttctgtggagcatggaacccacagagcttccaggacggatcatagacaccgagccatccaggagggcgcccatgtgcgggtcactgcgacggtccctctcagctaccccatgccagccagacctctgaggccggatccgtgtaccggaaatgccctcgggcaaactggatgaggccatcccagagcgggatccataagtgtgccacgcgcaccaagcctcacacctgaagcacccccagtagcccttccgcattgtcacggcttgccaaggcaagaatgtccactggctgtagcccacagatccacagtgcaacagacccgggatgcgagaaacaccgggggcggaccaaccaaccaacccacccacgcagaacacacaccgataacccgccccggcaccccacagcacaagccagaagcagccccccccgaccagcccacccacacccgaaatgcccagccaaggatgaagaaacacactgcacagacagagacggaaaaaaggcaccggcaacgcgcccaggagccaacacatgaggcacagaaagaaaacaacgaagcaaagggaagaacaaacgaaaacaaaaaaaaaaacaaaaaaagaacacgacgaagcccacaaccaaccggataaaataagaaagaaaaacaacacaaaaaaaaaacaaacaaaagacagaacacaaacaaacaaaacgcactaaaaaaaaccacagaaagc

SEQ ID NO: 546613 - DNA, 128 bp, Homo sapiens
acatcaggcatgtttccattgtgtctgtcatgccatcgcgggtcatcctgcagtcaacgtcgcgggccattccggcatcaggccgcagcaacagtgtatgtgggcacaggcacagttcagcatttcac

SEQ ID NO: 546614 - DNA, 931 bp, Homo sapiens
atgatcacgggtcgcgaacaggaaggcatctccagcagggtgtcggtgcctgcaaagcctgaatggaggaacttctcttcccaccgttctaaacaagtctaaagctaagaaatcctggagtggtagaaggcgtatatctgcaatgctcaaggatagtccgtagacaaaaacaccacatttaactacatctacagtataccactagaaacatgaactacttatcctagatagtcgtacccgagtaacttcgtaacgttctctaagaagtaaaagcctagccagaagatgactccagggaacataagtagagaccccctagaaatacgttcacccacccattaaaaaggaagaggaagacaaataaagggagatatctgtcgaaaaagatatcataggattgataacctcttaaagtgaatgtcatcagctcttgtaagtacagcattgttatgcatgtattgcttagtaactacttggtccaattgggcattcaccgatgtaaaatgatttacatggtagttgaaagacaaagatgcactgaattatgccccaggaaagtagcactggagaaagaagtacccatgaggtacaccgtttctgtaaccaacatcttcatgaaaaaacaatatatcggtataaaacgaaggatcagggacctagcgagcagtatgccccaggcatgtacctccaagacgctcatggcgcatcaagatgttccttccaagtccatcaagcagtccattaagtaggcaggaggttgtgtacaacagtggtggtgccaattggctcctcaagtccttgtctacagaattgtggaaacggacttaaattctggacactttacactttctacaagacaaggaaacgctatgcatggatcctgatgaacccagtcattatcacttagtttgtaaagaaataaggcaagcaa

SEQ ID NO: 546615 - DNA, 83 bp, Homo sapiens
ttttgtatgtgtataataatttgagatgtttttaattattttgaatgctggaataaagcatgtggaaatgacccaaaaaaaaa

SEQ ID NO: 546616 - DNA, 1286 bp, Homo sapiens
  misc_feature (292)..(292): n is a, c, g, or t
  misc_feature (1002)..(1002): n is a, c, g, or t
agcgggctggtgaaactgcacagctgggcgccgccgccgatcttgtgattgcgctggatcacacatccgactgcgcgcatgcgtaacatccttatcggggtgcatataggctgaaggagaatggggtgcttccgaatgtgacaagctctggactcagtctacggggacttgcgcactctcgctctctcacacgagatcgagtctgctgtgtcgttgttacaagattgctgtttaccagtaaagcacattgtaaaatggacctagtatttggatcgagtagttagccttgagnctcttagtcgttcgagaacagctggatgaagggaactaggcggacagtgagacaagagcatggagagtggaaggaaggacttctcaactcctaaagatgaatcctgtagaatggcaaggcagttaataaggagtctgggtaatgagttgaataatacgaaccgacgaggcgacgggttaatagaaaccatggatgggtcgaaccatgactggcgtatcacgttggcgcgtcagcatcactcgtacactttccgaagccacgttctcacgtgataggccacaaggcctgggcatgttgcaagtgcgctgcgagtcttcattaggctctactgggatatagccctttcgtggctcgtacgcgcgagcgcgtgttcgaaagctcgaatcgtctacactgaccctgtctagagcgttgccacacgtgaggttagggccttcgtgtaagctaaacaggaaagctggggcgttccacacatagcgtggcttgagaagcatttttgtggggtatagcgccaaaacctttaaaggttggttgcaaacacaaaggagagggataagtgggacattaataacaggacataaattgtgtgggttgatcacttagtagcatgcgaacttggggaaggataacttagctttccccggaacgagtaagagactagaaggaaaggggaaggaattccacaagttccagtttttgtggctaaaacncaagtgccacttcgcaacacgttggcggagactcatttggggaaacgggggttccattgttaaacccgttttcaaaggcgttacaggcagcacattgaaaatgccccccacagggccacccacacgcacaagggaagccaaacgtgtgcgaggcgcacccaattgtgttttcttacaacgcttctgaaactttttggtgacacgtgacaccatttgatacagaacagtgtttccgcgaccccaattcggacttttcgcgcgccctccatgtcgcgaattattac

SEQ ID NO: 546617 - DNA, 446 bp, Homo sapiens
aatgtttgataagaccatgtctgaaaattttaaaatatctctaaccaggatacaatttctgctgtttcctgaatgacatgatattcagcaataacatggttcagagagaaggaaggaagtgtgggtagttaaggtgatctaaaagttttaagaaaacctagaaatttatatttgtgatttggaaattatggcatgcaaacgcctgctcctatgacatgtaattctcctgttcttgcttcaatattctttcttccctgcttcacctaaagaccgaagcatcatctgttacgttgactctcctccttctagtctgtggccacgacaccacaagcacaatctaacatatcgtccattccagccccacgtctcccccactacttctatgactcttccacgacaactaaccacctcgtctttcgttttctccaacatcacagcaacaaaac

SEQ ID NO: 546618 - DNA, 424 bp, Homo sapiens
  misc_feature (273)..(273): n is a, c, g, or t
  misc_feature (275)..(275): n is a, c, g, or t
  misc_feature (339)..(340): n is a, c, g, or t
  misc_feature (412)..(412): n is a, c, g, or t
ttctgaagctggtgcctataattagatctcatgagtttgggtcaagacaggacttagtgtgaagaatttgatcatattcgttgaagactaggtcacgaaacacttgggtcaagacgttgttctcaagcgacagggcagtcgtctacttagagatacatgagcacagggtctgcgagatccccattcaatgaatctgttgtatttgcacacacacaaaggctgtttccaggtatccaatccattgccaatcacaacagtttgcaccaaggcgtnancaagtttgtcagttgccaaattgctggccagcatgcagccttgctaacttgcttaccaaagctnngccactgaaagcgagggacgaggtcccttacagaccactcactcgaaaatgccacgagtcgatgcttcgatncctgcctccaga

SEQ ID NO: 546619 - DNA, 591 bp, Homo sapiens
ctactctgggcattataccctgagatcgcctggaaacaggtagttggggcaagattcaggttctattctggtactactacattattggccaaatacatccttaaccatattgatctcatcctttaataggtcccctcttcccagttctcaaacatgtgaccctgaacaaatgaggtacttgacctaagtgtcaatttcttcatctggcaaaatgggaccagtaatgcagtcttcatacacttgatgtgaaggttaaatgacttaatatatgcaaaatagtgagcacagtgcctggctattatagcaggtgctcagtaaatggttgctattatttttatagctaagcagtatagtgtagtggctaagagcatggctttcggagttaaacggctctctctggccttggatccagactctgagcttagcacctgtttgaccaagggaaattagctctctaagcttcaatttcctcaataataataataataaaggaatagtaatagtacctctcttagggttgctgagaagattaaatgagattctatatgtcaagtacttaacacagaaacacagagtttgcacagaatcgtg

SEQ ID NO: 546620 - DNA, 356 bp, Homo sapiens
tcctggtatttcgccaattggcaaaagggggatttttttcaaggcgatttaatttgggaaccccagggtttttccaattccggcttttttaaaaggcggccattttattgttattcgcctcctttttgggggaatttggttccgggcccccccccaagtttttttttttttttttttttttttttttttttgttgtttttggtttttttttttttttttttttttttttttttttttttttttttttttttttttttttttttttaggctatttatttatttatagaagatggtatttctctcgtgtcgcacagtctagagtgctatggtattatcgtggttctctctcgtgccgt

SEQ ID NO: 546621 - DNA, 383 bp, Homo sapiens
  misc_feature (1)..(1): n is a, c, g, or t
nctggtctaatatcaggcaatcttaatcagtctcaaaatgtcgtgctcctactggtatgccacaagcactagtgatgcagttccaacagctggatcatctcactcttggttagcatgtgcactgcacagcgtcagttactgttcacctctcgaagtgatccaccattatgtgtcactgttcgaacagcctagtatccagtgcatatcctaatctcctcagtcccccggttctatcagacccacatgtcattagttccgccatgataggctccttatgaatcctaataccccctaatggttgactctctgtgtacattcgccctttcagagtcctggctccctgattttctgaaaacatatttcagctcatgacttgacgttct

SEQ ID NO: 546622 - DNA, 225 bp, Homo sapiens
agaggatccccggtatgacgagcagcacgctctcttaataggtggctgctttcaggcctactatgggtgttaaatcttttactctctctacaaggtttttctcctagatgtccaacagcgctgttcctcttaggactaacagcttaaatttacaaggaggatttacgagggttctagtgggcaaactttaacagttgaactacagattctatctatggacaacca

SEQ ID NO: 546623 - DNA, 387 bp, Homo sapiens
cctcgttgtgagcatgtctgtatcttcactgtatcattgtcaatatccggttatgagactacatggtagttttgcaagatgttgccattgggggaggctgggtgaagggtacacaagatccctctgtatcattacttacaattgtgttgagtttgcaatgatctcaaaatagaaagcataatttaaaaacaaagtacaaacaaaactgcaggtttttttaggtgtttttgtttttgtttttgctttgcttttgagacagagcctccctcggtcacccaggctagagtgcagtggtgcgatcttggctcactgcaacctctgcctcctgggttcaagcgattcttatacctcagcctccagagtagctgggattacaggtgcccacca

SEQ ID NO: 546624 - DNA, 137 bp, Homo sapiens
atcactcgattaacaagagtgttttattgtacttttagtacgcaccaatctcaaggagccttggaggcttgtgaaaaagacgtccacaaagatgctgcatttctagatgtggggtgaattttgttagcgcgtgctgt

SEQ ID NO: 546625 - DNA, 706 bp, Homo sapiens
gatcctgactagaccctatcgctctctgagttatagcgagattcctctcagatatgtgagtacagggctatacgacaacgctatcggactcgcgcgcataacagagacgagaagcggagtagctagacattctcagatacattctaggcgcagagtcatcatcccttattgatagtattaaccatagcatgagctggtgaataatctaatgtaagtgactcgaattgtaggacgacatccttatgacgagggcctgactggatataccgaagtatggtacacacccgtacatacgtacgctgctcatatcagtcggtagaaagtctgtgtcatactggatgtcctcaacaggatagcccgcatgtatacagacattccacgcatatgttgatagagttaacccccttgtgtgaaggatcgcattagcaataagtgggaggaacaacacattgctactcaggtacagatgcctatgtgggaggagagacatacaacaccactgtgcattcgtaatggaaggaagcctaggaacgaaagaagtgagtcgcacacacacactaatgaagagtacaggaagggtcggacccaaagacgattgaaacagtggggcacatgtacgtcgaacacaaggtggattacaaaccgatcatctaagcaattgccaacgataaatgcataatacaagaaaaactacaatcacaatttc

SEQ ID NO: 546626 - DNA, 148 bp, Homo sapiens
tacaaggcccgcgggagactggtcttcactctcaatgtagcctcctctggaacctcatcctgtcacctgctgcagcgtctctgggtgggcctgctggctggctgtgcctgggcagtgtggcctgctgcatggactgtgctctgctgag

SEQ ID NO: 546627 - DNA, 137 bp, Homo sapiens
ggtactctagaggatctctggtgtctgggggcggcccgtggctaggaccaatcagagaggagagcctttcccaggccaagatgggccccggagttctgtcctctgggcaagggattcagaaatgacccctctgggtg

SEQ ID NO: 546628 - DNA, 777 bp, Homo sapiens
ccagcgctgggcaacatagtcgagacctcatctccaaaaaagaaaacaaaaagacaaaaaaaggaaaagaaaaaaaaaaaaaaaaaatgaaagaaaaatttggaagccgacgccgacgcctcaaagaaaagtcagtaaacaataaacttcagcgtggaggagcgccgcgggcccattagagaggtaaggatacagctggggactgagactactttccgctgaggaagaaccctggagacaaaaatacaggagtgggagtactctgcagcatcatagaagaaacaccgcggcgtgctaacacagggggcgtatggaaataatcagcagaagaggtactgacagagcacaaagatgggggtctactataatagaacgctcactaacagcgaagtgcaacagcttcacaaatatgcacacccacggttggcccgggtggcatatactggtgggcctgaaaataattttgagaaaaaacaggttacctttgtttattcaagacttttcactaactatctaatgcctgacgtattttcaccaggtatctttcccaatgttacttcagcttttttcgtattttcaaataaaggtcagaccttttatacttttgaccaaatagttatttcctatgttggacacttagtttattgccaaagcctccgattgtgatgcaggttgtaagtccttgtaaacaatatatacagactatacaagaatcaattttatggggcctttcaaaaccatatttgcattccaaaaaccaaatcttaatgcagaaca

SEQ ID NO: 546629 - DNA, 242 bp, Homo sapiens
aacgtctgctgtcaccctcagcgtaacagttttaatcctgagtcagccaaaaaaaaaaaaacccagacaaaacaaaaaaaacaaataaagccatgccaatctcatctggttttctgcgccaatttaggtttggtcaaaaagggttgtaccgcacctaattcatattccgcctaaaacctttggcggtgaacaatggaggggccgaactcgtcatactcctgcttgctgacccacattttgtg

SEQ ID NO: 546630 - DNA, 138 bp, Homo sapiens
  misc_feature (60)..(60): n is a, c, g, or t
acgcgagaagattaattaggaacaagcttagcaggagatgagtgcagagaagtgacaggnaagctacaggttacaacagatttgtgaactcagccaagcacatgtggtggcagggcatagctgctactcgtgtgatgg

SEQ ID NO: 546631 - DNA, 328 bp, Homo sapiens
  misc_feature (12)..(12): n is a, c, g, or t
  misc_feature (17)..(17): n is a, c, g, or t
  misc_feature (49)..(49): n is a, c, g, or t
  misc_feature (202)..(202): n is a, c, g, or t
catatattcacncaaancctgtatatgaatgctaataaaagtcaattgnccaggtgtggtggctcatgcctgtaatcccagcactttgggaggctgaggcagtggatcacctgaggtcaggagtttgagaccagcctggccaacgtggtgaaaactcgtctctactaaaaatacagcaattagctgggtgtaatagtagccncctgtaatcccagctactggggaggctgaagcagaagaacctcttgaacccgggaggcagaggttgcagtgagctgagatcgtaccactgcactccagcctgggcgatagagtgagactctgtctc

SEQ ID NO: 546632 - DNA, 431 bp, Homo sapiens
cctgtatgcttgtggacgatctctagcaggatcccccgttactggcatttccattccttatacgtttagaatcagaatacaagttgtatttcaaagtatctcagccatgtcacactcatcccttgtttactaaactcgcatttggaaaccactaaagtaggtaagttccatgccatgttaactatttgaattgccttgcgtttatcacttattttgaaatctattgggttgatttctccctatatttatttttgtacatttgagccatgtcacacatactgattatgacaggtcagccgtattctatttggttagaagggttacatggtgtacatattagtgcagtttagctatagcagtgtttgctccagcttcatattggctaggtagggtcacctatggaagcacttgctcataatctgtgacctgtc

SEQ ID NO: 546633 - DNA, 406 bp, Homo sapiens
ttgataaccaggtctcggctcctcgatctgctcagtcctatacggcgcacgtggcagggctggaggtgtgcgctcgccgtcgccgccgtgcgctgagctgcagcaattccaccaggtcgctgttgtctccccttggccacagagctttcagtttgacgaggacgacggtgacggggaggatgaggaagacgtggatgatgaggaagacgtggattaagatgcccatgattcagaggccaaagtggcgagcctgagaggaatggagttacaggggtgcgccagcactcaggttgaatcagaaattaccaagaagtacagaaacaggtgcgcttaccagaaaggcggctgacaccatgtgaggtgtggtttattggcaaagaaaaagaagaacgtgaccggctgcaac

SEQ ID NO: 546634 - DNA, 225 bp, Homo sapiens
tgataaacagtgcacagaaggattgtctgagaacagtgcctatcgctggaccgttgtgaacacagaggagggaaggcaagctctggagccgctccctcgggtcatccaggagtctctgaacgactcttcccctgggggatccagcaggacgttgttaatgatggaacctgaatgattctacagaggcaaaacagtggcatttcttctgagctaaggagacataag

SEQ ID NO: 546635 - DNA, 642 bp, Homo sapiens
  misc_feature (257)..(257): n is a, c, g, or t
gcgttaacctgcggggatcaaccgatccagttccggcagcagcgaatatttgccgccagcccatttaaggaacgggcgttgccagctgcgcagcgccggttcttctatgggcatcgccgcagctccactgcaaacagatccgtatctcatgctgcctcctgcctttcccgatattcctcagcgagccgctgcgcctttaatggattgctgaccacttcaccccatggtattagccagcagttaccaatgaaggggangcacagtgtgcctacgctgatgtcgtcgtgagcgtgagtcataggatggactccatttcgtcgatatagaggccctgagcaatcaggcggcgacggcgtgctgcacgttcaatgcactcctgccgcctgccttcctgcgactgctctatggcgcgccgggtgaacagccgagatttaccctgcggcgtaatgacctttggcttcgtaaccaggtcgaatgtccggtcgcagatgccgtcctcgttgatccatttttccgactcaacgatctgcgctatctgtccggtgccgcgggtgatgccgttggcgacccggttaaactcaatgagcgatacgccaaacttctcggcgatttcgctgccagtgaccgggcggccgcaagctt

SEQ ID NO: 546636 - DNA, 131 bp, Homo sapiens
aaaaaaaaaaatatagctggtccggaattctatacattgacctcttgtttggttataacacatagcagtacaacgacgtgtcacacaatgacgctggtttgcatgggaaactagatgggacgaagactgcg

SEQ ID NO: 546637 - DNA, 170 bp, Homo sapiens
gaagcaggatggtctaccttctgctgacctgcaaaggatgaatacacatcatttgacaagcctatatgaaagttattcgttggacgtgcgcttgttcatgttattgcagctaagataaaaagttcaagtaccagcaaataaaataaaaataaaaaatgcgtcgtatcgat

SEQ ID NO: 546638 - DNA, 377 bp, Homo sapiens
ttttccccatgccgctctcatgacagtgagtgatttctcacgagatctgatggtttcataagtgtttgatagttcctcctgcatatattctccttcctgctgccttgtgaagaaagtgccttgcttcccctttgccttactgaggcctccccagccatactgaactgtgagtcaattaaacccttttcctttgtaaattacccagtcatgggcagttctttacagctgtgtgaaaatgaactaatacatgtgagaaagcatggattactctatcctcactcaggagaaaatgttagagattgtgaggtggtttctaatagtttgcacgtcgtgtgtccactagctccccttttcatgcacacactactccctccccc

SEQ ID NO: 546639 - DNA, 379 bp, Homo sapiens
attaagttctctagttatagctagtaacattgcaagcagagccataacattgtacagagtgtagcatttgtgattaaccctagcctgtaaaatccagaaaccttcaaccattacttctgtgaatactttagccctgggataagggtattttctgttccggtgtagtgtctgtagccggacatggacacaccatatctagctgctggcccaagggaacgtacattaataatactatccaaataaagtattatgtgctagtacagtgtatagtcaaagcacttctctttttcattactaaaaagtctggcataagatttgcattattaattacctctctatgaactataatactccttattccttactacaacaggtatag

SEQ ID NO: 546640 - DNA, 201 bp, Homo sapiens
gcatagtaaccaatgcgcgcgttctcagaccattttacggtgccgctgtccggttgcagatcgcccaccagcgttttcagcagcgttgatttaccgacgccgttggtacccagtaccgccagtttttcacccacttccagcagcaggttgagatttttaaacagcggaccgttatcaaaccctttggtcagaccttccact

SEQ ID NO: 546641 - DNA, 537 bp, Homo sapiens
cgacctagaggatccccgagatacgtaggtgtggggcatggagtaaacgttgagtagctaggaatagcgtccactagttacgtgataatactaaactatgtccaattaagaatggttatgtgatggttgtacggtaaaactgcgataattcatcctatgtggttaatggaggattatgctaagatcttgcgtacctgggtttggtttaatccagctcaactgcctgctatgatggatacgattgagagagtgaggagaaggcttacgcttagtgagggccgagatccggcatatgattcgagatgggggctagttgtcgccatgtgataagaagcaggccggatgtcagaggggtgcctagggtaacctctgggactcagaagtgaaagggggctattcctagtcctatggctatagccattatgattattaatgatgagtattgattggtagtattggttatggtgcattgtccggagagtataattgttgaagaggatagctatcagaaggattatggatgcggttgctagcgtg

SEQ ID NO: 546642 - DNA, 952 bp, Homo sapiens
  misc_feature (154)..(154): n is a, c, g, or t
  misc_feature (160)..(160): n is a, c, g, or t
  misc_feature (169)..(169): n is a, c, g, or t
  misc_feature (171)..(171): n is a, c, g, or t
  misc_feature (174)..(174): n is a, c, g, or t
  misc_feature (193)..(193): n is a, c, g, or t
  misc_feature (211)..(211): n is a, c, g, or t
gagtgcgagatccgctgctggtgaggagaggagcgtcaacagcagcaccatggtagctcaacagaagaaccttgaaggctatgtgggatttgccaatctcccaaatcaagtatacagaaaatcggtgaagagaggttttgaattcacgcttatngtagtnggtaatctngnttnggaaagtcgcattaatcanctcattattcctcacagnatttgtattctgccagagtatccaggtccttctcatagaattaagaaagactgtacaggtggaacaatccaaagttttcatcaaagaaggtggtgtccagttgctgctcacaagtagttgcataccccaggatttggagatgcagtggatcatagtaatggctggcagcctgttaatcagactaccttgatacgttaaactttgaggagctacctaagatgcagaaatcacgagtgagacatgacgtcagatgcctgataaaaagaggggcgagtgtagtgaataccttcattcggctccttcaggacatggccttagaccatgtggatattgagcttatgaagcgtctgcatgaagaacgtgattatcatcccacttatgccaaaagtagacacactcacaccaatgaggaatgcctacaggttatgacagcagatatgcaagcaagtcaagaacgtaaaggtagatgttcgaatttcagagaacgatgcgtagcacaactacgtgctaacagaataggaccggtacacctgcgggcaggcgaaaccatgcactgaagttccgggaccggcccagacgcaatcctggggtgcgcactggcagggcaacggagccacacaacagtgtgaaacagcgggaaggccatccacgaaacacaacactggtatgaggtaaagaggaacccgaaaaaaaggccgaacgcgcagactgctttcgtagcctctctcttctccttcctcg

SEQ ID NO: 546643 - DNA, 214 bp, Homo sapiens
agtggtgttggtggtgatgcaaaaacggttgtgttagatatgaattctaaatttctcttcaaagaatcaatatgtcagtatggtcaatctttgccttttacttttaaacttaacttcctcgtaaagcaacctttttccatcacctgctccaccctgactcatttcaatcacctgctccaccctgactcattccgatttccatcaccaccaacac

SEQ ID NO: 546644 - DNA, 361 bp, Homo sapiens
attgatatgcggatgagggtggtctatgatattgccccaccaccgaagtgttacaatatacttgtgagatcggacacacacacacaaataatgatcaatcaaaaattgtgaatgctaaggatcaagaagcaatttataccttgagggttgggggagggaggggtaggagagggatggagtgatcagagaaggctcaatgaaggaggtgacgctgaggaagttctccaagccttgagaggacttgggtaaggggagacggccttccaggttgggagagcagcttggaacattggcaagaaggtggccatgtgaaagggcattgttacagacaacagatggaccctcatcctgttattcaatg

SEQ ID NO: 546645 - DNA, 1012 bp, Homo sapiens
ggatctttgtgctgcggcgtcttcaatgagccagtggccatggtgcgagctcttcctcagatatcaacctcctgctggcccagcgctggggctggggtatgctgtcatattatgtcagcctggacagtctctcgctgaatgatgaatgtcgctagactcgtgtctgcacccgtggtgttaactagtcttcgttgcatacctacacgacgagtattggcttaccgatggggccctacaccctaagactggagaatcatgtagctaggcactatcagagtggttgctaggggctagcccttcctgtctgagagaaccccgaggcgggtatcctgtcccgctcctttgaccttggaccgccagattactgttccactggacagtgaactggtcgctaactcccagaggcgctcttcctgcatcgagccgttccaccatggaacctgtatgactgacacacctcggccctgctcctgctgttggccctctgaaggtggcacaggacaggggaacagtatctagtgcgcatgctgagggatcccgtccaaaaggaaggttccagcccagacccgttagagccaagcagatcgtgatctacccatcttcaactgcaacttcatgggcatctgcattcagccgatcccctccagtaaccagttctacgtctggtatttccacaacacgtgcccgtaactcctgtgggccatgcctgcaacgctggctcacagacctgctcaaggtagataggtgctgggggctcaatcgaagctctccctggacacacattaccctatccaaattctgcagttctggtggccttgaccattatgccaatgccgtcatcactgcttgacagcttctgggcttgaggaccgggagacttttaccaccaagaagagaccaaacacagccaagaaaagcgcactgaaagttcaacccattttccctaagggaacctgaatataaccctacaaggacctgggagttgagatggacatcttgcacttcaaagaag

SEQ ID NO: 546646 - DNA, 289 bp, Homo sapiens
cacgaggttaaagattatttcactgcaaaagcaaacacgtgccgatcatgggaccaggttcaggggatttgttgctaacggggactacaatggccacgtcgatctgggtgtctagtgttccaaggctgtgcccaccggcatccgtggggacatcatccttcctatgctctcatcaccgtgcgcagaggctactgggggacaactatcagaaactcccacactgtcccttgcacagtgacatgccgctgccgctctgtgctgttacccctcatcccaggacccaccggca

SEQ ID NO: 546647 - DNA, 943 bp, Homo sapiens
  misc_feature (484)..(484): n is a, c, g, or t
atcaaaggcaagggaaacctgtacagtggagacacaaagggtcactggcagatttcaaatgatccaagacatcctcaaactttttcatatctgttgggtctataatgatggtcaccccaaccacagcttcatttctgatattggacattgagatctgctggttggagatcttagtgcccaaggaagaatgcttgcaaaaggagatggaacagtgtttctgttgcattggccactgagaatatctggttattttgaatttgtcacagtctgcagctaaaaggcgaacaggaaaagaagagagagcggtaatttgaatgatagcagatttcacatcaggaaccaatgaagctagataagaatgcaacatctttgatgtctaaaagaaacaaaaagccaaccttgaattctttatttagtgaagttacccttcagaaatgacggcaaaataaagatgttttccaataaaagacaactatgagaattnttcaccagcagtcctatggtatcagaacagccaaaagaagttggtcagcctacagggaattatatcaaagggaagacttgaccttgaaaatgaatgaggaatataagaaattgatattatctgggtaaaaagaaaataaattttttattctatcatctttaaaaatgtatgactatttaaaacaaaaattataatatggcagtgtgaatttcaatgtatataaatgccatattgtaagactactttaacataaaaaacatcagtaaatggaacagaactataagaaacttatatagatgcaagtatctaaggttttacaagaagcaatgtgaatattaactctaagtgaactatgaagaatcctattttttgtaactacaggaccatattgattaaagtgggtagggcaaaaaagtggactctcaaatgttataatcccataaggggaaggggggaaaa

SEQ ID NO: 546648 - DNA, 218 bp, Homo sapiens
  misc_feature (40)..(40): n is a, c, g, or t
atgaacttgcatagttgaacgacagctgccaactggcggngttgcgcacgaagttgaggtacaggttcaggctgctggcgtcttcggtgaaggttgccgccaggttgggcgtgcgcccgcccagcgagcgcgcatagaagatgcccggggtcacctgccaaccgggcagcagggtgccgtcgtaggtcaagctgaagtccaggttgatccccgaagaa

SEQ ID NO: 546649 - DNA, 882 bp, Homo sapiens
  misc_feature (423)..(423): n is a, c, g, or t
atcaaaggcaagggaaacctgtacagtggagacacaaagggtcactggcagatttcaaatgatccaagacatcctcaaattggacattgagatctgctggttggagatcttagtgcccaaggaagaatgcttgcaaaaggagatggaacagtgtttctgttgcattggccactgagaatatctggttattttgaatttgtcacagtctgcagctaaaaggcgaacaggaaaagaagagagagcggtaatttgaatgatagcagatttcacatcaggaaccaatgaagctagataagaatgcaacatctttgatgtctaaaagaaacaaaaagccaaccttgaattctttatttagtgaagttacccttcagaaatgacggcaaaataaagatgttttccaataaaagacaactatgagaattnttcaccagcagtcctatggtatcagaacagccaaaagaagttggtcagcctacagggaattatatcaaagggaagacttgaccttgaaaatgaatgaggaatataagaaattgatattatctgggtaaaaagaaaataaattttttattctatcatctttaaaaatgtatgactatttaaaacaaaaattataatatggcagtgtgaatttcaatgtatataaatgccatattgtaagactactttaacataaaaaacatcagtaaatggaacagaactataagaaacttatatagatgcaagtatctaaggttttacaagaagcaatgtgaatattaactctaagtgaactatgaagaatcctattttttgtaactacaggaccatattgattaaagtgggtagggcaaaaaagtggactctcaaatgttataatcccataaggggaaggggggaaaa

SEQ ID NO: 546650 - DNA, 720 bp, Homo sapiens
tttgtagagtgatggaggacatttgttagcagttcgttgggcttgttggtttatgccagggtctagggttgatgcacaggccctctagagccccttatgtccttctagtcttacaccttgccctgcctgggctttcggtgcagactaggtgtgcgatttgagctctgtgactctatagtctactgcctggctctctatgattgctctgcggtgctgagtgctggactcaaggacatcatctaggcaggtgggagagcctgggctgaacagctgtgacctaactcccttatgccccacctctgccccctccacttcctgccctctgttccatcttcccccttcccaaaggccacagcctttattccaggtccagggatgtatggatgggggaaggaggaaacaggaagcccagagagggcaaagggcctacctcggggcgcgaaccatgccccagactattatctgagggctcttctgggcacgtgcacttcagcgtggcaccacctgcccatgccctgaggccagttggcgacgggagtggctccatagatgggttatttatacccttcgtttgctaatgtataattttgcatcataagtttctacattgtacccgagtgtcagaactataattcattccatttctctctgtgtctgtgccaagaaacgcaggcatctgggcctgccccttgcccaggaggcataacaccggggctagtt

SEQ ID NO: 546651 - DNA, 156 bp, Homo sapiens
aagtctaccaagaactctcccaccgagaaagcttgtatacagcaagcagcctcctttcaaggggactggatagtcaaaaatcaaaagctcgtcctcccctaagagcagaccaaagaaattctgacatctcttcaccaatccttccatatcagtgtg

SEQ ID NO: 546652 - DNA, 110 bp, Homo sapiens
ccaatgctcaacccatcaagttaaggctgaggaacaaggagggtattggcggccttacacgagttagttaaggaatttgctctgttgaaatgttggaacaatttcttccc

SEQ ID NO: 546653 - DNA, 975 bp, Homo sapiens
  misc_feature (516)..(516): n is a, c, g, or t
atcaaaggcaagggaaacctgtacagtggagacacaaagggtcactggcagatttcaaatgatccaagacatcctcaaaatccttccaaaccacaaggaaaatcaccaggccaaaagtgaggtttgaagtctggacatgtactggttttctctagcaatcgactcgcaatttttggacattgagatctgctggttggagatcttagtgcccaaggaagaatgcttgcaaaaggagatggaacagtgtttctgttgcattggccactgagaatatctggttattttgaatttgtcacagtctgcagctaaaaggcgaacaggaaaagaagagagagcggtaatttgaatgatagcagatttcacatcaggaaccaatgaagctagataagaatgcaacatctttgatgtctaaaagaaacaaaaagccaaccttgaattctttatttagtgaagttacccttcagaaatgacggcaaaataaagatgttttccaataaaagacaactatgagaattnttcaccagcagtcctatggtatcagaacagccaaaagaagttggtcagcctacagggaattatatcaaagggaagacttgaccttgaaaatgaatgaggaatataagaaattgatattatctgggtaaaaagaaaataaattttttattctatcatctttaaaaatgtatgactatttaaaacaaaaattataatatggcagtgtgaatttcaatgtatataaatgccatattgtaagactactttaacataaaaaacatcagtaaatggaacagaactataagaaacttatatagatgcaagtatctaaggttttacaagaagcaatgtgaatattaactctaagtgaactatgaagaatcctattttttgtaactacaggaccatattgattaaagtgggtagggcaaaaaagtggactctcaaatgttataatcccataaggggaaggggggaaaa

SEQ ID NO: 546654 - DNA, 157 bp, Homo sapiens
cgcggtggctcacgcctgtaatcccagctctcagggaggctaagaggcgggaggatagcttgagcccaggagttcgagacctgcctgggcaatatagcgagaacccgttcctccagaaacaggaacaaaaaacacaaagaataaaaaacacacaatg

SEQ ID NO: 546655 - DNA, 303 bp, Homo sapiens
agaggtgattccccctggagcagatgagacggcgctgttggggctacgctggaggtggtctcgcacaaggttcagagcgtcattcgattttccgcgggagatctgaaccaaggcgattcccttaatggcttccaccatgtctggatcgcgcttgagcgcttcgttgaaagaggcttcggcttcgttcaggcgtcgctcgcgaagatacagttcgcccatcttttcatagcctagcgggctctgcggaattccttcaattaaccgcttcaagtccaactctgcggacgcaggatctctctggat

SEQ ID NO: 546656 - DNA, 935 bp, Homo sapiens
tgttggctgcggcgtctatcgcgcgtgggtttgaattacggcgtcgcgctgggtgggatgtagcgtggtgctgccggcctgctggtgccgcggcaggttgacaatagtccctcgggggcggagttggccgcgcgcggcacggttgtttgtgccccgcggcgccgtgtgtgagcggtgtatgcttgcggtgccccctcgtgtgcgagtggtggtcgtccgcgccgcccgcgggcagtgatttactcgtcgcccctggttgcgccgctgggaagaagggtagcgcccaccagtgaggttgttctcgcacgctggcttgctgcggcgtgagctcaccaagggcgtgtgtccccgcttgatgtcgggggccagcctcttggtggtgtcattcatgaggcggctctctctcctgggcggctctaactgtgggctcactcctctctgacaagggttgtgtcgtacgccaggaatggggtggtgacgctctcgctcgccgcgcgggcgatcacatcacacgcatggggggccaccgccgctcggtagacgctctgctcgtccagagggccgcggcaagacaatgatggcgttctggtttcggcactctctcgcccgcgcgtatgatggagcttgtcagagctatcgctcagggcgggcaacagcttgtgatggagcagccaccatggcgcctgtttggacactcccccggacggtgttcagtgtatggaggcacccgtcgtcggttgtttctagcaatggtttgaccctgaatagctccatctgttccccgcctgctcaagtggagcaaacgggtggggacgtctcccccccagcaagtggactgcgcgtacgtatggttcctatcaaccaccacgcccccccctgtctcgtcccccccccccgggggcccccataaaaaagggttggctaaaaaaaaaaca

SEQ ID NO: 546657 - DNA, 125 bp, Homo sapiens
ctcgtatcatctcccttttgtccacccttcatacagtatggatttgcttgtgatgtccaggtctaggtgaatgcttaggaatatactgcatgctcccttctttcttccatagctgctacaggcct

SEQ ID NO: 546658 - DNA, 483 bp, Homo sapiens
  misc_feature (418)..(418): n is a, c, g, or t
accaggaaaacacatcctctgcggcacaccaggaagctcagatgacaaagcagtggaaggaagtataattacaatgatgaaatcaacacacggaaattcctaagtggctgcagttaccgtaacaagggggtacaggacctcagcctcctgcactggaactttctgccgcatcccagaaaggctggctctcctacactgtgctctggggtggcagctgtcttttctggttttttgttttgttttgttttgttttttctgagatggagtctcactcttgttgtccaggccggagtgcagtggcgcgatcttggttcactgcaacctccacctcccacgttcaagccgattctcctgcctcagcctccccagtagatggggattaccggtgtccggccaccacacccagctaatttttccnatttttaagtagagatggtggtttcaccatgtggtaaggctggtctcgaaactcctgacctcatg

SEQ ID NO: 546659 - DNA, 750 bp, Homo sapiens
  misc_feature (719)..(719): n is a, c, g, or t
gttttctactcgtggcggggagacacgtaggacattattgcctccggcctcactggacccctcagctctgtataagatatgctgcggcattcgaataccatgcgcaaagaagagatggatcgttgcccaactgtcactatagggcaaaccgcgcaatgcattgccacattggtgtggacaggtaggactcgccaaacgccgatgttcatctgccacaatggcctctgggtcgtcctgatcgcaggggtctctcttttagcatagagggccctgccactccctgggaacaatgagtcttaatcggaactggcgaaggccaactgtcagtggccaacactggtccacacagctaaaggaagtactcgtatagcccctcatgtgttatacctggaccgggattcgacacttgatgtgggaactaagaagaggcctgcagatttcccttctataccagacctggggggcgcccacccgggtcctactataggacccctgtatggcgcttgaaagccctgtaacaataagaggctgccagatggcccatccctagcattattaactttaccaatctttttggtggggatgctatcctaaaaaactataaaagttctcaccatgtggtcccgcctctaaagcatttccgggaaatacaggcgaaagattgtagatgggagccataattgcctaaagaggggaactcatgccacttgtactataancgacgccccttcaatcctccttgaactggat

SEQ ID NO: 546660 - DNA, 738 bp, Homo sapiens
tcatctcacagccaggcggtctggggcatatgagtgaagggtagcaggaaggacaggaccagctgggctggtagtgagatctgtggcagagctggtagtgacagtcgtggctgtgcgggcactggcgggatagccccaggagtgcccatgtcactatggagaaccacctcattgcatgcagcttcctacctagtcagccacacagacggttacaacggggagagtggtcctgtcccttcataagtccgacatctccagtggcccgcactggaactccgggggacctctactggacttgcttagcgtggagactagtcactcgagggttaggcggggaaagggccacgaaaatgaaaccattgagaaagaagccctttcaaggaggcccccagaacaagataaaccaataccaagacataacaaaaggcgcgcgggcgccgttcgcggaaagttaagtcctctacggacgtggccccaaagccacctacgcgcatgttgccccaggtttgtcgctgggcgacgcaggttctggggaccacccaaaatgatgcgtgccgtcagtgaattccaataagaggaaaagggcgccctgggggcacgcacaaatttggccccccacgttgtagtgggacggggagaaccacgtgtggctcagccctttgggcggagacactctgtggttgacgcgccagcccgtattcacaccttggggggtgcgttgccccttgactgtggctg

SEQ ID NO: 546661 - DNA, 99 bp, Homo sapiens
gtgccaaggaaaaacgggccagaaaaatgtagatctgatgagacaagttctctccccagtggctgatgtattccaataaaccaatagatttcaaaacca

SEQ ID NO: 546662 - DNA, 122 bp, Homo sapiens
ttggggttattcagtgctgaggaaatatctcaagcagacatgtagaggtatgaaagacacagggcaggaatgcaaaagagggagcacattgatggatcattgccagggaaggtatttgggac

SEQ ID NO: 546663 - DNA, 336 bp, Homo sapiens
gatttgtcccatggaccaacaggggtggaagaataggggatctgaatgctgtactatctcatagggcatacaacattacactcttctaaattcccaccggggcaagtgagggtgcgaaagcctgtatcgatgagcctttctggacgtattatcctacagttctgtgactgtccagcttaacgggagtctctggagggactagggaaattatcaatacatacagggccctaatttcacgctccttaacccaacctcagtcctggagcctaaaaccacaatctatacataacaatgatttctccctcctacctcctcaaacttggcttcctgccccca

SEQ ID NO: 546664 - DNA, 107 bp, Homo sapiens
agagttgtttcttctccctctactcgctaaagcagcctctctcgctaaagcagcctctctcgctaaagcagcctctctcgctaaagcagcctctctcgctaaagcag

SEQ ID NO: 546665 - DNA, 358 bp, Homo sapiens
cactcagcatagggcgtctggtatctactccaacaagatggcgcgcaccatctggttcttctacacactgtcctgcactgcctggtcttcctggtgctctacaagctggcatggagcgagagcagtggcgagggactgtaccacgcttctgcgccatgaagtacgatgaccacctgcacaagttccacgagaatgacaaaggggcagcggctggtgacttgtggcatgtgataccccgggccctcccccgtgacagtgacggttgcgcttccaccccgactggctcagtgcatctaattcactaagactcccctgaggaatccctcatgaataatgccgagtccgctgcatcggggac

SEQ ID NO: 546666 - DNA, 190 bp, Homo sapiens
tcagtagcagcattactcataaaagcccaagcgaaacacctcaaggtgtccatcacgatgaatggataaacaaaatgtaatatatccacacaatagaatcttattcgtcaataaaaaggaatgaagtactgatacatgctataacagagatgaacttcgaaaacatgctattgaaacttctaaaactagg

SEQ ID NO: 546667 - DNA, 793 bp, Homo sapiens
  misc_feature (110)..(110): n is a, c, g, or t
  misc_feature (112)..(112): n is a, c, g, or t
  misc_feature (132)..(132): n is a, c, g, or t
  misc_feature (142)..(142): n is a, c, g, or t
  misc_feature (163)..(163): n is a, c, g, or t
  misc_feature (178)..(178): n is a, c, g, or t
  misc_feature (379)..(379): n is a, c, g, or t
agcgggagtgcatctggaatacgcagagtcagtaagaccatggctacgtctcgatgtctaagggttgcttgtttttaagccaaactccaaaaagagaaagatctctctgncnatagaggactatttttaacnaggggaaaantgagcctgaggacagagcttngattcgaacttatcngttgatatgggcccgccgattgtagatctggagaattgggcgaacgtaccacgacgggagtttaattataaaccctgtgtgacgcaacttctggagttggagtttctcggcgcaaaatcctccattttctggggtttcccgaaaggaaattctccgaagagctttggggccgggtccccaataataaacttcccaagaaanttttccacactgggtggcgcctctggtgcctcttggggtgttgaaattggtgctccagggagttcacttggagttttggaccactttccgcggaaaggtcttaaacaagaaagggcccttttccagaaataaatgttgcacacccatattgtatgtctcactttgcgacaagcgtaaaaagatttgtgcccacgatattggaaaaccttttttttgccaaagttgatctcacagttgatggactgctgtgttgatatataaatccccaagaggaggaaagtgttcacgtcacccaaagaaagacacattattcaatggattcactttccagttggtatatgactgtcgcaccagaagacggacccaaaatgctaagcaaaaaaaggactacttctagccatggcagtctcctcc

SEQ ID NO: 546668 - DNA, 211 bp, Homo sapiens
ggctgaccttaaggatctcaagctccaacaagatagctgcagcccgtcagagagagctctgcacgtaccaagtaccaggcccagctccaggccccaactcgccagctctcccgctctggatctgcactctaacactcgactctgctgctcaatgggaagaacagaatttgctcctgcatgcaactaaattcaataaaactgtcttgttggg

SEQ ID NO: 546669 - DNA, 402 bp, Homo sapiens
  misc_feature (110)..(110): n is a, c, g, or t
  misc_feature (112)..(112): n is a, c, g, or t
  misc_feature (132)..(132): n is a, c, g, or t
  misc_feature (142)..(142): n is a, c, g, or t
  misc_feature (163)..(163): n is a, c, g, or t
  misc_feature (178)..(178): n is a, c, g, or t
agcgggagtgcatctggaatacgcagagtcagtaagaccatggctacgtctcgatgtctaagggttgcttgtttttaagccaaactccaaaaagagaaagatctctctgncnatagaggactatttttaacnaggggaaaantgagcctgaggacagagcttngattcgaacttatcngttgatatggcagcagatgaaatctgaaaatgagcgactacaagaggaattcaataaaaacttgtttgacaatctgattgaatttctgcaacaaatccacattcctgggggaatttttccccccaaggaaaaagcaaatttcaaagcagacttgggcggtcaaataaaactcagagaaattccaactgctgctcttgttcttggtgtgaatgtcacagatcata

SEQ ID NO: 546670 - DNA, 420 bp, Homo sapiens
agctggagtgcagtggcacaatcttggctcgctgcaactggtgtctcccaggttcaagcgattctccagcctcagcctcccaagtagctgggattatagccgtgcaccaccacgcctggctaatttttgtatttttagtagagacagggttttaccatgttggccagtctggtctcaaactcctgacttcaggcgatctgcctgcctcggcctcccaaagtactgggattacaggcatgagccactgtgcctggcattttttttttttttaatttttaatttctttggagatagggtctcaatctgtcatccaggctgaggcaggagaattgcttgatcccaggaggcggagcttgcagtgagccgagatcccaaccctgcactccagcctgggtgacagagccagactctgtctctaga

SEQ ID NO: 546671 - DNA, 310 bp, Homo sapiens
tttgccaagaaacccttaagagcttcaatttaggtctactgtcctataaatgccctaccttcatctttttatttattttaaacatccttacttttgggtcccataaaatgttccagattcatcttgtatttatctgccctagcccttgttccttttattgaagaacatttagaaaccaaaatctgggcactagctgtgcttactgttaccagggtacacaatatattcttttttggaggcaggtgtcactctgtcacccaggctggagtgcaatggcatgatcatggctcactggagccttgacctccca

SEQ ID NO: 546672 - DNA, 752 bp, Homo sapiens
  misc_feature (2)..(2): n is a, c, g, or t
  misc_feature (135)..(135): n is a, c, g, or t
  misc_feature (142)..(142): n is a, c, g, or t
  misc_feature (152)..(152): n is a, c, g, or t
  misc_feature (178)..(178): n is a, c, g, or t
  misc_feature (206)..(206): n is a, c, g, or t
  misc_feature (273)..(273): n is a, c, g, or t
  misc_feature (277)..(277): n is a, c, g, or t
  misc_feature (398)..(398): n is a, c, g, or t
  misc_feature (419)..(419): n is a, c, g, or t
  misc_feature (440)..(441): n is a, c, g, or t
  misc_feature (456)..(456): n is a, c, g, or t
  misc_feature (464)..(464): n is a, c, g, or t
  misc_feature (475)..(475): n is a, c, g, or t
  misc_feature (477)..(477): n is a, c, g, or t
  misc_feature (479)..(480): n is a, c, g, or t
  misc_feature (507)..(507): n is a, c, g, or t
  misc_feature (679)..(679): n is a, c, g, or t
  misc_feature (686)..(686): n is a, c, g, or t
gnacgggaccagggagagaggggagggatatttacagtgcatggtggtacggggacaaccactttcctctgagtagccctgagaactttgtgctttttttcttagttggtgccgagctactctgtgaatggattngtgtatntcttctttanggaaagatgtattaaccaaagcacantccagcccaatttctcggctgaggattncacgatatcaatccaaacatcacactatttaattccccaataaaacattggaaaaaggactatcagngctnacacatttacatataaaatttccacctaataggtaaaaaaagcctatgtaccaatttctaaaacagtaataagaaatatacacaattaggggtatataaaaaaaaaagaatattacaaaanattaaaggcaatcctcctggnccacggacccttgtagccgcnnacttgaagttggcanaatctganaatgcatcaanananncctgcaccaccttgtagcagaactcanactgttccagtgtctggaccatgtgtggcctctgtagccgcagcttgacagtatggaagacatccaaaatcccctctgcatacacacgctccaggacggtgctcagggcacagaaggtccccgtccttcctgccccggcgctgcagttcacggtgatggggtggttcctgantgctgcngctgcttctgcacggcggcgatgatgctgaacatgccctttccgtcactggggatgcccacttcag

SEQ ID NO: 546673 - DNA, 1007 bp, Homo sapiens
acatacccatggccaacctcctactcctcattgtacccattctaatcgcaatggcattcctaagtgcttaccgaacgaaaaattctaggctatatacaactacgcaaaggccccaacgtcgtaggcccctacgggctactacaacccttcgctgacgccataaaactcttcactaaagagccctaaaaccccggccaaatttaacaatcaccttctacttaacggcccggactatagctctacacacatgcgctcttctacatagtgaacccctcctcccgatacccaaccccctggtcaacctcaacctaggccttcctatttattctagccacatactagcctagcccgtaactcaatcctctgactcacggctgcagcaccaaactcaaacaacgaccctgatcggcgcaccgcgacgcagccagccccaaccacctacatactgacacgtcaacaccttagcccatcatatcctacctatccaaacattacttacctacagtggcatccgatgaaccttctacgaccccttatacactcattcctcgaacacacgtctgcaattacctccctgaccatacacggacgcccatgggagacaacaacaatggatcacacctaacacccaacatcacgcaggagaacacacaacacgacacccacacgtcacagaaccaatgcccgccaatgcggatctcccgaacacaacacacagcgacctccaaacaatccgcaaaaaccgcagccacgcccacatccggacgacaattattagcgaaggagccgaaacaatccacgcaaacacacacacacacgccagaacaccacacccacacaacacaaaacaaacacaatccgaccgccaaccaacataacgacagcaaaactaccacgtacaccgccaacacaacaagatcacagagaggacacaaaccacacacgcaaacaccaccccgagacaaaacgaaagctggaaaagcaaacccagcaaccacgatcagaca

SEQ ID NO: 546674 - DNA, 444 bp, Homo sapiens
tctgatcaagctcgaacttgatccaatatacgcacaggaaggtttaactttaattaaaattgacagggttgaagaggaggctggaacggaatacagtatctagtaagatctacacatgtctatgcgtgtcaaaatgctagtaggaatatgttttgtcaatacatgataggacatgttgttgttttaaatagatgagctgaaggctgataattgaagtcaatttatgtaatattcatagttaaatatttagattttattcatatatgtatctatatttaaatatatggataattttattattttaaacattaataattaatttatatttatcaattatttcaattaagttatttaaaatttatctttgtattttttatatcttataaaacttgaatttattgtgattatttttttttgtattatttaattctaagtatattttag

SEQ ID NO: 546675 - DNA, 973 bp, Homo sapiens
gctcaggtgccctggtggtctttgaggaggccttcttctcgttctgtgagcacggcgaaccagctggagtacctggtgggctcgttgtgtggatcggcttctggctggatgttcctggtcctgctcatggtggccctggtaggggagctttctggtccgcttcgtctccgcggttcagcccaggtagatcttcggccttcttcgatcatcactcatcgttcgatctgagtaagacgcttgctagcaatgctggtgaaggatcttccaggaagcagtcccgctgcgataggctcgctcatggctccaagcagctcagagtggtggactggctggtgaagaacattgacattggagcctggggtaagaatccacggctgtggagacagtgacaagaggacgcttgggctgaggcacgtctgggcaaggggaatgccccgcgtggccatgtcccaaaacacggccctgctgtcgctggtgctcatggccggcaccttcttcatcggcttcttcctgcgcagattcaagaaacagtcggtccttgtcctggccggatccggcgggtgaattggggactttgtgggtgcccatcgccatcctcgatcatggtgcgttgtggaattacagtattgaggacacctatagccagaagcttgagcgttcccatgtggatatcggtgactggcccaagaaaagaggggctagggtcatcaaccccctgggagagaagagccctttcctgtgtggatgatggtttgccagacctgtgccgcatctggtcttcattctcatcttaatggagacaaagataaccagctcatcatctcaagaaggaggcatgctgcagaagggtcggttccactggaactgatggtcatagtggcatgggggattgagactttgggctgcctggtggttgtgcaatggccggttgaacacgcaagggtcacagcaagaagagaggctggaaaccaat

SEQ ID NO: 546676 - DNA, 599 bp, Homo sapiens
catacatgtcacacagactaaggtaaaaaatgtacattatacatatcaaggcatgcaattacattaaatacaacataataaaatacccatgtcaactataatcacagcaacatcaataacaacaatgacgaatgaaatactcttcaacaggtatctcagatgtatacatccatgattctagacactccataggagctcggtaacagtttgtataagccatctatttaatggggtcttcagggcaaaattttctttactttcatgatgcaaagcctatgaaggatcaacgtgtctgatacctcgaactttattcaattcctcttgaagttaagtctcacttagtattaatattagcaagctgaaagcggagtttagatacttccgatatgagttggctatattcatcttacaactatcaacaacatgcttgatttttagtaacaaatactgatgacccaataatagcaagctcttctctcatttggtcatcatgacctaatgcggttagtatagttatagttttattccatgagccaacattctaaggctggaatgttggtactccgggtctatggctgaagtccaaacttagaatttcg

SEQ ID NO: 546677 - DNA, 156 bp, Homo sapiens
tccaccttctggctcctgcatctccatgattgggtgactatgttctcaccaggatccagactggcatacttgaaggagcaaaaagaatcacacagaacaggcaacatggaccagacggcggcgcgcgtgcacacgcgctgcgccctgcaaacgctc

SEQ ID NO: 546678 - DNA, 1450 bp, Homo sapiens
ttatttttttctcatttaacttttttaatgggtctcaaaattctgtgacaaattttgggtcaatttgtttccatataaaaagctactgatttttaaaaactaattaactttaaaacgtgccacacgcaaaaacagaaacaccaaaggtggctccacaaaacattcctccttttcctttcatgagaggtttttacgagtcgcttgtgttatcatttaaccgagtctctttttccttcacttaacactttaacatgtggccaaatgtgaacacaaacagattcgtgaagacaccgtttctttcacacccaccgtgatttacagacagtgtggggtgtggcccaggtatatttcagggaataaactatctcatatcctacgccctttcgtgagcccttctcccgtggcgcccagcaactttgcggtgacaccattgccccgaggctctccgacgccagcccttctcttgtgtgtcaacactgtgcctttgtgcatctgacccccccccacccgaccaccgtgctcgtgtcctcgatatccacagaaacacagggcaaatggcagaccccaaaaagggtgtgggtatagttcgtgagaacagcctcctccacacaacaccatttggcgcctatgcccacggaaacccattacttcacccactgtggccacgcaatctcacccaaagacctttcaacaagacatttctagggcgccccaatacgtctcacacgattcttacttccacaaaaaaacggcgaaatccacattctattcaccatatcagccttacacgcacaaatcttgcaacgttgcaagttgtaaaccccgttctatggcaaattccaccatatacaaggagagccataagcccccggccgaccatatactctgccccctagagcattgggtctccacagcaataaattccccctttgtcagccgaggttgaaaagcccaggcatcgctaccccactgtgggcgggagcatcaactctacgcgactgttcccctagaccactgtcgttcccccagtcactatacctctcgcctgaccagcacccgacttccttcggccacttagcatcccccagtctttgtctccccggggacacagccttcccctcaccgcctccaggaggccatcatcgcacagaattataactacagcagcacacctaacacggaaccacagatccccccccccacaccactcctacacacccacacccacgcggcccagtaaacacaaacaaatccacacttagtaacctccacagcacacaacacagcaatacacaccatcacgtacacaagataaccatcaccaacgcaaggaagacacacaaccagagcacacacccaccacacacgcaacacccacagcccaccacacacaccgggtccatacaaccacgagcatacaccaccaacaaataatacaccaacacagatc

SEQ ID NO: 546679 - DNA, 326 bp, Homo sapiens
ggtgcctgttgtgtgcctagtgactgtgtgtgccattcatagagtcgacttgcctctattttacagacattcaccgagaagagacgacacatttacagacggaccatatgatgcttttgcgtcttacctgaatgcccacctgaacatctggtgtataagatctgcatattggacagggacgtactgcctgcaggagcatgcagcgatgatatgcactcactgatggcatatatgccgaagactagtcatttgttctaagtaccagtgatatgtctactgaggtcaggtatgaactggagagcagtactgctgcagcatttggcggc

SEQ ID NO: 546680 - DNA, 838 bp, Homo sapiens
gctgcggcggcaggaaatcggggctcggccctgcggcgcgcgacccatccccatcccggtccctgcagagcagatccccgggcccagatatggactgcagcagagcctggtgactccccccagtgtcctgagggcaggaagaggtacatgtgacatcttccgtgagcctggacaacctcgaaatctcactggtggaactgtgacccttgatgatgcttggctggagaccctctactctcatgaagacccagaacctgacaagacccctacagccacattgttacccaactgaatgccatgctgttggagctggccctccccagagggtcctgtacccctcacaggggagcgaactggacttgcgtgctcattctgtgacaaatggggggtgtggactgcaagcccgtggaatatgccagagacctggagccgctatgccaaggaactgcttgcctggactgaaaagagagccagctattgagctggacgtttgctaaagaggcaccattgaaggatcgcctgaagcttggcaaggttgtccagttcaagcagcatgagcccacattgcctcgtgcgagtacatctacaccctgtatctggagcacgatctcagcctgggaaccctgggccatggagaccagtggcccagcagaagagaggactattaccagtcccatcgacggtccaacagtgtgactgagaattgcagatagtggctgcacatgtagttcacgggagcaagtgtgagtgaaggatgcagaagcgtgatgccactgacggctgtgcatggcacttgcggagcgcccagctggagtactgtgcaacccagtgaagcact

SEQ ID NO: 546681 - DNA, 449 bp, Homo sapiens
  misc_feature (427)..(427): n is a, c, g, or t
ttacaacagcttctcctgccaaagctggcaaccagacacgtctgctttcacatagaaccaaaacacatggaaagaagatatgaggagaaaccctggctccctcccacgtgttggcttccctttccaacagcctttcaaagccggagtctcctccaagtgggtgagcatgcctcccattcaccaacagcgagcttctctgtaggaaaaggctggggcctctctcagcccccaccgcccaccaccagagagcctagacttgctccatgagcagacaccatgggggcctgatggaaagctcattcaaggtcacccccaggaatttctctcgtgcaggaggtgagaggtgaacaaccatggctaggtggcaagtgagcagaaggaaagatgcaatgtgactctttaagaaaaggcattttctaatactttntcttttgaaatagtgcaaagat

SEQ ID NO: 546682 - DNA, 640 bp, Homo sapiens
  misc_feature (60)..(60): n is a, c, g, or t
  misc_feature (223)..(223): n is a, c, g, or t
tggtgaacccagtattcaccaaaactgggcagagacatgaggttttgataccagttttcnccaaggcctgaagttctgatgtcagacctctgtgaaagccacaagcggcaaatttgctggaccaatatgggatgaggtaaggaatcccttcgtggccgcacactgaagccactgtgacgatgtggccatgatttctctccatcatcgatggaagaagtgcttntgtgatccaaaaatgtcctaggatgttgacctcaaatgtcttggtaatctcttcatccttggtgctgagaagatcggctggatatactgtcccagcattattcaccacgattgttacatcacccacttctttcttcacctgatttagagagcgatagatccggcactcagctgcagtttcctccacaccgcgcttattaatatcccacagaaccaatatgctctgtcgttttgcaaattcataagtagtctgcctgcctattccatgcccagctccagtaatgagaacaatctccccagccacagattttctcctctgaggaatgaaaaacttcaccaacgactccaagtaggagtagatgatggtgatcagaagcagaaggatttctaggatgatgttcatggctttgctctgtcc

SEQ ID NO: 546683 - DNA, 237 bp, Homo sapiens
cgctctcacccacccccaggctggacagcggtcacgctgtatccagtactttgggaggcgaggcgggcggatcacaaggtcagagatcgagaccatcctggccaaccaacatggtgaaacctcatctctactaaaaatacaaaaattagctgggtgtggtggcgcgtgcctgtaatcccagctactcaggatgctgaggcaggagaatcgcttgaacccggggtgggtggagagcgg

SEQ ID NO: 546684 - DNA, 694 bp, Homo sapiens
  misc_feature (60)..(60): n is a, c, g, or t
  misc_feature (223)..(223): n is a, c, g, or t
tggtgaacccagtattcaccaaaactgggcagagacatgaggttttgataccagttttcnccaaggcctgaagttctgatgtcagacctctgtgaaagccacaagcggcaaatttgctggaccaatatgggatgaggtaaggaatcccttcgtggccgcacactgaagccactgtgacgatgtggccatgatttctctccatcatcgatggaagaagtgcttntgtgatccaaaaatgtcctaggatgttgacctcaaatgtcttggtaatctcttcatccttggtgctgagaagatcggctggatatactgtcccagcattattcaccacgattgttacatcacccacttctttcttcacctgatttagagagcgatagatctcttctctgttgctgcagtctaccacatacgcatgcgcagtgacgcctagttttcggcactcagctgcagtttcctccacaccgcgcttattaatatcccacagaaccaatatgctctgtcgttttgcaaattcataagtagtctgcctgcctattccatgcccagctccagtaatgagaacaatctccccagccacagattttctcctctgaggaatgaaaaacttcaccaacgactccaagtaggagtagatgatggtgatcagaagcagaaggatttctaggatgatgttcatggctttgctctgtcc

SEQ ID NO: 546685 - DNA, 420 bp, Homo sapiens
ttcttgttggtcgtctctcaggatcccccccgagaagctgacccatgttctcccctaatggccccgtgcgtaggcccctgcctatggcctgcctgggacacactaactatcaccggaacacactggactgatacatcaatgacgccagactgcacccctgcctgtgcctcccaagagcgaccccgggacagtgggtcagatctaggtgtcgtacactggccgaacacaagggctggacgccacactgtgatcgctcggacactgaacggcacgctatgctctgcagccgtggctacatatccttcgcgtattactccattcctcagggtttcaccgggcttgtgttcggagactccctctgctgacacgatgggcacactccccttcgcgtatgactccattcctcatgcgttctcgggg

SEQ ID NO: 546686 - DNA, 199 bp, Homo sapiens
cggttttctgatttggtgttccctcctccccactgggtgtctgttctggaggccagggtgagaggtggaggaggatggtcacgcagatcagaactcgggggagacagtgtaccattgggtaggaggagtacagactgtacagaagactgagcgaggatgaactggtgcagataggcatcgagcagaggctagcggacaa

SEQ ID NO: 546687 - DNA, 255 bp, Homo sapiens
  misc_feature (1)..(1): n is a, c, g, or t
  misc_feature (106)..(106): n is a, c, g, or t
  misc_feature (237)..(237): n is a, c, g, or t
nttccggccgcatcttactttatttgtgatacaagcaggggtggggaaagagaaatgagcagacttggaagcttctccaggggggggagaatacctctgggctccnaacaccagacgccaggagaaaggagggggggtgatgactccccactctttctccagcccctgctcctctgtgtctccccttcacccactgcagcttcctcagggcctgggtcccgtgccggggggtgttcnaatgacctcctttctatc

SEQ ID NO: 546688 - DNA, 120 bp, Homo sapiens
gcggccgcctactactactttacggttgcaagaaaacaacagaaaaaattggccaattccccaaaggtcctaaaaacccacggcctcttggtttgaccccattaaaaattgttatttccc

SEQ ID NO: 546689 - DNA, 124 bp, Homo sapiens
ggtctcttttcccccccttttccccttcccttttccccgccccccccccccaaaaaagaaacttcttcatcccggggggcgattattttttttaactaaaggaagataaaattttattttttta

SEQ ID NO: 546690 - DNA, 466 bp, Homo sapiens
  misc_feature (14)..(14): n is a, c, g, or t
  misc_feature (429)..(429): n is a, c, g, or t
  misc_feature (460)..(460): n is a, c, g, or t
gtagcgggaatcantcggaagaaaccggggtggggagataatgtacggctcctaggcccatgtaaaaacttaatttttttttattgagaactgagaacaattgaattcatcccaaaattgtatttttccctttgaaaaatagcctacatgagcctatattacctctttacactgataaaacattaaaagtactttttggctgggcacagtgcctcacacttgtaatctcagcactttcggaggctgaggcaggcaaatcacctgagacccaggagttcaagaccagcctggccaacatggtgaaaccccatctcttactaaaaatacaaaaattagccaggcctggtgccacacacctgcagtcccagctactcgggaggctgaggcaggtgaatcgcttgaacccgggaagttgcactgagctgagantttgccactgcactccagcctgggcgacagnagggac

SEQ ID NO: 546691 - DNA, 380 bp, Homo sapiens
  misc_feature (324)..(324): n is a, c, g, or t
aaaaaaaaatttcagttctatcttgaaagatctcacttccaacacacatgctgtctagcaacactaagtagaggggaccattcttcccaactcacggctgctttgtccacttcccagacctgcagccccagcacctgcccaccttggcatctcccattaagtcacataatgagggcagagagcaggggcctgtttttgcggacacttgaagtacagcatggaccaggcagagcaaggcgccggatcagatcagttccagaagatatgcagcagctgctctgatttcagtgaaatgtgtgaaaccatgcacaggactttggacanctctcagctgttagcaaaatcccagtttccccttggggctttccagaaggcaaggg

SEQ ID NO: 546692 - DNA, 869 bp, Homo sapiens
ggcctccgtgctgcccctgtcagactgtggcggccggtcgctgcggtgcgctctccctccctgcccgcagcctggagaggcgcttctgtgcttgcacacccccggtcctgccggaccggcctgccctctgccgtgctccgcctgccgcgacttgatgcccgcgcgtgacatgtgacacgcacctggaacgctggcaccagcgcccggtcggctcctggggactggcgaagatgggcaaacccaggaactgtggctgctcatcacggtatcacaggccaggatggttcctacctgtgttgagtcctgctggagaaaggctatgaggtccatggaatttgtaccggcggtccagtacaatttaatacgggtcgaaataaggagcattctgtataagaatccccaggctcacattgaaggaaacaatgaagttgcactatggcgatctcactgaacaagaacctagcctggtgaagatcattaatgaagtaaagcccacagagatctacaagcttggaagccccaggagccaacgtcgaaattacctttgacctcgctgagtacactgcggacgttgaccggagttgggcacctctacgaccttctagaatgcaggttaaaaatagtggcttaatcaactcttgtggacggttataacaaaggacctcaaaaggtaaacttaaatggggacaagctgcctgaatagcccagaagggagaacacccctatatatcccgataccctaatgggaagaaactatcatgctaatgattgggtaacaatccgagaagcgaaaaactattgaggaacagatactcaaacagagagccaaagagacaaagagaacgaaaaaccggcaaataaaactggaa

SEQ ID NO: 546693 - DNA, 961 bp, Homo sapiens
  misc_feature (17)..(17): n is a, c, g, or t
catcgatctctatgtgncccaccagcaacgagtctgttagaccactccgcccacatgtgccggcgtcgtgcatgtgtggcgcccgcgtggctcccctatgtatacacatcgtcgtgtgataaccccgcggtgttcgcgccccgcgagctgttgattcgggttctgccacgaggattccgccttccactatatgcctgcccccctttgcggccccggattgtggcgcccaactccttcggtcccatagggggggggcccgcacacccacattactgcgggggctgcaatccccccacctggtgagaagctggcagaaaatctctcccacaacgtcaggatctcacgaccacttcaccgccttttttcccctctgcaccaccagggggtttaataaattaccgcggacaaagcttttttcccagggctcgcactccgataaaaccacccttggtgctgaccacaacccaagagctccaatgttccaaccgaggtgacaccacaaagatttgtgcgctcccaaattgctatgacacaccattattataattgctgtcactaccttctctgcacatctttttcttctgttgccacccacccggtgagacaataccatcctgaaaacctcaaactcaataatcaggaaccttcttgtcaactcccaattcatctctactcattcaccgcaaatttatagctccccttaagatgcaccccgtggggacatcatcaacaatgatacaaaggcaagtcgtccaccctttttgtgaaccaaacaaattaataaggaacaccaccctactctctcccccaccactagtgcgagagtcgcgcgcctacacgccaatttggatagaccagcctctctatattcgctaaaatatgacgctccacttatcactcataaaaagaaagggacaacttcaaccaaccaattttccaccacccccccccaaaaaaaaca

SEQ ID NO: 546694 - DNA, 800 bp, Homo sapiens
  misc_feature (436)..(436): n is a, c, g, or t
ccccacaatcctaggcctacccgccggcatgtactgatctattctatttccctcctctgatctgatcccgctagcactcgcaagatatctcatcaaacaaaccgatgtaatcaccacgcccaacgaatgactaatcaagctaacctcaaaacaaatgataaccatacacaacgactgagagagggacgaacctgatctcttatgctaggtagtccttcaatcgatttttatgtagccacgagacataaccttcgctcggacctcctgccgcacgtcagtggtagcagcctagagccaaccccaatctatcgtactaagccttgagccgcatggcgctatccccttactgagtgcgaggcgcagatgagtgtatagggcgtttcgactctacagatataaaacatgccgcatagtcccacgttctataccacaaggncagcgaccgtacaaccccgtatatcccgcagtactgagttagtaactgcggaaagccagtgcaggcactactcagttcacaccaagtaagccctgtgcgcgtacgcctgaaccgcataagcattagctggcaggccaccgtactcatgcacctaattcggaagcgccaccctagcagtatcaaccattgaccttccctctacgacttatcaatcttcacaattcgtaattgctactgacatatgcctagaaagtcgctgtcgccctaatccaagcctacgtctgcacgactgtctagtaagcctctacctgcgcgacaggcttatgacccaccaatcacatgcctatcatatagtgaacccgcc

SEQ ID NO: 546695 - DNA, 247 bp, Homo sapiens
  misc_feature (4)..(5): n is a, c, g, or t
tgannatccttcacatgcaccacatcaaaagaaccaggatgtcattccctgttgatgatcacaccaacacgaccgaggttggctccagcaatcaccatacacaaattgcctgtatcaaatttgataacgttgattatcttgccagtccctaactcaatctgcacagtatcgttcaccttaatgacaggatctgggtagcggatggtacgagcatcatgagtcaccaggtaaggaattcccttcacta

SEQ ID NO: 546696 - DNA, 428 bp, Homo sapiens
gacgaatcgttccgagtggaataggagggaatcgtattcgagtggaatggaaaggaatggaatcaaccagagtggaatggaagggaatggaatggaatggaaactaatagaatggaatcaacccgagtggaatggaatggaaaggactggaatggaatggaatggaatggaatcaactcaattgtaatggaatggaatggaatggaatggaatggaatggaatggaatggaattaacccgaatacaatggaatggaatggaatggaacggaatggaatggaagggaatggaatcaacacgagtgcagggcaatggaatggaatggaatgcaatggaatggaatcatccggaatggaatggaatggaatggaatcaactccattgcaatggaatggaatggaatggaatggaatagaatggaatggaat

SEQ ID NO: 546697 - DNA, 870 bp, Homo sapiens
  misc_feature (861)..(861): n is a, c, g, or t
agagaagagggagaaggcgaaggttaagaagccagagagcaagccaatacaaaagaccccatccttttcctccctcctcccctgtggctggcaccagaaagccccattttctcgctcacacattagagcacaaacaacaaccctggcgcgccgggggcaagcctaaggcagacttcggtaacccaacccggaacactccggtactgtcttccaagggactggccggccctggggcgatccaactcgaagccccccggaaggggcgacggagggtttggggtatgaacgtggcgggccttaatttagttacattcaaataaaacttttcgtggcaactcgggtagctaacattggtgtggtatgcctttttttttttttttttatttttttttcctggttacgccggtccatggcagggctaaaatactatttacaattatagaaaaataaaagattccaaaagcattaacactggaactttactggctttgggtatatattgcacactcccattggattaacatcatattgcataactacttggtattttggaaagtaaggaccaatagaacaattactggagtctccgggttaacctaattgttgtgatcccggggctattggggcctgaggcgctggaggatctctctgtgacctggaaacacttttcagcctaggttcctatcgtgaaggaccttctcactaagatccaatcacggtgtggagctaatattagccataacgcaaaccataatcaggatactagattgtgtccactgatgcgcaatgataactggcggcacatgaggcaaccgaatgcggtacgccggaggtcaccgctggtctcgttcgagtttttcntgtggggtg

SEQ ID NO: 546698 - DNA, 942 bp, Homo sapiens
cgcggacgaaaggtacgtgactcctgcggctctcgcattgcctctgctatcgcttccggaaacatggccctccgatgtggctgtctctgatggtgtcatcaacgggttcaacgacatgaaggtgcgtaagtcttcaatcagccagagagagagtgaagaagcagcacaagcaaggacggtgcacttctgcctgagtgagcgacaagaagaacatcatcctgcaggagggcaaggagatcctggtggtcgatgtggtccagacatgtcgacgacgcctacgccatctattgtcaaggatgctggcagcataaggactgcctgcatactgccctctatgatgcaatactatgagaaccaatggtagcagacaagcaacgatagatctggtgtttatcttcatggagcccccggagtctgcgcccccttaggagagtcaaaaatgagttaatgtgccaagtctccaaggaacgccatcaagaagaatctgacatgggatcaacgcatgagatttggccagcaaatgtgctagctacgcggaggtcaagggatcgctgcacgcctggcagaccaacagctggtggtggcagtgccgacatctccctggagggcaaggcgctgtgtagagcaccttctgggccgctgacctggagcagttctggcaagacgccaacaacattgccccattgcggtggttggcaagtgcatgcccccctttacctggtcatacccggaaggggctgggtggtgattcctagtagggggcgcggcaatcccctttcatccaacgatggccaaaaagaaaccacaagcacctgagattacctttctcccttccatccctagaacagatctggcttgcccaaaatggtttagcattagattcttctagatagagcataaattttcccaagacccagttgggcgcttaatttaaaaacatcc

SEQ ID NO: 546699 - DNA, 811 bp, Homo sapiens
  misc_feature (184)..(184): n is a, c, g, or t
  misc_feature (701)..(701): n is a, c, g, or t
  misc_feature (742)..(742): n is a, c, g, or t
ggccatatatggcccgggagaacctcatagtgagatcgaactgcaacagcaccatatcttcgaacttgataatcatgccgaccctcgatgaagggataggcgggccaaattttcttgcagggagcaaggcggccctctccgaaggagaccaaaaaaagaattatattaaggtggcaaaacggcnggtacgtcgcgcggcgcgcagggcaaaagacttgtgacacaggataacctaaagagaactgatttgacacatggaacaacgtgaagcagggtgaaacttgttaagcgaggcgagacaccctgtccaataggcattgtggacataacaaaaaactattgggccttaatgatatgtaccaacatgtgggtcgggagcgcaacttatgcatagaaggcatgaataggtttgcatgcaggaaaataaaattgaatgccgcgaaacccatttgaaaaaccacaagaaaccacgggggtgtccgaaaaagacgaggcccttggcattaacaaacacgggaaaatataccccgagtgggaaggggaatggaaagcaatttgcgttaatcaagggaacaccgaaaccgggaaattgagcactccgcgttggcgctaccggaacaaaaattaagggggggagcaatatcactccgaggcgggcccggatacccgaaaagcctttttgggacacaaggtccaattcnacaccagtaatacacaatgcttttacacatttgcggcagcngacacattgtttgaaaagacttcgaaaccagagggggtagacaaacccggggcattcaccgaaatacaa

SEQ ID NO: 546700 - DNA, 137 bp, Homo sapiens
ggtcggtcccgccttcaggaacatactcggaatcggtcgagcctcaatgagccgaagtaagcgggcgcgatcatcagcatcaggtttgcgccgtcagcagcggatagtcgcggatgacgccgttgttgcacgaacag

SEQ ID NO: 546701 - DNA, 1140 bp, Homo sapiens
ttgctgccagcggcgtgacgcttcggactcgcctattgttatcaatcatggctccactcgtgccggacgacagggagacaggcgagcacgcgtgtcccgcaaaccgtataccatcggacaggatatctccgactcagcccaatagtgggagggctagttgcactatagctgtatttagatgaaagagctattgaagctttaagacaggaattcgacatgaagacggtgcattggccagtgtcttcgaaccaggtttgaaagagcagctgatctctctcgatgtttcagaaccaacaagtgccttaggatgtggcagtcgtgcatggacttacaaggcagcagagtaaaaacgaaggtgagcaatagtagcaagatgtctcagataaaggccccagcatgcaggcaaataaattacaggccactcttatggcgatcgaactagtgctatacattttgagtgtgaccaactggagcagcaggacagtatggacggagcaccatccagtattaccgatattcttcaggatcagccacagccttctgtaggccctgacgatatcggtgggaaaagatcccaaggagcatctatttgaggatgaactagttgccattatttgagaatagctggaactatatggggatcttcgtactaatgatggatccacatcaaatggtgctcaatagaggtatatgcgttagtccactttatgtacaatgcagaagcagcaacaaggaggactgataaacattgtactaataaatcatgaaatcgtgctgggaaaccatattggagtctggatctcagttgcaagaaataggttatggggggactattcctaagagtaaaccaagggaaagattcttgaagacatacggcaagtaaacaaagggtttatagaacgtatatatatcaacaaactgcatacagaaaacaaacgccgggatgaacactgacatgagaacccagaacaggggccaggcaagagaagacagagaggcccacagagaggaaaaggaacagaaaggccacccgcaacaccagaaggaacaacaaggggagacaacgacaagccaacgaaaagaagacacaaaaaaacgcaagaacacacaaaagcagcaacccacagccgcccacccgct

SEQ ID NO: 546702 - DNA, 742 bp, Homo sapiens
ctgatgatgttctcgtcggctggctctgggtgcccggtgagccagagtaagcctccaagaaggaggagagatgagagaaagtgcggctcttcccgtgccctaccagatgcttctggtgggcccaccttgtgagctccgcggccggccctcactgtgaacttgcgtcccacgctgtggagtggctgtcctgacctgtggcgggcacgctgtgcccgctgctgaccctgtgacgtcgcctgctgcagcccctgtgttccccaatggcagagtgaaataccctggtggagccctccttccatagaaccagagatggcatcttgttggatttcaaggacctattcgtggcatcagtgccctgcacgagctgcctgaggtggaggtttagtacaatagtctactacaacccactcattggaattaacgcggcgcgcaggtatgctagtcccgtccttagtaacattggaggcacaggacaaacacttgggtacttgcgaaattgcgccaatcggctagctctccataggtacaaaggaaatcgctatgaagttagaggtataattcggcacactcggtacgccgtttaccaaggacggagctatccccaagaatacacacggctgggattaaggagctgcccgcaagccccttgatatccaatggagtgaaaggcccatgaagcccaaaggccccatgaactcaacgggatcccattgctcgtacactctagtggcattcagatgca

SEQ ID NO: 546703 - DNA, 826 bp, Homo sapiens
tctgggactggcttttgctttaggatggtgttggaagttgtcgttgtctgctatgaacctggtccactgtaagggtgtcgggatctgaagagctatgtgtgaaacacactgaagcattgcaagggatgtggggtggtaagtatcaaaaagcgcggacaagggaaaagccgatcaaagagaagtgacaatgggccaatgtgagcccccatgtaaggtcagctgcccaagacaaggactgcccctggcactgtctgccctggtttgtcttcaaccaccttactcctccaacggccgatgaacacctggatgaacgacaagcatttcgttgggtggctctgtattgactacaccgcgtatgaatgatcgggacctgcagatgcttgaagggggatgaagctacaggtcctgaaatggaactggagactggtgtgctggcaggtcactcgtcacaggaagagaagctatgtgcccagcaactttgtggccgagtggagagcctggaaattgtgaaagggtggtctttagaatcacagggtcggaactgaggcttgagagtgcaagcttcttgctccaagtcaacaaggctgggtcctttcttatcacagagagaggtgaaccaacaaggtgccttcttccctgtctgtgcagggtgttacaccagtgggagctggtcacgccctaatacgatccgctcctggttagtgggttactctcccccgggtcactccgctgcgccgggctgtgggcatctagacgggtggtatcagttgctctttgttcgccctacctggcgtttggccgagcccggcgccgtgcaccacgtgta

SEQ ID NO: 546704 - DNA, 334 bp, Homo sapiens
gcatcgaatcatcacctctacagctatagatctcgtgggttaagcgcagtctagatagatccaactgagtatgagtcggcctgtcgtcgtactaattggccagccaactcgccaaacgtctctaaaagatgtagacaacaacaacaaaaaaaacctaataacaacacagcaacatatggcttccatgtgtaattatacatatcacatctctatacagtcatcagtctacacttagtgacattttaaatcaattatttaaaaccttcctttcccctcctttgccaaaaaaaggggggaggggtatcaaatacaacgcaccttcatgaggacttac

SEQ ID NO: 546705 - DNA, 279 bp, Homo sapiens
taatccactggagattactatcaggctaacttctttgtagctctcagtatagaactatttctgagtatatgtgtacctcatacaaatctccatcaattaagaagttggttgttctacactagcattttaaaaatagtctgtatttatatcttatgtataattgtacagtgaagtatagtactgtggagctgggtgcagtgttcattgcctgtagtctctcagctagtaggtaggctggtgccacccttgttgattactgcttggacccaacttgaaaaa

SEQ ID NO: 546706 - DNA, 306 bp, Homo sapiens
  misc_feature (4)..(4): n is a, c, g, or t
  misc_feature (81)..(81): n is a, c, g, or t
  misc_feature (93)..(93): n is a, c, g, or t
  misc_feature (143)..(143): n is a, c, g, or t
  misc_feature (172)..(172): n is a, c, g, or t
  misc_feature (255)..(255): n is a, c, g, or t
aaangggagaggggactgcaccgagccatcttttccgcctcgcccctttggggagagggccggggtgaggggcaatatgtnatccagcttaantttcccgcactccctcttcccttccgatttacctctccttgttctgcgtnatagtatgatcgttaaataaacgaacgcngttctataatgtagaacaaaatgattcagcaaggagatctcatgccgcagtccgcgttgttcacgggaatcattccccctgtntccaccatttttaccgccgacggccagctcgataagccgggcaccgccgcg

SEQ ID NO: 546707 - DNA, 167 bp, Homo sapiens
ggtttacaggcatgagccatcactcttgacttgtgaggctattttaaattgagacttgaaatataagtagctgttgacccaggcaaggtgcattaaagccctgcaggttaggagtgaacacgtgtgaaaagccagagtgactgtagcataatgaatagggaggatgg

SEQ ID NO: 546708 - DNA, 899 bp, Homo sapiens
  misc_feature (1)..(1): n is a, c, g, or t
  misc_feature (137)..(137): n is a, c, g, or t
  misc_feature (143)..(143): n is a, c, g, or t
  misc_feature (159)..(159): n is a, c, g, or t
  misc_feature (193)..(193): n is a, c, g, or t
  misc_feature (219)..(219): n is a, c, g, or t
  misc_feature (263)..(263): n is a, c, g, or t
  misc_feature (277)..(277): n is a, c, g, or t
  misc_feature (286)..(286): n is a, c, g, or t
  misc_feature (675)..(675): n is a, c, g, or t
  misc_feature (681)..(682): n is a, c, g, or t
  misc_feature (686)..(686): n is a, c, g, or t
  misc_feature (688)..(689): n is a, c, g, or t
  misc_feature (693)..(693): n is a, c, g, or t
  misc_feature (700)..(700): n is a, c, g, or t
  misc_feature (703)..(703): n is a, c, g, or t
  misc_feature (710)..(710): n is a, c, g, or t
  misc_feature (712)..(712): n is a, c, g, or t
  misc_feature (755)..(755): n is a, c, g, or t
  misc_feature (781)..(781): n is a, c, g, or t
  misc_feature (783)..(783): n is a, c, g, or t
  misc_feature (786)..(786): n is a, c, g, or t
  misc_feature (794)..(794): n is a, c, g, or t
  misc_feature (813)..(814): n is a, c, g, or t
  misc_feature (819)..(819): n is a, c, g, or t
  misc_feature (821)..(821): n is a, c, g, or t
  misc_feature (836)..(836): n is a, c, g, or t
  misc_feature (854)..(854): n is a, c, g, or t
ncaggagaatcctgacctttcctccctcatttccttttggcaacagcacatatatttgaaaggtttcgtgacttccataccacacctgggtcaaattatctattaagatttatgtattcacgtgggcaccatcaganagatanattccaggtgtcaganagaaagtacaatcttgatcatatcttcatccaanattcatcaaccgttccagtgagaganaccatgctaggggataattgtttagagaacattcaattcatgcntaatgtaagaaacnctaattganacttctgaattaagcagacttctgagagtgcatacagatgatctcatgtggtacctacagaaataattctactgaactaaactttgatatcttgccatcagcctatattgaaggaagccattaaaaacagctatgaaactcgtcattggttacaaagtggatgttgataaagctgagcaaatgattttgctttgtacaaatctttaggaatactatcaagatacagatactatctttatatttgataattaatattatcattatatatgattaatagaactttaagatgttatagttatgagtacaatctattaagtataaaaatctatcataataaatatgtcacattatatataataaatataagtatgtactatataataaaattntataanntatntnntctnttatatngtnaaatgtnanggttaatgttattaattcaaggctacatttatttctctagagnaataattcttttttatgatatagaantnggnattatggnactatcctgtgttcttttnncagtntnctagatagcttagancaggatgattatgaaatnatatatacatgaccaattcacactgagcagcttctatatattgaa

SEQ ID NO: 546709 - DNA, 982 bp, Homo sapiens
cattaagacagtatggtctcctgaactgttatgaatctaaaaacatggtctatcctaatggtgaccgctagtgaagcgattgagaaattgttacgaaattgtgagcaatcttgttattcaggtgtagaagagcactaagatatctcataaatatgcaagctcagaatgtagaagatagtaagggaagatactcggagaacgttgatgattcatgtagttataagtattaatttttagaaagacgatactctagagggataaatattctattgaacctcgcaaggaactatatacttttctatgttgaattccattcattctcagcagctttagtaagaagatgtagcagtatatcccatagtgcattcttataaacagttattaaaccgctttcactaattctgaactgggcgagtataggaaagaaagactatggttcatattatactttggaacatagatgggaaattcttttgataaatatactcagctgaattgaaatccaagctagcatatctttgagcgtaattgctatgattgacttagtgttgtatgagtgctaagatacttcagagattacgagaatgactaaaagttcggcatgtagcaggttcataccgatgaccatagtcatatatttcaccttagggctaaatagagcatgcagtcccattgagcctcttgtgatccttacgagtattttcaaacttacgtagcaacctcttcggacgcatgataagtgtcacgcaatatgcgatacctgccataatccccgagacaagtgtcttttcaagacgtgtcttgaaaatgcctaggaagtattacgttacgtaccacacgcaaaagcacccaaggacatattgaatcggatactccttgtggcaatcaccctagtgaacccccagtggagaccggctaactccgcgcattagccatttctcgcctgtccgccaaactgcgaaatacccaaaccaaaaaaccc

SEQ ID NO: 546710 - DNA, 393 bp, Homo sapiens
agccggctccaaaaaacgaggacaataatatctacctcaaacactgttgggtaggaaaggggtttgtaaacaagtaacacaaaatagatacattagcgtctgggtcagatggctcacgctctattatctgctgatggctcacgccctgttatcccaagtgctctgggaaggttgaggcaggcgtatcactatgattgagctcagaacgtttgagaccaatctaggcaacatggtaaaaccccatgtttactaaacatactaaaattagcccacacatggtggcacacacctgtgttcctagctactccggaggctgaggcgagacaatcaccctagcttaggatgtcaatgctggagaccggctaggaataattgaattggaccgcggttcta

SEQ ID NO: 546711 - DNA, 158 bp, Homo sapiens
  misc_feature (2)..(2): n is a, c, g, or t
  misc_feature (114)..(114): n is a, c, g, or t
gngtgcgcccgggccgcggatccccaagcccgccacgccgcccagcccggccccgcccgcgccggaagagccacgccggccctgggcagtgacggggttcgggtgaccatgganagtgcgctcaccgcccgtgaccgggtgggggtgcaggatttcgt

SEQ ID NO: 546712 - DNA, 302 bp, Homo sapiens
gagcccagtatggggtgcattcagggtagatcaggaggtatgagtgggcagtgggcgagccatgctgggtgttgcgtgaccagaacacttttgcctccaaaagctggcgcgtgagaccccggctatccgccaccaagatgagttgcggtctttaggggcgttgtccccacctttgcaccccatagttctttccattcaccttttttcctgcttgcagacatgcacctagatgggcatagggatggggtgagttcgagggagagtgaggtggtatcctgttctgtttaacctgctgattttct

SEQ ID NO: 546713 - DNA, 940 bp, Homo sapiens
  misc_feature (262)..(262): n is a, c, g, or t
  misc_feature (265)..(265): n is a, c, g, or t
  misc_feature (290)..(290): n is a, c, g, or t
  misc_feature (303)..(305): n is a, c, g, or t
  misc_feature (310)..(310): n is a, c, g, or t
  misc_feature (334)..(334): n is a, c, g, or t
  misc_feature (336)..(336): n is a, c, g, or t
  misc_feature (338)..(339): n is a, c, g, or t
  misc_feature (346)..(346): n is a, c, g, or t
  misc_feature (364)..(364): n is a, c, g, or t
  misc_feature (366)..(366): n is a, c, g, or t
  misc_feature (381)..(381): n is a, c, g, or t
  misc_feature (397)..(397): n is a, c, g, or t
  misc_feature (403)..(404): n is a, c, g, or t
  misc_feature (425)..(425): n is a, c, g, or t
  misc_feature (431)..(431): n is a, c, g, or t
  misc_feature (434)..(434): n is a, c, g, or t
  misc_feature (457)..(457): n is a, c, g, or t
  misc_feature (471)..(471): n is a, c, g, or t
  misc_feature (479)..(480): n is a, c, g, or t
  misc_feature (489)..(489): n is a, c, g, or t
  misc_feature (495)..(495): n is a, c, g, or t
  misc_feature (501)..(501): n is a, c, g, or t
  misc_feature (507)..(507): n is a, c, g, or t
  misc_feature (518)..(518): n is a, c, g, or t
tagacaaagatgaattcgcccctggatcctccctcaagattatgatcacgcacaggctgagaccaggcatctgctatatgaatcagacagaaacaaggatgagaagcttactaaagagcaaatattggagaactggaacatgtttgttggaacccaagctacccattacggggaagatctcaccacaactcatgatgagctttgatagacactcaccagaatatggcagactgtcataggcattctgttattgtcttggatngtngctacaattgtctaatttacagcanttgtgatcccacnnnaagcnagtttatacctcagatggggtatnananntgttttncgctcagtatttactgcnanaatggacatcactantctttcagtaagattnctctcnnaacacgtgaaaaccttggtanattgcnatnctttctggggatatatggtacancatgacttaaaacntttttttnntctattaanacttanaggggnacaaanattgaaaaagncgttcttcagaaggtgagtgggttgcgggaggcagtattatgaagtgactgctgtgtattttaactaccagatttttgatatttggccactgttaaatagtcggacaaggggaagattcggattaggcgaaagttggtatcatcctaggtaagcttatggtcagaccagtctaatatttcagattgcttcactttacagacttatactctgagttgtgacttactgtaagttgggtgtttatgaaacctcccatgcatttccagtatggatctgctgagtatgcacagtaaatcccatgtcttcgttgtttcccatttaccaagcatcaagaagggactctctggaacacaccgacggtttcgaggtggcaaagatgcatgtcgctttgacaactcttgttaatgttaccttatttcctgga

SEQ ID NO: 546714 - DNA, 151 bp, Homo sapiens
gtaactcttcatgcataaactgaaagagccatgctgtctagtctgagtcctcatttaacagaggtcaagcaataggcgcctggcagtgtcaagcctgaaaccagcataccctcatgtttcagccagcccaggccctagttacaacactttg

SEQ ID NO: 546715 - DNA, 766 bp, Homo sapiens
gcagacagtgattaccgggcaatgtgcataggagaaagcagaaggagtggtaggcccaattcttcattgtgtagtctccatgtgcacagcagcagcctcacaagaagaggaacagtggtccctttgtagtgtcacttgaggggtcttcaccctaaaccatcttcccaaataacttcctcagatgccggaaattttatttcaacacaaatagccctggaagaaattctatgctgatgtcttttaggtagaaagactcacagccgtggcagtagataagggttctaatataggtgtcattaccactttctagctgcacaatctagggcaagttaaccaacactttcaaccttagtgctttggatgtttctaaatccataaaatagagatttgaagtcctacctctcaaagtcctctcaaagtcattgcaaggtttacactagacaccatatgcaaagggttacaaagttggtgcttaaggaaaagaaagggggcatgagtggggagatgacaattagcttagctttgatggtcaagcctcccatgattagattcatcaaattcaaatctggaattctgtgtaatttttgcacaagcacgtaccttctctgtgctttgttcttcatctgtgaataggactactatggtacatttctgaaacttattatataggggcagcatatcataaggccatggcaaaatttgggccaagaaaatgagcccttgagagaaggcgcgggttagttttccggaacagggggttcccaaa

SEQ ID NO: 546716 - DNA, 197 bp, Homo sapiens
  misc_feature (72)..(72): n is a, c, g, or t
gtaatgagttcttaaatggccatgtaagaagtatgctgggggcgtggctgagtacagagcctcagagggtanagacagtggaggtccttttataggagatgtggacataccatccgagacatctaggggggatcgctctacgtgtacctatgtgggagcagttatctcaagagttgagcaaggagcaacagtctgag

SEQ ID NO: 546717 - DNA, 794 bp, Homo sapiens
taaaaatcaaaccctttttttaaattttctttttataaaaaaccttatacaaaacttttcccccccccaaaattgtgtgggaagcgagtgaccaaagcgcggtgtaaatcctatttaccctctcgtaagcggggattcagtatctcctctatcaacaccctcaacaatattgtctgaagagacccaccagcaagcgacaccccacacacgcgtggggcaacaaaagtcaccacgcgcggtgtgagtgggacccaccagctgcggcgatctttgagcacaacagagagtgtgtggtacgagaccgcgcacagactcttctctctaagcacagcgacgaggacagccctctaagacgcacgcagaggagagagacagagagacgagcacacacccccgagaagagatgtgaggacaccacgcggcgatgcatcacttatagaagagatgatctctcctagacaaaacaccatcatcagccgcggagatgtgcagaacaagcaggggggcgcacaacaaaccaggaagacgcgctgcgggtggcgcggcctacaaccacaatgtgtggaagagagagcagacaacacagatgtgcgcgggtgtctcctcgtatcaccacttctctctccttctctctctcccgagaggagacacagagagggcgtgatacaaacaaagagttgcgacgagggagcccgaccaacaatctccagaagagcggcgagtgtgtaggtgcagacgcgcgtatgctaccacctttcagagcgagggactatctgcggagagagagagtaata

SEQ ID NO: 546718 - DNA, 147 bp, Homo sapiens
  misc_feature (18)..(18): n is a, c, g, or t
ttagaggatcccctacangccaaggcgattcttcatcttggtcagcaccatggacgagatctcctcggggtagaatgccttggtcctccccgcttgtatgctcaccgtgcaccttgtgccttgtctccgtctgttgatcaccgtgga

SEQ ID NO: 546719 - DNA, 432 bp, Homo sapiens
ccgtatgggtctcagaagaattaatctattcacgctcgtaggaattctataatccacatctctgatcagacctaaactccaaagacccattgtgtttatcatagatcttccatctatgagtgtgatagctagtcagtcctttataatgcataaaccccatttattaaccctacatcctcaagtaagcaggcctgttttcagaactaaacagctgtcctcttacatcagaacatcttagttatctgacagaccattcatcacaagtgtttcctaattttcttctgagaacatcaccaatcccactaatgcaaactctgaacattacttcagtcaaatttcgctaaatgctatagctttcttcaaatgaaaattagccagaataatatctttgaacagattttttttttcattgtggattccaggatactttta

SEQ ID NO: 546720 - DNA, 161 bp, Homo sapiens
  misc_feature (3)..(3): n is a, c, g, or t
ggncgtgttccgtaggctgaggatccggaattgcggtgacattttccttgggctcatggccacggctccgatctggcattgctgcctttctatggtctgaagtcatgttctcatgccagcccctgggaggctgcgagggttaatatccccttcgcgcagac

SEQ ID NO: 546721 - DNA, 136 bp, Homo sapiens
  misc_feature (11)..(11): n is a, c, g, or t
agggcacaatntacacagctagtggtatggctgacagtggtgcttcaggaagcacttctgtcctccagctcagcttccctgggcataccaagatctacagaaaaaggatgtatgcgtgcatgtcctggacgctacc

SEQ ID NO: 546722 - DNA, 355 bp, Homo sapiens
ggcaaaacgcatccatttctctcaggctcgtgttgtgcacaccagtcagccatttcacaataggttcctcaaatggttgcagttaactcatcagcaacacatgttttggcaaatccagtcactccattcactaatttcacatgttcttcaaatgaccactcctgaagatactaagcaagcgcactcaacaccaaggctttgaaattttcttctcccaaacctttaaacctataagcaccttcattcgtgtgtgcatctccacgaaacacacctgtgaataacgccgagctagagagaaagaggagggatatagagtgttacacttctcagtgtgacaaacgcgtgtggggttccc

SEQ ID NO: 546723 - DNA, 339 bp, Homo sapiens
  misc_feature (2)..(2): n is a, c, g, or t
  misc_feature (86)..(86): n is a, c, g, or t
  misc_feature (169)..(169): n is a, c, g, or t
  misc_feature (172)..(172): n is a, c, g, or t
  misc_feature (176)..(177): n is a, c, g, or t
  misc_feature (185)..(185): n is a, c, g, or t
  misc_feature (199)..(200): n is a, c, g, or t
  misc_feature (239)..(239): n is a, c, g, or t
  misc_feature (291)..(291): n is a, c, g, or t
  misc_feature (294)..(294): n is a, c, g, or t
  misc_feature (298)..(299): n is a, c, g, or t
  misc_feature (301)..(301): n is a, c, g, or t
  misc_feature (303)..(305): n is a, c, g, or t
  misc_feature (307)..(307): n is a, c, g, or t
  misc_feature (310)..(310): n is a, c, g, or t
  misc_feature (315)..(319): n is a, c, g, or t
  misc_feature (326)..(326): n is a, c, g, or t
  misc_feature (328)..(328): n is a, c, g, or t
  misc_feature (337)..(337): n is a, c, g, or t
anatatttaaaaatcgacattataacattaaacatattttatttttatttatcaatgataccttaataaagctaaggccgaaggcnagtatttctctaactatctttacaaaatacaattcatccattaacaaatcacagtaaattaggaagaataaaacttacatttnggnaaanncctatgcnatatttctgagagnntcttccaaatcctattaaaaacatctttaaatatatttntctcagcttcttcccttatattttttatttttttcatcatattttaattttngtnattnnantnnntnctncttgnnnnnctcgggntncgggttggngg

SEQ ID NO: 546724 - DNA, 257 bp, Homo sapiens
gttatcagacgactcgtatatcagtacatgctgagtccactaccgtcctgtgtgtgatatttgttcccctacaaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 546725 - DNA, 159 bp, Homo sapiens
actaaccaaaagatacagtgatatagccatgtactgtgtgagtgggacagatacagtctcctggcctataatgagaccactaggactttatacagttttccttaattggttgacatataaatggtaaattatatttaggcttatcctgtattgaaatga

SEQ ID NO: 546726 - DNA, 302 bp, Homo sapiens
aattcaagcctggtgcattactgggccaaacagtgcatttcctacaacaagtgaaatagggctgggcacgtggatcacgaggtcaagagatcaagaccatcctggccaacatggtgaaaccccgtctttactaaaaatacaaaaattagctgggcgtggtggcacgcacctgtagtcccagctacttggaaggctgaggcaggagaattgcttgaacccaggaggcggaggttgcagtgaactgagattgcgccattgcactccagcctgggcaacagagcgagattccgtctcaaaaaaaa

SEQ ID NO: 546727 - DNA, 889 bp, Homo sapiens
  misc_feature (219)..(219): n is a, c, g, or t
ttctctcgccacggggacttgggtagcgcgtcgtagttggcgcggtgaacgtgcgcgtgttgtcgcgcggtccattatcaaggccccctgtgaaacttgaccggggggtccccgggactccgtgggccaccggcccgcttttgcgaaactggacccctctcggccagcgcccggaccccggcttatttccccggagcgtgtccccaataatggacgtgnaaaaagctcgggggtacaccacttcgcgcgttcgtacttggaccgcaccccccccttcgctgtatgtattgccgcgcacacctctttcgggcgactgccgtggcccacacaacggcttttcttcaaggagcccccagaaaaatggcgttattctggactcttaacacctctcaagtttctcccccgatcgtttggggcattcctcccttgtaacgccgtgccaccatttcacaaacaaaattgcgagggcacacttccgctaaagcacattacgcccgccgtcctaaatatgcgcctgcccgcaaagtcactaattccagccatggtttctcccgcatgaacctttcccctttgctgacgcactatctagcgctttgtcgacaaaactccgttctcttctaggcgagtatatcaagggtcgaaattttgatacgacgtctttacaggcgtctcaagatggacaggccgcccccattggggggccgacatcaatgcctgttcaggtggatggctcagtcccacgaggaacgcgcagtcccatagacgccccttatctcaacaattggtgtgacccggaataatgcaaaaaatttaagctggcgaacccctggaaagcagaccctttaatgcatcgcttataaaataaacaaccccccacgcccccccgaca

SEQ ID NO: 546728 - DNA, 401 bp, Homo sapiens
  misc_feature (6)..(6): n is a, c, g, or t
  misc_feature (15)..(15): n is a, c, g, or t
  misc_feature (47)..(47): n is a, c, g, or t
ataaanccccacatncttatggcccacctcactttcaacaaaggccntcaagaaccatacattggcaaaaggatagtcctctttaataaatgcctgcctaggaaaacctagccatatgtagaagaatgaaattccccgtctctcacccatatacaaaaatcaaccctaaatgtggctgggcatggtgactcatgcctgtaatcccagcactttgggaagtcaaggcgggcggatcacctgagatcaagagttcaagactagctgggcgaacatggtgaaacatggtggcacacacctgtaatctcagatacttgggaggctgaagcaggagaatcacttgaacccaggaggcagagtttgcagtgagctgagaacacaccattgcgctccagtcggtgtga

SEQ ID NO: 546729 - DNA, 481 bp, Homo sapiens
gtcgacaccaaaaacattagacagagctgggtgtggtggctcatgcttgtaatcccagcactttgggaggccaaggcaggtggatcacctgaggccaggagtttgagaccagactggccatcatggcaaaaccccgtctctactgaaaatacaaaaatcagctgggcatgatggtgtgtgcctataatcccagctactcaggaggctgagacaggacaatcgcttgagcccaggaggtggaggttgcagtgagctgagattgcaccattgcactccagcctgggtgacagagtgagactccgtctcaaaaaataaacaaaaaaaaagctctttaaaggaaacgtgcccggcacggtggctcacgcctgtaatcctagcactttgggaggctgaggcaggtggatcacctgaggtccggagttcgagaccagcctgaccaacatggagaaaccccgtctctactaaaaatacaaaaattagc

SEQ ID NO: 546730 - DNA, 92 bp, Homo sapiens
cgctcccaacagtgtatttatgggtgtcatattatacaatatttcaatggtgacttcacatagaaaacattcaattataatgtttgactatt

SEQ ID NO: 546731 - DNA, 197 bp, Homo sapiens
acctggcgtctagggcatcagtttcatcacaacaattatcattatgaaaccccctaccataacccactaccaaacgcccctcttcgtctgatccgtcctagtcacagcattcctacttctcctatctctcccagtcctagctgctgccttcattatactactaacagaccgcaacctcaacaccaccttcttcgacc

SEQ ID NO: 546732 - DNA, 203 bp, Homo sapiens
aaaagttccctaaatggttacgtattatcaagacggataagtatatatcatgtatatctaatatccatacgagttatgatgtgtaagtctaatatacgtgagctaggtagtctacggggtctagtatcttatgaaagggcagaggcatcttgagagcaaggcacaagatatgtgatagcgggtacgagctcgaatcgaatcat

SEQ ID NO: 546733 - DNA, 287 bp, Homo sapiens
gtaaaaattttccaaaaaccctgaatttttaaccctgttatatttcagaaaaagggggggctttttcttttcaggtctttgatcgggttttattccggtaattcaccccccctattttggtagggggggggaaaaaaatggggtttttgtccaaacatgtttcccagtgggttgttattttggaaaaaatgaggggagggagtttggcaaaaatggagaaaatgaatgaagaaggcctaatttctttttttttcagtgaataaatggaaccccatttttggatttta

SEQ ID NO: 546734 - DNA, 294 bp, Homo sapiens
aaactctagacgtgacagacacgaaattcagccctctctttagtttatgaaaatttttttccatatcactttaatcattacctcttccgtcttttctctttctcctttctggaactcttcttacgactgtatgttaggtttccttgatccattcaaggctcttctcttttcctatcacgactttcatcgttttgtatttttacttcgtgctttgaaatttcattaacttgatcttttataccgccagttagcatcgatcttctacttgacctaccgaattattcagcttgagaa

SEQ ID NO: 546735 - DNA, 183 bp, Homo sapiens
ggaaggaggggggcctttgcccaattaagggcggggtttggggggggcccaacccgggcttaaaaagggccagggcgccggaccctggaattccgggggggaattggaaaatttttttttttttttccctttaggtttggggaattttttggttttttcccccggaagggcccccccttttta

SEQ ID NO: 546736 - DNA, 445 bp, Homo sapiens
ttgctgcctgactggtctgactctaaggatccccaaggactctggtacacaggggctgtgatgggtatgatagtgtggttggagacacggatttcttcctgaacaaagtctcctccacctacatagtgaacatggtatgatacggtgcttcagtattcttcctcttgaacccccgatggctgcctgccgccgtcatgtaggacaggatgtccatcttgtaagttactgaccgtggaccggtgtgtgccatcgcatgatgtgtataccatctggtcccaccaggaacttctccaagtttcagcggatttcgttggatcgtacatagccttttccgagaagaggcggtcagatgtacccaggagctccgaggtgggaggacaggagttctttaggaaagtgtcgaatttctgctctttctctccattgacatccccttttccagagc

SEQ ID NO: 546737 - DNA, 1763 bp, Homo sapiens
gtcgcacgtggctggctgacgcggcccgtcacgctggatcatcctggcgtccgcactccgacgagctgggttatcaggctcgacgcgaggcgatgatcgaaaccctcgccgacgcgttggaggctcacgtcgatgtcgatcggatactgcacctggcgcgttgatctgttggttgaggatcttttcctacttggccatcttgttctcagatgacctggtccatgctgtgagcgtgcaagaacagcacggcggccaaagagacccggtattcggtgcggcgatgtgttcctcgctaccgcagcattaggtgtgtgtgatgtctcgtctcagctatgctcgatatgcgatcgagcgatgagcaatccggtgagattccggagcggtcccgccactgtgagacacccccatgcggtgcagccagacgctctgcccgattcctgccgaacagaccgtcaggcgagggtacctgaggagaaccacatgaacgatgccacgtcacgcacccttttcggagtgggggtcggcccgggtgacccggaactggtcaccgtgaaaaccgtacgcatcttgcgcgaggcagacgtgatcctcgttccctacaccgaggccaccactgatggtccggggcgtgccgagagcatcatcacggctgtcgttcccgaaatcaccgggcgtatcagacgcatccccttctcaatgcgggagaggtccggtgtcggtgaaaagcgcaaggcctcctggcaggtctcctccgacgccgtggtgacagccttcgatgagggagcccgtaccgtcgccctcgccaccgtcggtgatccgactgttttctctaccttcacctatctgcgtgccaacgtcgaggagaggctgcccgacgtcaccgtcgagttgagccctggcattaccgccatgcaggccctatcggctgcgtccgggcgtccactcgtcgagggcaaggagatcctggccctcgtcccggctaccgtcggcatcaacaagcttgggcaggtcctcgacctcgttgactcggttgcgatctacaagggcggacgtaaactccccgacgtcgtcgagcagttgcgcagccgggaccgtcaggctgtcatcggcaccgacgtcaccttgacatctgagcagatcatcacccttgacgaggtggctgacgcgcagactctgccgtatttctcgaccgtcttgaccactccggagcgcaccaccacaggagggaaactgtgaacgaacctcaggccgcacgacccacccagcatgtgtctgagaaggctctggaggatttagaccacaacgccatcgagccgccgccggtgtcccgtcatgacatccccgaaggagctggcaaggtcgttttcgttggagctggtccgggtgccccagacttggtgagtgtgcgtggtgctcggattattgagaccgccgacatcatcatctgggcttccagcctggtacatcccgacatggttgcccgtcacaaggagggcgctgagcttatcgattccgcctccatccccttggaggaccttgaacccctctacacccgcgcccgcgacgagggtctggtggtggccagggtccacaccggtgacccgtccatctacggggctaccgcagaacagcgtgacctgtgtcgtcgtattggtattgacttcgagaccattcctggcatctctgctttctcggctgccgctgctcggatggacgtcgagatcactgtcccggaagtctctcagtcactcatcctcacccgg

SEQ ID NO: 546738 - DNA, 954 bp, Homo sapiens
acatcgcaacccatacgaggaggtaaattagagaaacctccaggtggtacgtgtctacggcaccatgatcatgctgtccctatctggggatctgcccttctccttgggatactaggaataaaaagggtgggggttgtctacgaagaaagcatctcgccgcgtagaaacgttatccatgtccgggaaagattctgtgtttatctctcagattgcttcattggggaaagaggacgggtcctcaaagaaaagtatcccaaatcgggtctcccttcgggcgaattgtgacacaagggggggggggcttatttaaaactctgcagcaaacagtaccgtggactcaaacccggggggagaaacaccctccatcgtccctcgggacaggcgcgcgacacgaccttccaattatggacggtaaagaattaaatatcgaccggacgcgaaaaaaacaaacaatgagctcctccgccccagcgggtgaggtctcacgtctgctccctttagttggggtgatttgcagattccacagtcttgactcagtcggctccggacgtgaggacgtgttagcgccgcccgctctcgccatgggcgaaccgcgcgattccgccactccggagaggcctccgacgtgaaggtgggaatcagcgtgggcccgcgtagaaacctaaagggcctaatggcggcatagcaccacgccgtacccgactggaggagacagcgagcaggcgccgaagtggtaaagaggacgggcgggaagaggaacagccatcgtatccatttaatacacctgcgacgacgcgatctctcatcatgcttgcagagacggtcagccccgccttaccgggtagcgtctgtgccgaccaccgcccaggcggggtagtcgcctcggaagcactaactctatgcagagcacttcgatgtcggggagccaaatacgtatgatccaccgcacgcgag

SEQ ID NO: 546739 - DNA, 972 bp, Homo sapiens
ctgggcccagtccttggcagccggttgtgggtgttcacctggccgtccccagtatgtcgccccgccgtgccattgtgggtagcactcttagtgggctcctagatcaatggccatggtgggctggcccgtagtattagatggtcgcacttgggtcggcccatatgagtctgcttgcggctgcggcgccacttagcaggttggtgtccgcacatgtttgccccctattgtgtggtggggcctcaacctgcccactgtgcatgtgcgtgctgctgctgccgcgcgcaggtttgggcgggtggggggttacttccccggtgtgtggaggtgcaccggggttggagcgccgcccggtcttctacgataagtaggtctgcgcaacccgattcgccgacaacaatggtgggaacgagattctgttgcaactggcaattgtctgcaaggcgcagtctgcggcccgtcacggagaatgtatctcaaggggggatagtttgccgcccctcccaggtagaacaggagatcggtgcaccaaccacccggaggttatagaagagaatctgtcgcgggttctttttgacccccgcggtgcgaaccaatttagcggtcagaatagagtgctccgtattgcaccccggtggtactcacaatggggcagaatatttcgccaagcacaattgttcagcagtcgtacgttgaggatcacgtggaacacacagtggactattgtatcaaatacacagctgcgacggtcctagattagtggggcagctcacgcttattgacgtgtgcccccgccatatgtttgttcctcgtcccgacaaaacacgctggtacagagccctttctcttcgtagtggagtttcctttctcacctgtggtatacctcctctggggagcccacaggagaccttcttgtgaccagggatttgaatcaacaatggggttttccggaacccccccaaatgtcacacacat

SEQ ID NO: 546740 - DNA, 259 bp, Homo sapiens
  misc_feature (33)..(33): n is a, c, g, or t
ctcaacgctttatacttcataggacctgagatnggttttcatattcagtagttaataagtacatattagtttattactcatgatatgggatacttatatagccatctaaaaaatgaaaataaataaagttggattcctattttactcctaacataaaaacaaatctcaatagatcaaagaccccaacataaaaaagagaagacacaaataactagaaaaaatttaacatgagaagtataaagcgttgaggggtaccgag

SEQ ID NO: 546741 - DNA, 358 bp, Homo sapiens
gtgtgccatcacatctttataatttttgtatttttgtagagacggggtttcaccatgttggtcaagctggtcttgaactcctggcctcatgtgatctgcccactttggcctcccaagtgctgggattaaaggcatgagccactacacctggccaaccaaaaaaaaaaaaaaaaagaagaaattgttttttaaattaactaggcctagtgcacatgcctgtagtcctaactactgagaggctgaggctggaggattgcttgaactcaagagttcaagttcaatgctgcagtgagccatgattgcccacttgcactccaacctgggcaacaagagcaaaactccgtctcgaaaaaaaaaa

SEQ ID NO: 546742 - DNA, 813 bp, Homo sapiens
  misc_feature (199)..(199): n is a, c, g, or t
  misc_feature (291)..(291): n is a, c, g, or t
  misc_feature (316)..(316): n is a, c, g, or t
  misc_feature (347)..(347): n is a, c, g, or t
  misc_feature (420)..(420): n is a, c, g, or t
  misc_feature (537)..(537): n is a, c, g, or t
  misc_feature (556)..(556): n is a, c, g, or t
cggggggcgggctcgggggggaggctggagcatagctcttctctctggcagcttctcttctatttggaggatgaagcaccatcagactggctaaggaatccgggtgagggacccggaatagaattgtggctggaatctcctcggttgaagcccctgggcacaaagtggtgcctggcaggaacttcactctgggccaggnccacagaatggggtaccaagggctcctggaaactcactcgaatggtactcacgtgggcagaagcggcgccggcctgtgctggatgggtgaancaatgggccgtctttctggccacancggcaggtggccctggacgggtatctcaaancaccttcgcgacactgggccctctcagagaaagggctgtggaaggtcttccgcaatctacggggggctggtantttcctggcaggtatgaagcttttgggcccacattctaaatggccacaggcccggaacacgggtgaattgaatgtacatatggccaaacttctcaagaacgggtcgcgttatagaancacattctttggggtaggnctctggtaacgggtcaggttgggcagaaggtacgaatgaaactcgctggaaattctctggcgaatcggccaaagaaagtggctttgggggcgggccaggtgggcccggcattgggatccctttggatcccagaattcctaccggctaactctctgggtgccccttggaaggcctggacttccggaataacacggtgatggacctcaccatgggcctaagttgggggatgacaggccggccagggggcccggaggggc

SEQ ID NO: 546743 - DNA, 123 bp, Homo sapiens
agaaaaaaattattctctcacaaaaaataaatacatttagataaaactgcataccatcttgagatagtcacaagattcacttgttgctattttgagccttgactgcccacgagggtagcctca

SEQ ID NO: 546744 - DNA, 1054 bp, Homo sapiens
gggtgtgccgtctcagccccatttctgagaacaggtgaatggcagaacagccctgggcttggcccaggcagctctctgtgtcgcgcccttagagcctctgccgccctcagttccgtcctgctcttggcaaattgccagaccctttcagaaatggccgaagccctgaagcctctcctcacatctgcgagctcccaagaatacagactccgaattataaggcatgcttcgtcttatcgtggtggtggtggttgttaagtttcaggacattgagaagaatcattgctccgaccaaataaatgaggataggaaagataaaatacaggggtggcgtcgagttaataatattctcgctttagaggggcgccaaatagttatcgtgatgctcgcgctagtctttctcttggatgaaagtgggtggcgccactatgatgtggcgcggtgatattatcacacagatttaaggcgcagttgccccggtttgattcaatacatggcggcaaatacgggaggacaagaacgtggaataacatcggggatatcttccagaggaaagaagcgaagcaccatgacacattaggtgggaggcgcgtgccgaacatgtaggggcgaccaaattccaccgtatcggaagaattttattacgtgcggcctgaaaggtgcatcgtacttacacaagattacctaaaagcgggtatcaaggtgtttgcgtttaaactttccttggagaatgtgttgttgcgtcccgggaacgtacaaaagtatgggggataaaggaggaggggttgaagccctgacgtgacaagcttgtgtagccacgccagggaggacgtggcagagaaaaaacaacgggcacaagacacgaatcacaggatcaagagcggaaaccttgagaggcgtcgagaagggaacaacctttcactcaccaagcaacgcgaggcacagccccgtaacccacagggcccgtacctacccaccaaaggttgccacgtaatcatcccattgaggacaaccacaaaagggaacaagtacatagcccccatgggatggagacccc

SEQ ID NO: 546745 - DNA, 669 bp, Homo sapiens
  misc_feature (14)..(14): n is a, c, g, or t
  misc_feature (38)..(38): n is a, c, g, or t
  misc_feature (41)..(41): n is a, c, g, or t
  misc_feature (94)..(94): n is a, c, g, or t
  misc_feature (504)..(504): n is a, c, g, or t
  misc_feature (551)..(551): n is a, c, g, or t
ctttcctgagggantagtgcccgggaccacaattctcnctnacctgtcgggagggaccatctactgcgctgatcgccctttacatggcttcgcngcccaaaaacaaatgggttaggctgcagaggactggtttggtttttggctttacccccttgaagtccctttttttgggggaggggaactcccccgggcccccccggtggaagaaccccctggcgtggtcttttgggggggttgtttttcctttttccccttctgttttgtgttcggtttttctttggccgtggttccttcgcctgtcgcctccccccgctccgccgcttcgccgcttctttctctgtttctctgcttcttgtctccctctttgcccccgttgtggtgttcggtcctctgtccttttccctggtcccctgtccttctttttccttcctccgttctctgtcgtcctccccctcctcctcccgtcgttctcgctttcttctttccttcttgttctctcgcctnttctccgcgacccccgttgccctgttcctcgctgcggtcgttctgtngttttggtattttccccctctcctttcttcttcgtgcctctctcctcctctcccccgcgcgctcttctccctcatctgcgccccgtcctcttcatccttgttacaaactaacaaaata

SEQ ID NO: 546746 - DNA, 439 bp, Homo sapiens
  misc_feature (18)..(18): n is a, c, g, or t
cttcaacgctgctcacanttgaaacaactctgtaactgcttataaatgataaggggggggagtgtgcattgtgttttgatgtgtgtggtgtggatgtgctgtgtgtagtgtgtttttgatataagtgatgagtgtggtgtgtacgtgtgtggtatatgtgagtgtgctgtgtgtatattgtgtggtatggtgtgtatgtgtgtactgtgtggagggtgtggtgggtgaatgtgtatgatgtgcatgtgcatatgtgtagagtgtatgtgtgtggtgtggtgtatgtgtgtgatatgtttgtgtgtggtataggtgtggtgtgtgtacgtgtatttgcggtacggtgtgtatatgtgtggtgagtgtggtgtgtgtgtatgcatttgtatggatgtggtatgtgtggtaggtgtgtagtgtgagcagctgtgggtaccga

SEQ ID NO: 546747 - DNA, 186 bp, Homo sapiens
cgatgttggacatcaaaaatgttctcagtaaatgaccgttgaataaaggaacttgtaagaattcatagaagccgggtgctgtggcttgcgcctgtaatcccagcaccttgggaggatgaagtgggcagatcacgaggtcaggagttccagaccagcctggccaacatggtgaaactctgtctctac

SEQ ID NO: 546748 - DNA, 305 bp, Homo sapiens
actcagacctgtgccccagagtcccctgccgcagaatggccccagccgcccgaccgggtccaggagcactgctcgcctgtacatactgttccctagcccacctggtgccgtgggcgccaccccaggtgactgcacagcccctccccactccgccacgcccccacccaccccgcgtgtttctgccctgtgactcctggaacctgcgtcctccccaaagccctgggagcggctgtcctccccagaccatgccccccgatgattctcttcaaccacgaaacaaatgcaccccgcaaaacacacaacaa

SEQ ID NO: 546749 - DNA, 746 bp, Homo sapiens
tgcagtggctcacgcctgtaatcccagcacttggggaggccgaggcgggcggatcacgaggtcagaagtttgagaccagtctggccaacatggtgaaaccccgtctctactaaaaatacaaaaaaattagttgggcgtggtggcgtgcgcctgtggtcccggctacttgggaggctgaggcaggggaattgcttgaacccgggaggagaaggttgcagtgagccgagatcgccccactgccctccagcctgggcgacagtctcaaaaaaaaaagaaaaaaaaaggcttccatctctgaaggtaaagtataaactcagggggctcaagattggcaggtacagccttgctaatgccttcaataatgcttacgtaccttgtctacatgggttataattttccacatcctcttcagatacaatctgagaaactgtgtgacttaccttggttacatttgcaaacaatttcctatttcaatatggcatcatatcaagggttccatagttacattccagttcttaactctgaattccaagcgtatggcttaaatttccagttcctgggaacccagaacaataaaattcccttaagacatcgtgtcctaatagtgggtcatctacctattcttgggaattacgggaaatggcagtgtacactaattcacagtgagtttacagaccctatacactacacacccaaaggtaccttcagggaaatcggctaacagggcttccccctccctagccctc

SEQ ID NO: 546750 - DNA, 310 bp, Homo sapiens
ctccatgagatttttgttgtcaatctttctggatttcttttctttcttttggtattgagatggagtctcattgtgtctgcccagtgttggatgtgtagttgtgctcaatctcgtgctcattgcaagctctgcctcttgtgtgttcaagccattctcctgcctcagcctcctgagtagccttggctactaatttttgtttttttagtagagacggggtactgcttgtgtaagccatggattggtctcgatctcctgacctcatgatcctgccacctcgacctccctatgtgcttggagttacgggcatgag

SEQ ID NO: 546751 - DNA, 247 bp, Homo sapiens
aagctccccggggacaaaaacagggggcagcagggggacgttttttcttggtccgtgagggatgggggtttggccaaccccttcacgcaaaaaagccttttcctgttcccgggttaattagttggacggccggcaagccccccctccccggggtttttgggttggccgaggatggttgggccggtccccgttttaattctttcccgggcccccgcatgggaattaagcccccccccctgccctggga

SEQ ID NO: 546752 - DNA, 597 bp, Homo sapiens
catgaactgtgtcaattagggaggtatttggctctgagaaatagaaaaaaataacaaacagtggctgaaataattaatgagtatatttatattttacatgaaaagatgtctgttgagaagcctttaatatccagtatatgagcatttttcatcttcctctaccaccaacctttgagctttaaactgaactttggggctacaatatcactgttacaccatttgatattgaaatagtgagagaaaaatagcaacaacaagaagttcctctccaggttctttttttttcttctattttctctggtctctcctctcctttcctctttccttccctttccctcccttccggtcctctttccttcctctcttgttcctttcttcctccctccctcacttccttccttccttccttcctcactcccttcctccttctgtctctccctccttttccttttcctcccttcccttcctttcctttcctccctcttcctccctccctccctttctttcctttttccctttccccttttccttttctttccttccttcttccttccttcctcactcccttccttctttccttttccctcccctttcttt

SEQ ID NO: 546753 - DNA, 606 bp, Homo sapiens
  misc_feature (17)..(17): n is a, c, g, or t
gtaccggttcgcatgtncccaaactgctggattacagtgcatgacacatgcctggttttgtttgttgctagagacagggtctcactctactcacccagtgctggagtgccatgacgctgatcttggctcactgcagccccgacctcccaggttcaagcgattctcctgcctcagcctcctgaggggctgggattgcaggtgtgcgccaccacgcgcgactgatttttgtatttttagtagagatggagttttgccatgttggccaggctggtctcgaattcctgacctcaggtgatctgcctgcctctgcctcccaaagtgctgaggattacaggcaaaagccaccatggccagcccacataaagaaacttctaatcaacaattactgtacaactcatgggaaaatgtgcaagagtcatgaacaaggaattttgcagaaaaaacatatatgggcagtcatcagataaaaaaaaaggtcaacatcagtgttcattagagaaatgcaaatcaaaagcacaatgagataccaatctcatgccagtcagaatggcacttttaacccgtcagaaacacagatgtagggaaacatgggaaccggggatcctc

SEQ ID NO: 546754 - DNA, 488 bp, Homo sapiens
actgtcttacaaggcttcaagctttgctgggctatgtagggcatgttaacaggattcaaaccaggagctgtacagtcttacactgaatgaacgtttacagtataacatgtgtggtaatctgggtattctagaatggacttctgggacacggacaacggatgcccatgtggggattaaggggtttcctgtcgacttaagcaacactaggtctctagcgcacaacattcagccacaagaggttttcatggcacagcagagccgcagagcacattataatttggcacccaaatgaccgaaagcattcttgtgggcccccatgtccctaacatttttaataccttggggcacggcacaaacccaagctctgggcacgacacgggattggtggttgactaacacacgtacggacaagaacaacgggacattcatgtggactggtaatacttgacacctccgattggctaacggccagcgcatagaagtgggta

SEQ ID NO: 546755 - DNA, 459 bp, Homo sapiens
  misc_feature (123)..(123): n is a, c, g, or t
  misc_feature (133)..(134): n is a, c, g, or t
cggacagcttttccccttggcgccttttgcggggcctataacaacagttttttcaacaaaccgggggggccgcggccgggatttcccgggatttttttccccccggggccccccccggggccnaaaaaaaaanntttttttttttgggggggaaaaaaaaaaaagaaaacccccggggggggggtttttttccccccccccgtttcttgggaaggttccccccccccccttttgggggggggggggggttttcccccccccccttttccccccaaacggttttttggggttttttttttttttttaagggggggttccccgaattttattttttttttttttttttttcccccccggggttttttccccgggggggggggtttttgaaaaaaaattttgccccggtttggttttttttcccccccccttcccctaaaagcccttttgggggggggggga

SEQ ID NO: 546756 - DNA, 807 bp, Homo sapiens
ggagaactagtctctgcccaccctgtctgactcggatcccgtgctcctggcccccggtgcggcggactcagacgaagagacagaggtgctttggagtccctcggccacgacccgtttggcctgagcctctgcaaggtcgcccctgcagtggctgatgcagccagcgtctggagtggatggagccgctcggagcatgcgtggcgccgcacaaaagaagcacgcagcgggtgcagagcgcgtatcatatcggtcgaccgacgcgacagcaccaagcagagcactcgtggggccagtcgcaacgaaatcacgaaggctcgttcggccaccacaatggcaaggtcgaggtggcctgggtgcccaaagacccaaggggcgtatgctggcctggggagttgctggactgctgatcatgtcagtgcccggatgtgggcctcagttgcgagagggagtgacgggtcaaacccctgtccatgatgggtcgctcatttccccagtgcgtgtccgacttcggaggtcccggtcgcggggtcagtactccgccgagaccagtgcgccggggatgtccagctggccacagcctcagggatacgcccgtggtgctagctggtatcctgggccatacctgacaccaggcggtgagcaggagcccggctgtgtggggtgacgtgagttcattcgcagactggcgtgcagcgcgcgtctgcatactgtcagtcagtggccaggaccagcgccaaggaggaaaggcatgctggggccgtccgtggatcgcgcgttacttggtccagcaaggcaaggattggggac

SEQ ID NO: 546757 - DNA, 379 bp, Homo sapiens
  misc_feature (79)..(79): n is a, c, g, or t
  misc_feature (368)..(368): n is a, c, g, or t
  misc_feature (372)..(372): n is a, c, g, or t
taatatctccattatgggttttgggttttccatttcccgtaaatggaataaatgggtgatgagccatccttttccctgngcttccttaaacattgtatattttatttggtaaaatgttaattcaaacccattgcccatataaaaattgtgcatatttgtctttttattgttgagttgtaaaagttctttttacatagtagatacaagtctcattctttggcttgtcattttacttagttggtggtattctttgaggtacatagttttgacatttttaatgaagtctaatttatctttttttattttgtcactctgaaaccattttctttttctttttcttttttttcttttaaatgggcgacagaccngagntccgtct

SEQ ID NO: 546758 - DNA, 108 bp, Homo sapiens
gttgcccccccccccgcggtcccccccccccccgggggggggggggggggggggccttccccccgggggttttccccttttaaaaaattaaaatttttttttttggga

SEQ ID NO: 546759 - DNA, 1566 bp, Homo sapiens
cagcgcgggcgttgtcagcgcacgccgcgcgagcgcgcgcggcgcacgcttagccagctggccggacgcgcaccccggcagcgccggctgcgcgcgcgctgccgcgcctgacgcccactggccccgcgctggccgccgcgccctgcacgccccccgtcctaccctggcttgcatactccactgcacacggaccccggccggcgggaactcccaacggcacccaggccagactcactgcgctgggccgcgttccgggcttcccgggcccccaactccacgcccgctgcgccacgacgcctggcaccgggaccgcgcaccccttagcccccgttcgagtccgtgcccccatttacacacgctgcgcactgcaagcccacggcgcctatgcccccacgtgggccctccgtggcctcacggcccagggcaggcccttgggcgagcggggccgagcgacgcgctccttgtcctcctcgcacttgcgccctcgaagcccatccaacccgtgggctgcaacgtgcgccgccggcacacacgggggccccacctgcttgggcccgtctgcccacgccccaccccccctcccgtttccgcgttccgttaccatccgagccgttgtcacaccctccctctgccgccctggctgccctgcctccgcaactgcaacccacttcgaccccacacgcgccacaggcccctgcgggcgggccgtccctctccgtgttcccaggtgcacaagccccgctctccccttaggcacctctgcacttcccaacacgggcaaccaacccttgcgggcacggcgttgtcccccctttagggccccttgtgcgcttgggtgccccccgttgcaccttcccgttttgtagccccgttttccaccgaactcggcgttcccacttcttgggcctgttgcaaccctttctgtccccccccaagcaccccgttaaacgttaacttcgcccgctttggccgttggccccgaaagccgaaggggaaggccgacccaggtttagcttattaacttacgttgggggctcctggaagcggaaggccgttacacaagggccttccgcccccttcctttaggaggcgcgttggctttaacccggattggcttgggggccacaacaaaacttcccctttccggcctttccttccttggcattctcgtggccaaaagttccctttgggggtctcccccttcccagagttagtttcgaacccccaagaggcaacttggcaaggaggaaaaaggggccaaaggggggccaacccaaccggaaaagcgggcccacacctttaaacaggcttagcgtttggctacatatccaagagggatataccccgaagcccccaaaggccaaatatcgcccctttggaggggggttaacaccttagtgttcttccacgttaaagggaagaagaccccgttggggggggggaaaaaaaaccgctttggggttgggggttcggggaaaacacccctaggcgaaatactaatctaggggggggcgcccccctttggtgtatccccgcgtatccgttcccattcccccgagatttcta

SEQ ID NO: 546760 - DNA, 215 bp, Homo sapiens
ctacactccgtgacagctgtcggttgccagtgtccaccttctcacgatacgtggttgccgtaggatggagtgtggaagatttgttatatcctggaaaaagactgatcaagttccagaaataaatgactggaccactgtgtagaaacaagtcaaagccaaagtcatacacgtggctatcacggaaaattattgcttgggaggttgctagggcgggg

SEQ ID NO: 546761 - DNA, 109 bp, Homo sapiens
ccctttaagttcaatagcatcatccaagaaaccccaggcacgcaatctcagctgccccagcagagaactctctcaggattaccatgacccaggagcgccacgaaccgga

SEQ ID NO: 546762 - DNA, 717 bp, Homo sapiens
  misc_feature (359)..(359): n is a, c, g, or t
  misc_feature (435)..(435): n is a, c, g, or t
cgaggacaaccgtgtactattagccatggtcaaacccatcgtgtacttcgagatagccgtcgacaggcgagcccttggggcggtctcctttgagctgtttgcagacaaggtcccaatagatcggcagacaattttcgtgctctgagcactggagagaaaggatctaggttataagggttccatgcgttgctacaggaattaattgccagaggtttcatgtgtcgagggtgcgtgactctcagccactgccatagatggccactggctggcaacggtccatctcatgcgggaggaaatcttcgcatagattgagaatcttcatccctagaagcgataccgagggtccatggacatctctntgatccactggacaagactgcatgagaacccataaacaatcaaaatggattccctatgcttgtggtcaatcttgcnacgtgctcaaggtacgtgatgtgcgtgtaggaagtggccaatgcattgatggttggtttgggactaaaggatggacataggaaagcgctcattgaaactaattctggtgcgaggagacccagtggtaggccgtcgtcctcgggtgttcgcaaggtaaactggggccatggggaactcgattggcaaaggaaaagcatttcaatccgagttctggcgttggaaccatgggttggggaacctaaaggcttgcgggcaaccattataggcttgtctgggaaccct

SEQ ID NO: 546763 - DNA, 183 bp, Homo sapiens
cagtgcaatggatcaaagcaagcagaggaacatggaagggctagactggctaagtcttctggcctccatctttctccattactggatgctacctgccctcgaacatcagactccaagtcttcagcttttggactcttggacctacaccaggtgctctcagaccttcagccacagactaaaggc

SEQ ID NO: 546764 - DNA, 511 bp, Homo sapiens
  misc_feature (511)..(511): n is a, c, g, or t
taccctgggcagaaaaatctaaagggggctctccaaatttgagggggaaggttatacctcccgcagggaagagctgggggtttttaaaccacgcgcacactttttggggtgaatccggccccaagcgcaactggtaaagacttgctaaaagagagattttgtgtgacggctttgtgtcgcacgcttcacgagagtttgacaggtttcgcgggaaaccctgccgcctataggagaggggattcccagacccgggtgttgtttctcccggagggttccctggtgagtggggcatataaaccggcggtggatagtgggggagatggtgggtgcccttacgcgttgcgggtgagggccttttgggaaacaaagcgggaatagccgcgggtgtcgcctgggtcgggggaaattggggcgtggagtggtccgatgcctagtggccagggttggtgcgagggaggggttagagggggagcggggcgatgggaggtagagggtggtcgagggtgatgtn

SEQ ID NO: 546765 - DNA, 426 bp, Homo sapiens
gtaggcagagacatgaacagacacttctcaaaagaagacatacatgcagccagcaaacatgaaaaaaagctcaacatcattgatcattagagaaatgcagccataaaaaggaacaagattatgtccttgcagggatgtggatggagctggaagccgttatccttagcaaactaatgcaggaaaagaaaaccaaacactgcatgctgtcatttataagtggagctgaatgatgagaacacatggccacttcgtggggaacaacacactctggggcctgtcgggggtgtgggggtagagagagtatcaggtgatccgccggctttgacctcccaaagtgctgggattataggcgtgagccactgtgcctggcaaggatcctgactttcaaatgatggccaccatgcattcgagtgtgattctggccgg

SEQ ID NO: 546766 - DNA, 389 bp, Homo sapiens
ccccgactagcccgaaaggaaacagtcacatcctgggcgtggagattcggtgtagtgcattcacgtggcatgtcacgggcttgcctggtactggagacactgtgtgggcggcagggtcagttggctgctcgtggtgtacaggtccccggaggcgtcctggacaggtgagaagttactggcggtcactttctgtccgattgcgctccaggtcacagtgaggtggctcctgggggaaaaagccctggagcatgcatgcgacgaccacgttcccatcttggagggtgctgtcgggctagtcggggatgctgaagagacggtgaccactgtcccttggccccagacatcaaaagcatcaggggtccagccactactatacccggtggtcctcg

SEQ ID NO: 546767 - DNA, 284 bp, Homo sapiens
taaaggtggactccttacttttatatttcaagatttctatttgtatcaatatatgctgcattttctgattgaaattgctgttctgtctaatgaaacttgtgattttctgtagttgctttttacatttgaaagcaaactttcatactgtgtgtgcttaactgtaccccttctgttagggatttgattaaaatactctaaccgtttcattaattcctttttatgtgcttaatgtatgtgacatttatggctttgtcatctcaaaagctatctgtggacaaaatcca

SEQ ID NO: 546768 - DNA, 361 bp, Homo sapiens
  misc_feature (55)..(55): n is a, c, g, or t
aacatgtggtacccacgtttgtgtgggaggactttgtcaactattatgtggcggnccctgtcccgcttaaagacttctagacaatttatggagctaataaatttacaatagatcttcttgttactcaaagctatgcttaggagtggtctctggtcgggagctgagtagagtcagggacaacaagacccttgggcggggggcgtgaacgcttcactgcacggtgccacatggttgtttgctaccaacgaccggcccgcttaggaggctacggtgaagtcaaaaccctctcgtcggctactttctctttggctttgttttacctctttgggaccccctcccccctgccctcccaccacaaacg

SEQ ID NO: 546769 - DNA, 252 bp, Homo sapiens
gtcagcccccggagtagccgggaccacggacacgcaccgccacgacgtcagccccccgagtagccgggaccacggacacgcaccgccacgacgtcagccccccgagtagccgggaccacggacacgcaccgccacgacgtcagccccccgagtagccgggaccacggacacgcaccgccacgacgtcagccccccgagtagccgggaccacggacacgcaccgccacgacgtcagccccccgagtagccggg

SEQ ID NO: 546770 - DNA, 241 bp, Homo sapiens
tggcccaggtgagataggccgcaagaagctcctggctgtcaggctgaggcccgcatgtctaaggccaatgaagcacgcatgcgccgtgaagagcgcctcaggtcgaagaaggaggagatcatcaacgtactttatctaaggagtgaagagaacaagaaataaaacctcccactttgtctgtacatactggcctctgtgattacatagatcagccattaaaataaaacaagccttatctgcg

SEQ ID NO: 546771 - DNA, 173 bp, Homo sapiens
  misc_feature (28)..(28): n is a, c, g, or t
  misc_feature (97)..(97): n is a, c, g, or t
gcgagcactctctggcctatccggatgngctggggtctgccagggtgcgaaactggaatctatgctgaaacactaagtgccaggaggtgccccatgnccaggagtgacacggtcccccagcagcagagcccattctgagccagacaggtcacggttgacccaggaagagccat

SEQ ID NO: 546772 - DNA, 133 bp, Homo sapiens
atgtcgttcctcctcctgtctcttctccctcctcccctctccctcctcctctccttctccctcttctctcctccctgtctccttcctcctcctgtatcttctccctccttccatttccctcctctggccggtg

SEQ ID NO: 546773 - DNA, 738 bp, Homo sapiens
tcaccaggccttccagcgcctgtgttgccatctggtaaaatctgagctgtgccccatgagccttaccacttcctccagtctcctctgtgctgtggctgtgtggagactgacgcctacataaggagccaacgagcaatgatgggtcacgaccagtggaccacggactacagacagtcactgactagacccattgtatcgagacctcctgatgcctcagacctgtgggctttcgtccgcacatggcatacacacgagagggggttaggagataggaggtcatgggggcccgtggcagcgttactcagggttgggagggactctaggctctggtgcctgtccttgaggaccttagcaaatcttgtccccccagatcgcaggcaagggaatggattgcgaaagagagtgctcttctcgacctaacactggagggcacagagcagtggctttgtacggccaggaagtattctcagatacagcgtctacaggatagtgcaagaattccagatacgaatgtgggaattactcaggaggcagacagaagtatctttattatgatcacgagtgctggttccagcaacagatcagaaatgctttaagttcactcgtggggaaagctggactctgaaatcttcaatgcagaatagggatgcagccatggcaagaccttacacggttagaagagaccatcagataataattctgtgagtactccacttccgtctcttcagcagagaacag

SEQ ID NO: 546774 - DNA, 188 bp, Homo sapiens
agtagcggggaccgcaaacgtcaacaccacacccagctaattttttgtatttttagtagagatggggtttcgccagtagtggccaggctgagtcttgcaattcccgacctcagtgtgatcccgcccggcctcgtgcctccacaaaggtgctggagcttacagcacatgcatccacacacacccgagcc

SEQ ID NO: 546775 - DNA, 526 bp, Homo sapiens
agcattttcattggcttagttattgttaatagtgaaagaaaacactttgtgctgcacatactgtatgactgtgactatagaagactgccatcataaagtcctcaaaaactcttaagatgtaatttacaaagataataataacacagaattatttcacttctctgaatgctacacatttgcataccaggactgtgtacaatatactcataatgcacattcataataacaaggacttcttaactctataactacagcataagatctgtgcagtagacaattcatcttaccaagttttacttattggtgtgaaagtgttagtctcagtaagccaggtgttagctgtctacgaagttgaagatcacattaactactacatcaccattgtgagaaaatataatgataaaactgaaaatcgtgtgactttaccagacaataacactactagctagctaagattatatctaagataatgtcaaatgaatatttcaagagttggatgtgataatcatgagcccgtattaccaaa

SEQ ID NO: 546776 - DNA, 202 bp, Homo sapiens
cggtatgtataagcttgattaagcttcatagtacccccccccgtaaaatgtcttaatgctgtactaccattattttaccaactgtgaaagctggctttaattttgaggaggaaaagaaaagcctgcatgtgttctttattaggtatcatttaaaatatacttttttttattttggggaaagggtaggggtataaaaaaatat

SEQ ID NO: 546777 - DNA, 159 bp, Homo sapiens
ctcggctctaccttgtctctcggctctacctgtctctcggctctaccttgtctctcggctctacctgtctcctctatataaatgcgtaggggttttagttaaatgtcctttgaagtatacttgaggagacaaggtagagccgaggggtacggagctcga

SEQ ID NO: 546778 - DNA, 604 bp, Homo sapiens
tttttaatgaaaaaggcagaattaaatgaaattgcaggaagggatggaactcacttagagccattatctatatagtttgccagttgaaataactataaagatgggccattttgtggttggtataagcaacattttggcggtagtcagatattaagcttatgttccccagagagaattcctctgtatttcaatagcccttggtagctattttcattactgacaacattagttatattgcagtgcactttttaggtccatttccacaaattgaacacagggacagcctatttcattcccatattcacagatgggaacaggccaaaatattttattagagttattagggggaaaaaatcccattaagagcacatatgctgctttcataagggtttagatgcaccccagaccaaatgagttataccaattatttccttttcaaaaaccaattagaaccgggttattaaaaccattcccctttattttgtgaaagttagggaaatagattctcctcagttctgaaccattgaccattccaatattgatgtagaaagcatagacctttatttcatttgatagtaaagaataaaccaagctattttgcccc

SEQ ID NO: 546779 - DNA, 173 bp, Homo sapiens
aaccgcagagtagtttttttctctttgaaagatagagattaattacaactacttaaaaatattgttcataggttactcaagatattgcttagcgttcacgttttacacgttatttttaatatgcttaatgattttacagagataaatatagaagacttagaaagagtagcatg

SEQ ID NO: 546780 - DNA, 648 bp, Homo sapiens
  misc_feature (301)..(301): n is a, c, g, or t
cctcggaggcgttcactgcttccagatgaagctggacatctcctcccagcccctggctgccagaaactccttgaagtggacgatggacgcccagcttcgtactttctatgagaagcgtatggccaccacgaagttgctgctgacgctctgggtgaagaatggaagggttatgtggtccgaatcacgtggtgggggacgaccaaacaggtttccccctgaagcaacgggtgtcttgaacccctggccgtgtccgccctgctactgagtaaggggcattcctgttacacgaacccaggagaanctggagaaagaaagagaaaatccgttcggtggttgcacttgtggatgccaatctgagcgttctcccaacttggttattgtaaaaaaaggagagaaggatattcctggactgagctgatactacacgtgcctcgccgccctgggcccccaaagagctagcacgaatccgcccaacttttccatctcttctaaagaagatgatgtccccccgtatgttgtaaggaagcccttataataaagaaggtaagaaacctaggacccaagcaccccagattcagcgtcttgttactccacgtgtcctgcagcaccaacggcggcgtattgcttctgaagaagccgcgtacccca

SEQ ID NO: 546781 - DNA, 590 bp, Homo sapiens
aagatggaggatcggaggggacattttcagatttacaaacctgacaaaatatatctgtaatgtgcctggatcaaagtacctttcttgaataggtagactgcaaggacccatatgtacctggtcacaggtcatcaaaccaacctttcttgtgaaatcatgagcgagatgaagtagagctgggcgtgagttcggagcacctgtcataacaagacactgaggcctaaggttttgcacgtggactttcactccagaaagacgaattgaatgctgcagagcattcaggtaagacagggctcgtgtagaggatccccaattcacatctggttttatgtaggtaacatacctatacagtccaaggactatcacatgagcgatcaatgcagcccaccaaccaatgacgaacatttctatgcaacaaataattgctcccacaagtgatatccacatgttgtagtatttgaatgcaggacgccatcctggagattttgcaagtgatgcatggaatactgaaaaattgatcaatgcatatgatgcaaggaagaagtttgagataatcggtgcaataacattcagttcagcaattaagatga

SEQ ID NO: 546782 - DNA, 155 bp, Homo sapiens
  misc_feature (77)..(78): n is a, c, g, or t
gcagcgcggagcccggctcggccacaccgatcggccgccgccatgggctcctcgcaaagcgtcgagatcccacgacnnggcaccaaggggctaccacggtcctgccgggtacaaggaaattccccagggacacagagcttggtttggagtccttc

SEQ ID NO: 546783 - DNA, 164 bp, Homo sapiens
gatgctttccgattagccgacagctgagttgcggtactcctcgaggccttaatgcaccccagaggtccatctgaagctggagtaccctggggtcagcagcaagagaaagaagaggagatattctgtttgtttttcccctacagccctgtcgggctagtacagga

SEQ ID NO: 546784 - DNA, 1344 bp, Homo sapiens
gtggtcagtattcagctgtttttaagaaggaatagcaagtttaattatatacaaggagacagggcatttcacacacgggggtgacagaatacaaccaggtcagccatcatcacattgggcaaaacaattcgagtgtccatccatgccgaagcagcaaaactccatcagtcacatcacaagtattttcacacaaatcgtctaatcattttatcaaaatctaaataacatagctcaggcacactatgtaaagggcaacagtactcatttagtcatcccaaagcactcgtatcatgtcgaatagtcatggaaaaagagcatgcattattccacacaaaatcaaatccatcaggcaggcacaccagcacacattcggctatactccaagatagcggcaaggcacataccaagcctaggtcaaaggaacacgccaactatataatacttggcacaacattactaacatgagacgttatctaagacggcagacttacaacacactttctagctacccctatgctcacattagcacagatcattggagtagagacttacttcaagataaccgcgtaaaacaattaaaacctacagacaccgtcgatccgggcccctaacatataacaaaaacgaacacattatacaccgtccataaatacacagacaacagtaaccgccagccaagtaaacaagttatctataacttccccagggcataaatacactaggaaaaaagtgtttttaaccaagtgaataatccttgagaggatgtaacgcccgaaaaaaagatgtcccacctattcgtggcgagtaaggcacaataggtacacctctttggcacgcaccagtacccaatacatcccacaacggcacaataaataacaccgaggacaccaggaacgggaccgaaacacctccacacccaacgaagaaaaacagaacgaagacaacagacacacgcaaagcaacaacacgacaaacaacgagaccaatacagaggcgcagaacaagacacgataggacaggaaacaggaaaagccccatgccaaaaacgccacctaaccaacgaaagaaacacacaagaagagtagacacaaccaggcccacacacaagcagaacaaggagcgaaccacccaaagcaaacacacgaaccgcaacacaaacgaaaaacgaaaaagtaacaagatagagcacacacaagacatgaccaacacagcaaagcacgagaaacagaccaccgcccacaacgaaaaacacacaacccaaacaggacagccaacgaccaaaacgacaacacataagaacccacaggacacagccacgagaaagccaaaaacaaccacacgcac

SEQ ID NO: 546785 - DNA, 107 bp, Homo sapiens
atattttaccattttattgtgtgtatatatagaaggccatataggaaattgatatttgtaatagtggatttgttaataatactgtttacataacatgactgtgtaaa

SEQ ID NO: 546786 - DNA, 163 bp, Homo sapiens
aggctgggccggcgtccccgcaagacgggcagcccccgcagagagcgctacttccctagtcatagtaagagcgttatcacctgttcatgagtcacgcgcctcataatctatttgtccttactctgcttcctaggtcctcgtatgcgccttttccgtaacactc

SEQ ID NO: 546787 - DNA, 587 bp, Homo sapiens
aaaacttttttgccgttaacttttccctgttcaactttagatttaaactgaagaatatcatcctcgaaagttgcagttttaagatctttacggtcagctaaataattattgctgacacgccaagggccatgcttaccttgttttggcatgacgtttgcggcacgggcaatataacctgaggtcagactgcccatcaccgtatcttcgagtaactctgcagcattaccttctggtaatacctcatcaaaaccgctcatatccatatagttcagcagacggcagatatattcggctgcgatgtctactttcagtgtccaagatgcattgatatagccaataatcagcggcatattcggaatatcactcaccatcacgcggcgatacagcatatgtttggaggtatcatgggcttgcatcgatagaagctgcatccacccaaaatctgaatattaatccggtgctgatcggtatatggcatcagaggttaccgatttagcgaatacggtttcgtaatccccgcgaaggcaatttaccgagacgccttcaggtattttaataatccacgggacaaccaaagcgtcccaggt

SEQ ID NO: 546788 - DNA, 847 bp, Homo sapiens
attccagtaaagtttatttttttcaatctacagatataagaaggctttcccatgaaaaacactctatttatgtcccactattaattatctaatgtcctataaatagtcacatacagaagtgaaaaatcagagccaggcactatttatcaacaaaagaaatctggtgaacgtctcctaaatcttgcccatgagtagccaagttcattctaacacgagttccaatccatggaaattatttctaaattggctctgtttaaccaatattgaagcactttatccaatccaacatcattgtcacactattcgctgcaacatgacacgaaattattctccagttataaatatggcgcacttgacacgtgattaaactcaagtgctttcctccttcttcagaatttccaggattttaacacactgagtgggtgtggtttatctcacgaagctctcatttacacaagaaacacctcgtgctaaaacctaaacagtgcgggtttttcacaaagccatttaggggtgcactgggaaaattgccatctcccaaaaagtttcttctcccagcttcgaattaaggggggcatttcccctcttgggagtgccaccgtgggacccaccataataaacggggcatacctaaataatccctttccccatgtggtcgtggcaaacattaaaacgtccccaatcttgggccccatccgtggtaattatgcgctgagctttcaaccgacacctatttgggaaacaacccttctcctctataaaactttgtctcccatatcccctttgtggccacaatttccttcccccgggaggaaacccctcaccccattttaatttcaagccaccc

SEQ ID NO: 546789 - DNA, 109 bp, Homo sapiens
ttcccaatgctacctgactcctgtggaagacccgggccggtgcgcgggggcgctagctggctcacaccgtccacgggctgggcctcgatcagaaggacttgggcccccc

SEQ ID NO: 546790 - DNA, 201 bp, Homo sapiens
ctatgttgacgaccacataggacagcaggaaagatgccttgctatgttggttcctgggattttaccttcataccagttatgatcaactctttataagaagaataactgctatctccctttctcagtgacagctccacatttgtgtctgcgttgaactttgtatttggactatagtcttctcctgatttctccggtgctgtc

SEQ ID NO: 546791 - DNA, 250 bp, Homo sapiens
ctaggagatgatgacagcagcagacatggaagagaaacctttgaaaatactgctgagaatatattatatttcataactgctcatgtttcttgtgctcgagagtagctgttcacttcgtttagagagaaatttgtttaaggggagtatttttggttgactttattcaatctttcattcttatctaagttttttcttaagatgctttgaacttcttttgtgttttctcaattaccgtgttgctttgacgcgt

SEQ ID NO: 546792 - DNA, 278 bp, Homo sapiens
tttttgtttttttggggctctaaagggggtaaagggggtgctatagggtaaatcggggccctatttcaaagattttaagggggactaaattctaggaggaggggcatgaaccgggtggttggctccacagatttcagagcatggaccgtagtataccccgcggtcgtgtagcggtgaaaggggttgggttaaaacgtcggggaaatgcattgtgttttaaagccttaagggggggcacagctcagtcagttgccaacacgttctggtgacgtgtaatt

SEQ ID NO: 546793 - DNA, 203 bp, Homo sapiens
ggatgtcatgagatcctggcttctccccatgttgttcccggacaagggcagaagggaggcatgcaagggactctgctgtcttactaacagtggtctcatcctcccacctccactgcttctgcaaggcaccagttgtatgagaaagttggcctttggacttaggatttcttattgtagctaagagccatctgaagcagcaggtt

SEQ ID NO: 546794 - DNA, 172 bp, Homo sapiens
  misc_feature (30)..(31): n is a, c, g, or t
tacgtactactaaattcgcggcagcgttgnnacccattagctgtaccatactcaggcacacaaaaatactgatagcagtcggcgtgtgaatcattagccttgcgaccctcggcagcaagaaccatacgaccaatatcacgaaaatagtcacgcaaagcattgggattatcat

SEQ ID NO: 546795 - DNA, 341 bp, Homo sapiens
cgtcgacttatcctgcagtctttatcatgctgtctcgattggcccaggttgagttggcttgtgtgatcctataggctttgttttccttattatctcaaattagctcagcatacagccatctgtcatatcagcactactgtcatattttcttcatcctaccacctgaagtctagcccccaggtgtttgctctttctctctctctactcctgttccttctcctccccatctcttcttctctttctctccctttgtctcttttcctcactggtttcagcttcgctcattctctttctccaattttacccttttctccctcccctgcttcttgggtcgtcgacgc

SEQ ID NO: 546796 - DNA, 967 bp, Homo sapiens
gggtgcaccaatgggtggaacaatccctggctgcggcacaggtaagatggcgcaggttgtaagctgggtcagcacttccgtggctgaccacgggggacctgagtgagggccagtggtggttttctgtcgtctcctctgtcagggccgactgggtttgagggtggtctggctcctgactcccatccacccccttctcttcccgggcttgctgtttcccagcagccggaagaagccccacagacagcttgagaccccctccttctgctgcctggccaagtcccacccttcctttctttcctctgaaacaggaccctaccccccgcccccccatgtctgccagaagttctccctctcctgtcctggtagacctgtctcctcttgtaggacaggctgaaagaacccggtccctcattctgaaactggggccaaagctgtggctgctggaaccccagggtggaagcaaactgggcagattggctggctaccagatccagctctgagatgggtgtgagtgggcgtgtccctagggtaggcagttattgggggggggggggtccccctttttcccttgaaaactttcacgtaaaagggacttccccagcctggttgggttttggaccctggcctttcgcttctttttaaaccttctccggttaattactgtggggacgtaaagggtttctgggtgagggttgggtcctctgcccaggttgcttgtgatccgtgagctgtagagtttcttttaaagttgcttctcagattggtgttagacagattgggccatggccgccggattgaacttaaattgtatataggctggatatatttttcctgggcaacagacgtgcatctaaaaaaggggggcatattatggggcaatctaccccttaaggccataggaaaaaggcgggacatgaaaaggatagccggatgcagcagaatttgttcggggtcgtgcgagagaata

SEQ ID NO: 546797 - DNA, 585 bp, Homo sapiens
  misc_feature (509)..(509): n is a, c, g, or t
attcttcttatattttcctcttcccctttcttcctaactctttcctccttctctccaacccctttttattatccaccggccgaccgcttctaaacaaatcttatttccccagctcaacattttaatacaatcggtaaaaacaaaaaccctttcttaaaacgtcataaagacaccacttcccggacccaaaaaaaacccgctctttcctaccccattcccttggaggctcacacccaaggcgcccaaaaaatggcccaacaacaaacggaatggcggcaaaattttctccccaaatatttgagatcaaactaaatcgcgttctccatttaaaaaccaacaccaacacgggttagaatcttattcccgcacaatatggctaaaatttcggtcacacaaaaaaatgggctttctccaaaaaaaaaaaagaaaccggcacaaatatccttccggccccaacacaacaatataatctctccttggtaaaaattcgcccacttcacacataccanggcgatcattctcctttgcccctcctctgctcccaaaacaccacaataatttttacagtaacactcgcgattcccg

SEQ ID NO: 546798 - DNA, 186 bp, Homo sapiens
tcgtcggatagcccatgtagatctcgggaagggcagtgatcgaagcgaaccactccgagccccaatggaactccagatccgattcgacctcggcggttttcgcaaccggctcttcgctcgaacctgacagcggcgagtccggcacttcgatgtcatcgtcaacggccacgaccactccttcgaact

SEQ ID NO: 546799 - DNA, 84 bp, Homo sapiens
agcttctacatctgcagtgccaatgatgacaggccgggtggtcacgagcagtacttcgggccgggcaccaggctcacggtcaca

SEQ ID NO: 546800 - DNA, 1858 bp, Homo sapiens
  misc_feature (946)..(946): n is a, c, g, or t
ctggatgtcttgccttttatgtggacaccaatatagcagctctctttagagggattcccatttctgcatatgccttgagccaaactggctgctctttagcacaccaaaaaccataagtatggtttatactcgcaacttctctttgtttcttatatgagcagacaatattgcctatcttttttggtactcccagctgctcaaagcagtgctgaggatcatgtttcaaattcattcttcttcaccacagcaacaatcctcccaaatcactttattttcaactttgttctctcttcagactttccatgtttagcgttcattcattatccaaacctccatctggccaaccaaggttcttccttctcatcacagggcacattgccttggccccattcattcaagaagaacacaggccttgaaacagcaggacaacaccaattggggagccacgccaaaagtggccttatcgagtacatcggtcattctcatttacaccaacatatgtggaaccacttttcaacattcctcgggtcacaacggaggagcattacagcgtctcaccctatacagtcctcggggcacacgtccaacacacaggggccgcgggacaaatgttcactacgaccaggcccacccacatcataagttccagcgcaattggcccgtaggatttccatccacactttgcgagccgattttggctctgtagacgcacagcgattataacaagttcttaatgaattcccaagtgtccacaacggacagtctaagaccgttacacaacgccagttcattcggcgtgagagccataccgttagcagaatcgcgatacacacaacgcaggcactactattccacttagtatacgccatctgtggaacccgtatgtgatctcacagtgtgggaccgccattcagattacccttgtcacgcacacacacaacttcanaacgacgtatacaccgataaccgtataatgttcgccgtggatacactttacagcattctgtgcgcccagacgccacaattgttgacacgattcatatgctactactacacatcatcatacgctacaagacaacgccatcaatcaattcaagtcacaagctgatggacacacacacgtacatacgcgcagaccaacatcgtgtctcaccaaaccctgtacaccctaagcacacaacctgtgcgagccaaccgcaacacaaacatctacacacacaccaacccggcgcgcggcacacacacaggcgcagaccacactgcaggcaccagcgcaaacgactaccaacaaaccaccgccaccgcacgctataacttacacacacgactcaacacaacgcaattgacactgacgccacaggccaccaccacacacacaccctacagagacgacatcgacatacacagactcacaccaacacaccaaggccacatcagagccacactcacacacgcacacagcgacctccctcagatcaacgcagcacacccatcgatcactcacggcgcaaatgcagcgtaaggagtactccgagcagactgaaatggaagcacagcactacaacgacgaacatagcgacaatccacccctctctattcaggagagcagaatcagatacagaaaccaggccagcgaccgagcggatgagcaaggacaagcgcacagacggagcacgagatcgcaacgacagaagagaaggacacaaccaggaaacggcgaaacagaagacaaaacgcagaaggagcagtgacgacgagcaagacgcagccaatagcacgcccagaagctcgctacactcaagcagtagcgccagaagcgtacagcacgtgccactgcacgaagcaagcgcgtgcagag

SEQ ID NO: 546801 - DNA, 236 bp, Homo sapiens
  misc_feature (95)..(95): n is a, c, g, or t
  misc_feature (127)..(127): n is a, c, g, or t
ttgcggggcgtgatccactctgaccagttgacggtgcggcccaggtggtagatgtcgtcttcgaggcggtagacgcgtgaggcaacgcgccagancacgcgctgcgcgaggcggctctccaggttgnggcgcatggcgaagtcgaccagggcagcgagacgctcttgcggcgtgcgcagttggggtgacggcggcacttcgatgccaccgcgcgattcgttgaccacggcgcggtt

SEQ ID NO: 546802 - DNA, 212 bp, Homo sapiens
gatggataatagatcagaaaacaaaaatcatcctggaaagaccactccatgactagatggcttctctagcaagtgcatccaccattcaaccagccacttctgtcacactgaaaaggacgccgtaagtcaatcttacaaatccagtgtaaccatcgtataccaaatgtgcatcgccttccaatccaataatcattttttcacacagcgcatca

SEQ ID NO: 546803 - DNA, 314 bp, Homo sapiens
  misc_feature (6)..(6): n is a, c, g, or t
gggctncagacaactgatccacacgggaatcagcattattgtcagtatggctgccggattcactgactttgcggctggtaaagtaatcgctggcttctttaaagtcttgtgtagctctggcatcgatatcatgacgagcatcatggctggcccgtgaaccactactggcttcatgtgagtcaagatcactgccatcaatgcttgccttagctccggcctggagaccaacccctccaccgttacccaatacacttatgcctaaatgccctttagcataagcatcaccgtaaaggccaagcgacgcatttgtactt

SEQ ID NO: 546804 - DNA, 784 bp, Homo sapiens
ggccatgacgcagccggagagagcttcacgcacaccatctcttcgttcttcctgaactctgtcacggagggggcctttgtttatttatttttgggaaactctgcttcgccactgaaggtactctgcaccccagaaggaatacgacttcagtgtttcatgaagtattttacagacgaaatgaaagtgaactggtgtcacaaagatgctaagatctcatccagtgagcatatgagaatcggggggagtgaagagatggcttggttgcagatatgtgagccgactgagaaggataacggaaaatacacttttgagattttcgatggcaaagacaaccatcaacgctcccttgacctgtccggacaacgctttcgatgaacgcatttgcagaattccagcaattcaaagctgctgcttttgcagacgaagcaatcgtggcacggttgatcggcggcttgcctgacgtggtgaccatcatggaacgggaagaccttgaatctgacctgcacggtgttggaaacctgaccccgaagtgataggttcaagaaccgaccacggacatccagctcagcgagcacttctcggtgaaggtggaacaggccaagtacgtcagcatgaacatcaaaggcgtgactccgaggactcgggcaaagctacagcattcagcatcaaggcactaagtattggggggacaaagatcgaccgggaccgtgcaccgtgttccaacacgcgggagacagatcccggacaatggccccggcccacgaagcaagcccaggcaatcccc

SEQ ID NO: 546805 - DNA, 205 bp, Homo sapiens
  misc_feature (70)..(70): n is a, c, g, or t
cacgagcgccagtaccccctgtaatttagccagctgaaagtactccggagagaagcggagttcacaacancatcattatgcgaggtacagccctttaccacagcgcctagtggtgctcggcggcgcaaggtgctcggcggcgcaagcttgcggccgcgaacacaacttacggtggacccggtcacattcaacgctcctaagtcca

SEQ ID NO: 546806 - DNA, 505 bp, Homo sapiens
cgattttcctgcctcagcctcccgagtggctgggattacaggcatgcaccaacacgcccagctgatttttgtgtttttggtggggacggggtttcactatgtggtcaggctgatctcaaactcctgacctcaggtgatccgcctgcctcggcctcccaaagtgctgggattacagggattacaggcatgagccaccatacccagcccaatgtttttaagtttttaaagttatttctcctgggagtcatggctcacacctgtaatcctagcactttggaaggccgaggcgggcggatcacgagattgagaccatcctggccaacatggtgaagccccgtctcaactaaaaatgcaagaattggttgggcgtggtggcgcatgcctgtggtcccagctactcgggaggctgaggcaggagaatctcttgagccaggaggtggaggttgcagtgagccaagattgcgccactgcacgccagtctggcgacggagcaagactccatctc

SEQ ID NO: 546807 - DNA, 174 bp, Homo sapiens
tgtgtgtatttgaatgtgatttctatgtatatgtgtgtagtagtttgggtgttatttggaggtatgtgttattttggtgtatatttgtgtgtttggagctgtgtgtgtgtgtgtgtgtgtgtgtatatatagatgggtatttgtgtatttgtgtgtgggggatggagcacccat

SEQ ID NO: 546808 - DNA, 674 bp, Homo sapiens
  misc_feature (657)..(657): n is a, c, g, or t
cggatcacaagttcaggagatcgagaccaccaccctggccaacatggtgaaatcccgtctctactaaaaatacaggaattagctgggcatgatggtgcgcacctgtggtcccagctgctcaggaggctgatgcgggagaatcgcttgaactcgggaggcggaggttgcagtgagccaagatcgcaccactgcgccactgcactccaccctgatgacagagcaagactgtgtctcaaaaaaaaaccctaaatgcataaggactaagacagatagaaacaaagaaatataggaatcatagatttttaccttattttaccttatgacactgttgaccaacagccaaagtcagaatcaattatgtaactctcagagcctagaacaaaatgaaaatatgggttcccttgttcaagaatgactaataattttaagaccggggacaggcaaacattgagtgtggggcccttgtgcacaccggccctctaccactgggcaagccacacagccacgtcagccctggacaagttattgatagtgtatgatagaactaaggtgacggttccctttgggacacactctgatcaccagtgaccaccagtcagcagatgggctcaagccgcatgaagatgagccgttcccagaggcattttccaatccaanaagacacgccgctttct

SEQ ID NO: 546809 - DNA, 413 bp, Homo sapiens
aggatcacttgaacatatccaaccaatatggatacaaattctgtactaatatggaaacaaagtttagaaagagatatctcaaaacatcatgttgttaatagcagttatctctgagttgttgatcatgggtatttttgtttgtttgttttcttctctataattgtgcgtgttgtttttgtttttgtttttgtttttgagacgaagttttgcccttgttgcccaggctggagtgcaatggcacaatctcggctctccgcaaccttcgcctcctaggttcaagcgattctcctgcctcagcctcctgagtagctgggattacaggcatgcgccaccacacctggctaattttgtatttttagtagagacggggtttctccatgttggtcaggctggtctggaactcccgacctcag

SEQ ID NO: 546810 - DNA, 327 bp, Homo sapiens
aagacggcgagtataccggactccagttataactgtactatgatttaatggatgcctattgtaactgactcatgtccatatagctgagttctggtgtaaccgactctggtgtctcccatccctgtaatatataacgctgtgtgacttcaacggagtcctcagcctctctgggcttcagtgcccttatctagtaaagtaggggataaaacaggcacttacttcactgcagtgtagtgaagatgaaacagcatatgcctgcgaacatgatgaacacagtgcttagcacagaaggagtgcttgtgaatgctaacatcactgttgctatta

SEQ ID NO: 546811 - DNA, 187 bp, Homo sapiens
ttctctctctccaaaaaatagcatcccccgctctgccctgtgcacattcggccccggactcggcagagggcgtggagaggagtgtccggcagagggcaacgcccgctgttcggtttgcgacacgcagcggggaggtgggcggcagcgtcgcggggttccagaaaccaatggaaatcccaatggggaa

SEQ ID NO: 546812 - DNA, 113 bp, Homo sapiens
aaggcaggtgagtggtaggaagttttctaggaggtgtatgagggggaaatggtggggtcgtctgggccatagaggacattcaggatgactgggtcgctgtggtcaacacttaa

SEQ ID NO: 546813 - DNA, 1003 bp, Homo sapiens
gactcgcgcccttgccggtgcaccgaaccccgccatggagcggcgtcgctgcgcgcctgtcttcggcgccgtgggctggtgctcctgtcctgcccctctcctcttcctcctcttcggacacctgcggccccgcgaagccggctcctgcccgccctgcccccgttgggctgcctgctgggacgagaccccgcaacgcgtgcggttgttgccctaatgttgcgcccgcggagagggcgaagccggtgcgtgggattgggcggacgccggcaggggggtacttggcgccgggcattggaagtggttgaagagcccgcaaaaaggcggcaaggggtaaaaagccgggggcagacaagccggcgggcacgggggatgtaagcagggcgtgtaccagttgttgcaaaaagaaggccggtaaccccaggtgttggcgacaggacgagggtgacccaaccttaaccccagaaggtggtttgcacaagttgtggcgcagaccgacaagaaccaaaaaggggccgaagaagccgcggggaaagaagggccaataaaccacatgtgtccagcaaggggcaacttgcgaagcaagggccttcccaataaggtggacgcccccaaaaggacattcgggaaattggccactggttgcccaggtgtcctagacccgggaggtctcgaaatcccaaacactgtcttcaatcgggaaccaggtcaacaggggccactactgggtccacaggaaggaaaccctgcctgtgaccggacaccctgccagcaaaccgggtggccagaaagtaagcaccggggggcggaacccccaaagaagcaaaccggactgagtgcagcacaaaccagacggcaacgaccgcaaataggcggcccatcaaaccgaacggggggggcacacacaatactcgggagacagcaaacaagcgggacagttcaccaccattcgtgcgacacaacacgcatataagacaataaacacgagcgcggccacaagcgccgc

SEQ ID NO: 546814 - DNA, 351 bp, Homo sapiens
  misc_feature (38)..(38): n is a, c, g, or t
  misc_feature (215)..(215): n is a, c, g, or t
aggtaatttttattccggtcctatgtgattgtatgtantctccaaatcttctacaatagatatataattattttataaaaggaaaaaggatcaggctggtggctcaggactataatcacagcatttggggagaccaaggtgataggaatgcttgaggccaggagttccaggcctgcctggataacatagtcagaccatgtctctacaaaaaaatnaaaataattagctgggtatggtggtgaatgcttatagtccaagctacttgggaggctgaggcaggaagattgcttgaacctgagaatttgagcaagaccctgcctcaaaaacaaaacaaaacagaaacaaaaattc

SEQ ID NO: 546815 - DNA, 736 bp, Homo sapiens
ggcgatcagatcgatctaagcatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggttgatctccaagtttgatactgttgaagacttttgggctctgtacaaccatatccagtgtgtctagtaatttaatgcctggctgtgactactcactttttaaggatggtatgagcctatgtgggacagatgagaaaaacaaacggggaggacgatggctaattacattgaacaaacagcagagacgaagtgacctcgatcgcttagggtagagacacttctgtgccttatgggagaatcttttgatgactacagtgatgatgtatgtggcgctgtgtaatgtagagctaaaggtgataagatagcaatatggactactgaatgtgaacaccagagacgctgttacacatatagggagggtattccaggaaggttaggacttcctccaagatagggatggtatcagcccagcggcgaacagctactagaagcggtccacccacttaaaatagggttggtgctaagagacaccttctggttctcatagggggctggcgtcagccacgcggattgggggctggaccaagctctta

SEQ ID NO: 546816 - DNA, 454 bp, Homo sapiens
  misc_feature (52)..(52): n is a, c, g, or t
  misc_feature (74)..(74): n is a, c, g, or t
  misc_feature (103)..(103): n is a, c, g, or t
  misc_feature (178)..(178): n is a, c, g, or t
  misc_feature (252)..(252): n is a, c, g, or t
tctccccttccccataaatggatccgtggtcctgtgtgacctgaaaccccanacagaagtgtccatgggtgaanaagtttcctggttgaaagtaagctcccangccctggcttctgtggacagcagattcttttcccttctcacaaggggctcatttaaaatttggaggctgggtgcntggtgcacgcctgcaatcccagcactttgggagactgaggcgggcggatcatgaggtcaggagatcgcgaccancctggctaacagtgaaaccctgtctccactaaaaatacaaaaaattagccgggcgtggtgcgggcgcctgtagtcccagctactctgaagactgaggcaggagaatggcgtgaacccaggaggcggagcttgcagtgagctgagatcacgccactgcactccaccctgggcaacagaagtagactctgtctcaaaaaaaaaa

SEQ ID NO: 546817 - DNA, 240 bp, Homo sapiens
ccaatttagcggggctttaaatcgcttgaacccgggaggagagattgaggtgagcagagatgtcgtcactgtactccagcctggcgacagagcaagtctcttgtctcaaaaacaaaaaaaaaaaaaaaaaaaaaaaaagggattgttttgttcggggttcctgcgttccccataacctgttgggtttggaaattgggggcccctctccgggttacccacaattttggtctgcggattttt

SEQ ID NO: 546818 - DNA, 1209 bp, Homo sapiens
gtttctttcgctatgggtttgccgacagacacacagcgtgtcggtcgaaatacctacccgatatcacacgccgaaaatgggatacggaaaagactcatatcaagcagttgtcgtcgattggacacagtacgattcgcgtgcatgtcctactcgacttacttggcgcatcgtgatcctataaagtgcgggtggcatcgtacagagcagaaccattgtgtacaaaagtattgaacaatagagaggtcatgccatgtagcaattggagtataatggtgcctcccttgcgaccggtcaatgctcgtgtggctcccttttggaataaaaactttgcacaaggactggtatgcgttggtaaaccgcttggttaaatcgagccaatgtggactcactcatcgctatgttgggcacaaatttttagtatggaacccatgtctacaggctggcgtattgttgaaccattactacgaattagaatgggcgctctcaacgtgtaaccatccacgaaagtaccattttaatcggatagacatcgactgggactttaacaggggtgaatccacttcgtgcaagagtctggcatcgtgctgccttggtttccctggacttctgtttttgcctgactggatgcataggatgaagttatatagaaggcttggtcatgcgtcccaatttacactgggggcaggactcctgttagtagtctaatgtctccctatacttgtggcgtttgacttagctacttgggggatgcttgacagacaatatcttaaatgtcgatccgggttgtttataacccatacccattcgggggttctcgaccttgtaaggcgacgcgctttagcagaccgttgtacacggacgcactttagttgaacgcggaaaaagttttgcttccatcggaggacgacggttcaaaggcaacgtgttaaccattgtcccaggaaaccttggtctggcccttacgaaacaccgccctgaaactaacaacgattgatccaactctgtggttggcccaagattgtatcctgtgggcttaagggtacacgtttgtgtgtaccacacgccattgtccgttggcgaagccccaggagcgtttggccttaaacaaattgcgtctttttgagttgcccaaagggcactttggaagaaacttccctaactcgttgaacggtgtcgcgtgaaatttcgccccaagttgggataacccag

SEQ ID NO: 546819 - DNA, 1793 bp, Homo sapiens
  misc_feature (671)..(671): n is a, c, g, or t
tgtctgggtggccgaagtcgtccgatgattcattctgcagacattcaaggctctcgtctatctttttgaatcgcagggtcgagtgagtgcccgtgacatctctgctcttatctaaatgttgccggtgacattgtggccaccaccagacctgagtctgaactccgacaagcgcatcccagggtgcatgtcgaacagaggacttggtgactagggaagagactcgtcctttcatttctatccttccaatacgcccgttggcgtgtagccataaacaacctatagtctgaattcttttttgaacttaagcacggttttacatccttatgctaacagttgataatggtcctcatggtacattcctaacgtagagtttatccaaacgaggatatggtatcacgaacattgatgctagaaccattccatcaaacgttggcggacaagtttcccttcatctgcactgggggccctttgctcccgacgctagggacgcgattgcattttgcacatgcaggcgatttcttgaacgacctctaatgaagaatgctgggcaaaagatgtggaaccataaaatggcaattcgtaatgcctgcctttggtagcccttggcaacaagcctaacacttagttggccatcgattaccgtccgttacgttaagttgcatttcccaaanacgataccaattctccgaggggtaggcgtccctccctgctcctaaattttggaacctagaccgtaagtgccattcaccaacattaaataattgggtattcacaacaaacggtaagcggaaagaaaggacattggaggtttcctccccaaacgtggacgaaggaaggtccgaaggggcaagaaaactttaatcccccctcttaattccaagaagaggcggcggaaaacagttctaaaagccccccttggcataattcacgaggggaagctaccaatattccccctgggggccaccatagaaaagccgccttgtgttctcgggtggctgaattttattcccaccgttttggaacccacatggtcacaaagggccacatagcggcaggattctccacccgggacgacaagggcgcacacctttcacaattgcacaagagctttccccgaggtaatgagggccattccaatgttaaggagtcacaagggctgagggcattacagaggggccccaagcaagtaacacgcttggcttatgccagaaacacaaggaaggggccaagtgtaatttccccaatgcgtggaagcacttttgagcactcttggtggtgttgtctcccctcaaataacacacacccagttcttttgcgcgccctgtaaacgtgtgtctccccacttatcccttcccacaggtgcgcaaggcaatttcgccacggcaattacttatgggcgcttccaacgccatcccaacggtcagagaggcccattcccccgcgcaacagcagagctacgggataagagacaacgtgtaaggatccccagtcgtgtggtccctacctgttgaagagtgtggtcaaacgtacaacctgttttgccgaacgaaaaggggacaaaccccgtgggcagcaatcaacacaacagacactgtgcttgtggaagaacctctcctgtgtccagcgaaattatgcgttggtacctcgttgaggcagaaaatctcccccgtggcactactcacgaatagataccatcgtcggtggtgttcacccgacgaaaattatttggtggggactagacgctctcgatcagggagagcccatctagcgagagactactcaatcaacagaga

SEQ ID NO: 546820 - DNA, 218 bp, Homo sapiens
gataattaaactgacgacgaatgcttagtgcatatattgcagtatcatctgatgctaggcacctacaaagcactactacaagaggttagctgttatatatatttctattagacagccattcttacatgtggtattctgtgtgtgtggaaattgtagtcgattgaacaaggctttcacaaatataaattttacaatgataaaaatcctatttgcatttc

SEQ ID NO: 546821 - DNA, 378 bp, Homo sapiens
  misc_feature (87)..(88): n is a, c, g, or t
  misc_feature (253)..(253): n is a, c, g, or t
  misc_feature (322)..(322): n is a, c, g, or t
  misc_feature (364)..(364): n is a, c, g, or t
  misc_feature (369)..(369): n is a, c, g, or t
tttttttgttaagtcttttacattttaatagtttttgaagacaatctaggttaagcaagagcaaagtgccattgtttgcctttaatnngggggtgggaagggaaagagggtacttgccacatagtttcctttttaactgcactttctttatataatcgtttgcattttgttacagggtgaaacctctgacccctcgcgacaccgtaggacttgacttaaatattcggggtgagtaagtagttgggtataaganctgaacttttcatctgcagaggcaagaaaaatatttgacattgtgacttgactgtgggaagatgatggntggcatgtttctagtttgtatatgtttgccatctttgtgatnaagangatttaatt

SEQ ID NO: 546822 - DNA, 603 bp, Homo sapiens
  misc_feature (23)..(23): n is a, c, g, or t
cgcgggcaggtactttcacaggnggtgggaggaggtattgcgctgggtccactgcttcccagctccacgtgacctttcctctcaaatttcctcttgatttcatctttggcagaactggtacctgcccttcagctccaagaaacaaaagagcaggggggagtcagaaggctttgactacctcacccttaactagagatagaaagtgcttgattaaattctttgtgatacacattgcatttccttccctttccaacttaggttcatataacaatgaaggatcaattaaaatgaactccacctcccttctcccttagggtaaatatagattcccttagggctgagttgggcagggccatctacactaatgaaaagtcttctaggagaggtaatctggcctgttctgggctaggtacagaacaccacatcccatttgccctcattaactcattctttaaactcattcttttcctggcagcctcccttttctttctatccttttctgtataatcccatttagctacccaccataactctactttggatcatggaatctaggataccatcactgacaacgtttgtgtagataactgtctcttatcagta

SEQ ID NO: 546823 - DNA, 299 bp, Homo sapiens
gttatgaggatgagtaactagttcacttgcactgcgttcacatacgtgagacattctcaacttcaagattgtttcagtgcttctctcccccttgatctaaagcaggctgacatgagtttctgtcagctgcgatcaagagtcatgactcttacagtgggtaggattactccctttttttgttgtcattaaggaaaccttttgtcaattttggcttttgttgccatttcttttggtgttttagtcatgaagtctttgcccatgcttatgtcctcaatggtattgcctaggttctcttctag

SEQ ID NO: 546824 - DNA, 786 bp, Homo sapiens
ctgatactcggatctgggagctgaacagacgttgcataagatcaaaagatagaattatcatgtcctgtgtgaactagttggatactagagtaagaacgatcaacatatcccaagacatgatttccgagctaacctaaacgcgttgcaaacaaccgtcatggtagacgagcagatcatggtgtcacaaaactgccttggtactacctatgcatggaaacacactgtgtctcagccccttggatgcgtactttatcttctaccatcagtctcaaagcaaagtagactcagggcagaccctttgtcctggctaaatgatgcgatagcactcgcgcgcacgattattttgtaatatctacccattaaggccatcctgcacttgtgataaacacaacatgagacttattgttccgagtcaaacacgatatgactaaaagacaatacagtagcagcaagtatacttttagtgactacctcttccactcaattcttgtgagtgactagcacgaattgaaccgactgctatgtttgtaccaatacgattatggtggccttcaattgggactaccaaccatgcatcgattcgactccccataatctattatttcctcaaatcaaaaatctcaagatgatcctaaccccgactgagtagatctattggggaagccgcgtaggaactttagatttctaacctgttcggaccattcctggggtgaacgcacaatgaagtccctggcaactctttagtctttaacataacgtgccaccaatctagcacagccgggcaat

SEQ ID NO: 546825 - DNA, 246 bp, Homo sapiens
gggtcagttagtcttgccgagtactcggagagactagggtggaatgtagggatgctagactcttgcgtcaaacccctgactaatagacacagtgccatacccgttccttgtagtatcccgatgaggcagtaatttttacatgctccatctggctactacaaacagacctggaatcgctcattgtatagtcttcaatcagccacatggccctcgtagtatcagccattctcatccaaatcccctgaa

SEQ ID NO: 546826 - DNA, 272 bp, Homo sapiens
gcctggccaacatcgtgaaccttgtctctactaaaatagaaaatcactcagacaaggtggtgcacacctgtaatccagctaatcgtcttgtctcggcctcctgaatagctgggactacaggtgcccaccaccacacctggctaatttttgtatttttttgtagaatggatttcaccatgttgcccaggctgttcttgacatcctgagctcaagcatctgcccaccttagcctccaaagtgctgggattacaggcgtcgacccatgccgagcc

SEQ ID NO: 546827 - DNA, 208 bp, Homo sapiens
ctgtaacatgtatatactgagtaagtacactagtacgttgtcgtatgcaatattggttgacatgtgcagtggcttgagcccgtgtgaccgcagctctcaatactgagggaaaggagcactaagcagcatacctctgtggaaacaccgtgtggttcgtggctttagggattgaaatagcttcaataaaattctgcctttgtgaaagaca

SEQ ID NO: 546828 - DNA, 359 bp, Homo sapiens
  misc_feature (43)..(43): n is a, c, g, or t
tcaagaccagcctggccaacatggtgaaacccttctctactanaatacacaaattagctaggcattgtggggggtgcctgtaatcccagctactcaggaggctgaggcaggaaaattgcatcgaacctaagtggcagaggttgcagtgagctgagatcgcaccactgcactctagcttgggcaacagagcaagactctgtctcttaaataaataaataaatagattaccacgaaaaatgaaaacgaaaaaaacagacatacaaaataaaagccccagttttttattatcggtatttaactgagttaactctgtcagatttgctgcaaacatttctaaatacttgctcttggtatctata

SEQ ID NO: 546829 - DNA, 104 bp, Homo sapiens
tgttgggataacatggctgtgagccattgcgcccagcctcagttcctctctttaaggtctcctttccagagagggataggacctcaaattgcagggaggggaat

SEQ ID NO: 546830 - DNA, 1030 bp, Homo sapiens
  misc_feature (341)..(341): n is a, c, g, or t
  misc_feature (347)..(347): n is a, c, g, or t
  misc_feature (404)..(404): n is a, c, g, or t
  misc_feature (438)..(438): n is a, c, g, or t
  misc_feature (440)..(440): n is a, c, g, or t
  misc_feature (448)..(448): n is a, c, g, or t
  misc_feature (450)..(450): n is a, c, g, or t
  misc_feature (461)..(461): n is a, c, g, or t
  misc_feature (465)..(465): n is a, c, g, or t
  misc_feature (520)..(520): n is a, c, g, or t
  misc_feature (915)..(915): n is a, c, g, or t
  misc_feature (979)..(979): n is a, c, g, or t
  misc_feature (1005)..(1005): n is a, c, g, or t
tgctgggtgttaatcggccgagggggaaggcatgatggctggcgcccatggaggtggccgtgtgtacggactcggcggccccgatgtggagctgcatcgtgtgggaacttcactcgggcgccaacctgctcacctaccgcggcggccaggcgggaccccgcggcctggcgctgctcaatggcgagtatctgctggcggcgcagctgggcaagaactacatcagcgcctgggagctgcagcggaaggaccagctccagcagaagatcatgtgccccgggcctgtcacctgtctgactgcatcacccaatggtctctacgtcctggcaggagttgcagaaagnatccanctgtgggaggtctccaccgggaaccttctggtcatcatgagtcgaaaataccaggangtctcctgccttcagttcacaggggaaagcagcnanttcatctnanggggcaaggantgcntggtgctggtttggagcctctgcagcgtgctgcaggccgacccctccaggattcnggcgcccaggcacgtctggtctcaccacacgctccccatcacggacctgcactgcggctttgggggccccctggcccgggtggccacctcctcactggaccagacggtgaagctatgggaggtctcctcgggggagctgctgctctccgtcctctttgacgtgtccatcatggcagtgaccatggacctggctgagcaccatatgttctgcgggggcagtgagggctccatcttccaggtcgacctcttcacctggcccggacagagggagaggagcttccacccagagcaggacgccgggaaggtcttcaaagggcacaggaaccaggtgacttgcctgtcagtgtccactgacggcagcgtgctgctctcaggctcccacgacgagaccgtgngcctctgggacgtgcagagcaagcagtgcatccggacggtggccctcaaaggccagtcaccaangccgccatcctgctggcgcccgtcancatgctgagctcagacttcagccca

SEQ ID NO: 546831 - DNA, 890 bp, Homo sapiens
gtgttctacatgtgcgttatcagtatgtgcttagctgtaagtgacaagtatttttgaacagaacgtttacttagaaataccatgcactggtgctaccacgttaaccggctgacatttagcatattgatagttctagagagaacagatataatctaagaattcctatgacaagattgtatcattagagccagaaatactttgcatattaatatataatacagattaacattatatataatatgtacctgtgtcacttctgacatgagcctgtaaacatatattcatatatgtacctgcacatgtacccacctgatgtaggtctatccctttagtatggacttaaaagtacttattcatataccttgtaactaaaaattagaacagtccctagaattatgaacttttaagaggtctgactagaaattttgcacttatcaaaaacgttacttttaaacatataagttagggctaggcacagtggctcatgcctataatctcaggcaattttggacggcccagacaggaggatcacttcaggccaggagttcaagatcaacaaacctgtttaacatgggcagaccccatctctattatatatatatatataaacctagagttgatatcttcccctaacgaggcggtgatcttcggcgacgcctcaaaatgcctaagcggttaggtgtccgaagcttcttcctaacagtaccaggtaatactacggtaactggcctaggatgagctgtcccgcccagtgaaaagcaagaacaggacttattcatagcatcggacgatcatcaaaaattgaattacaccgaccggttgagatgtacaacaagaacggaagctagacgactccgttcccgaacaagggcaactatcgacagcaaaaa

SEQ ID NO: 546832 - DNA, 319 bp, Homo sapiens
  misc_feature (71)..(71): n is a, c, g, or t
  misc_feature (100)..(100): n is a, c, g, or t
  misc_feature (182)..(182): n is a, c, g, or t
  misc_feature (197)..(197): n is a, c, g, or t
ttaactgtgttccatggcaaactgccttcctgtaaacgttaagaaaaaaaagcctaggacccaggcacggntgtctcgccctgtaactcccagcactttnaaaaggcccgaggtgggtcagattcacttgaggtcagttctttcaaagtgcttggattacaggcgtgagccaccaattgccncctaaggccagtgantcttttgtcttttttttttttttgaggcagagctttactctgtcacccaggttggagtgcagtggtgtaatctcggctcactgcactccagcctaggagacagagtgacagttagtctacca

SEQ ID NO: 546833 - DNA, 760 bp, Homo sapiens
  misc_feature (439)..(439): n is a, c, g, or t
  misc_feature (760)..(760): n is a, c, g, or t
tgagacaggagttacagtccctttggccctcacatccaataaagagactgataccactggaagaaaacaaaaaaaaaaaaaaaaaaaaaaaaaaaaacttgtgcttcggcgccgcgcctcgggcccccggaaaaggcttcttcaacacccactctcgcgtttgggccgcgcgcgggccccaggcgggacagcggagacccctggcgccacacagcgggtcaccagaggagaacatccgcggggtcacaatgacttagaggcgctcgtggtgatttctctcacccacatataaaaacaaacacgcccgcggcgggaaaaacacggaagactgtctcttcgtgaaaacaaaataccacgaatagtggcgatctctcggagagaagtcaccaactaacagcggggactctcctacttaaacaacgagagagatcgttcccanagagagagaggagaacctctccaagaaatcttctaacaaaaatattatagcagcgcccacgcgtcgcctgtggtgagggcaaacaaaaaaaaacgaagaaagaacgaaaaaagacaagaaaacaaaaaagaaaagcacaaaaaacaaaacaaaagaaagaagaaaaaacgaaaagaccaagcaaaaaacagcaacagcaaaacaaaaaaaaacaaacatggcacagcaacaaaaatgaagcacagacataaacaacaaggaacacagacagaccaacatagcagaagaaacagataaacaagaagaacaaaaagcacacan

SEQ ID NO: 546834 - DNA, 442 bp, Homo sapiens
atcatccggctcagtctcactgtaggagaggatgcgtcatgacattaccttaccagccacaggcatgcaactaaatgtgcatggatctggtgcaacgtccgtgctggagaaacaaagataaatcttgattagctgtgcaataaagccagcagtggacgtcaccatttcaacgttactaggcgagagggcgactccagtgcctgccgtctttttgcctcgatgacattcagtgagggtcctccacatttaacaaaagtagtcctcatagttctaaaagtggttctcactgtcctgttattcttcagcttcttccgatcctgcttcggattcaggaggggaataaaactgaccatcagaaagaccaccaggtataagtgctgccctctctgcagcatcctgagctatcaggagtcggttcacttctactgctgggtaccgagct

SEQ ID NO: 546835 - DNA, 316 bp, Homo sapiens
  misc_feature (47)..(47): n is a, c, g, or t
  misc_feature (69)..(69): n is a, c, g, or t
  misc_feature (71)..(71): n is a, c, g, or t
  misc_feature (77)..(77): n is a, c, g, or t
  misc_feature (83)..(83): n is a, c, g, or t
  misc_feature (86)..(86): n is a, c, g, or t
  misc_feature (102)..(102): n is a, c, g, or t
  misc_feature (105)..(106): n is a, c, g, or t
  misc_feature (112)..(112): n is a, c, g, or t
  misc_feature (120)..(120): n is a, c, g, or t
  misc_feature (131)..(131): n is a, c, g, or t
  misc_feature (139)..(140): n is a, c, g, or t
  misc_feature (143)..(143): n is a, c, g, or t
  misc_feature (151)..(151): n is a, c, g, or t
  misc_feature (201)..(201): n is a, c, g, or t
  misc_feature (230)..(230): n is a, c, g, or t
  misc_feature (252)..(252): n is a, c, g, or t
  misc_feature (267)..(267): n is a, c, g, or t
  misc_feature (275)..(275): n is a, c, g, or t
  misc_feature (279)..(279): n is a, c, g, or t
  misc_feature (285)..(285): n is a, c, g, or t
  misc_feature (297)..(297): n is a, c, g, or t
tgaatgaaatgtggaaaaaaagtttggtgttgaattaatgtgaaaanaaagttttgagcaatgtatgantngtaagntatggnganggtttttaatttgggnttnntttttnttgttggntggtggttgtnttgtaggnnttnggccaggnagcgaaggtaaagggaaccagataggggctatcttgtggggtacggtggncagctggagcttctgggggtctgtggtgntgagggggttgttttgcctggnacccaggcatccttntcctctcntggnaaggtnttactgaagggntaggacagggctggtgtct

SEQ ID NO: 546836 - DNA, 713 bp, Homo sapiens
attctagagcccgagtcggcgagatgttattgtgggttctgtcctaggtgcttgagatggagtatggctctggtcgcccagattgaagtgcaaggggacacgatctcggttcagcgaaagcgtctgtgcctcacgtgggttcaagcgattctccatgccgtcagcatctcgagtagcttgggatcactgggcatgcacacaaggtaggcccagcataatgttgtatttgaagcagagacgggggtggctgcaggtagggcaaggctgtcctctaaaattttccacagatccgtcagggtggattccagggcgggtcctgaagccttcccccaaagagtcgctggggaattgacaaggggtgttgaggccatggtagccacttgaaggctggaagaattcgggataggagtgagggggaaaggcgcaacattgtaccccccccatagtggctggggaaccccttgtctcactctgattgcccattttggaccacatcggggctggtggtcgggttaccccctattcgaacatggactgggcaaaggttctgggggagggccatccgccagtgctggtggtgactggcgagctcatgcaaacggtgttgactcttacttcaaattgcctagtcgtcagtgcaagttcctaatagcgtgtgtgggaaacgactaactatcgatacgcaatatgaaacattgttgtgttggcataaa

SEQ ID NO: 546837 - DNA, 486 bp, Homo sapiens
  misc_feature (106)..(107): n is a, c, g, or t
  misc_feature (114)..(115): n is a, c, g, or t
  misc_feature (117)..(118): n is a, c, g, or t
  misc_feature (125)..(128): n is a, c, g, or t
  misc_feature (130)..(130): n is a, c, g, or t
  misc_feature (141)..(141): n is a, c, g, or t
  misc_feature (147)..(147): n is a, c, g, or t
  misc_feature (167)..(167): n is a, c, g, or t
  misc_feature (177)..(177): n is a, c, g, or t
  misc_feature (179)..(179): n is a, c, g, or t
  misc_feature (182)..(182): n is a, c, g, or t
  misc_feature (185)..(185): n is a, c, g, or t
  misc_feature (199)..(199): n is a, c, g, or t
  misc_feature (204)..(204): n is a, c, g, or t
  misc_feature (214)..(214): n is a, c, g, or t
  misc_feature (225)..(225): n is a, c, g, or t
  misc_feature (229)..(229): n is a, c, g, or t
  misc_feature (233)..(233): n is a, c, g, or t
  misc_feature (236)..(236): n is a, c, g, or t
  misc_feature (245)..(245): n is a, c, g, or t
  misc_feature (247)..(247): n is a, c, g, or t
  misc_feature (250)..(250): n is a, c, g, or t
  misc_feature (253)..(253): n is a, c, g, or t
  misc_feature (266)..(266): n is a, c, g, or t
  misc_feature (274)..(274): n is a, c, g, or t
  misc_feature (276)..(276): n is a, c, g, or t
  misc_feature (280)..(280): n is a, c, g, or t
  misc_feature (283)..(283): n is a, c, g, or t
  misc_feature (288)..(288): n is a, c, g, or t
  misc_feature (291)..(291): n is a, c, g, or t
  misc_feature (314)..(314): n is a, c, g, or t
  misc_feature (329)..(329): n is a, c, g, or t
acctcagcctcccaaagtgctgggttacagtatgagccaccatgcccagcaactcaatgttaattttaaaaactttttttttttggaagaatgaaaaaaatgaaannggaaaanntnngaaaaannnncntatacacaaanacactntctttttaaaggttaaaaangtgccttgtncntcntcntaagaaaaaaaaanggtgnctatttctgntggaaaggggnttcntacnagnaagggtccntnagnacnttaggaggtaatngaaatgcncnatantcngatcngcntaatgatgacactgatttttacntatgttatatgtacnaaatatattcattaagttattcatgtaagggcattttaactccatttaaattttacctcagaaaagcacttttactaggcaaaaaacctagtgaacattgaagcctagtaaaaattattttaaatttaagaaaacacatttttaaagcaaaaaaaaa

SEQ ID NO: 546838 - DNA, 150 bp, Homo sapiens
gaaagctagatcttgctgatgacgcaaatctcctctgttgcctccggcagcccaggtcgttgaacgatgccagctgcgatgagcttcgctcaccagtattcttggcttcctcctcctgtagaaacagaagcggcggcaataatgtccccg

SEQ ID NO: 546839 - DNA, 770 bp, Homo sapiens
gttgtcgctattgtgcttcatccgttcagctgaacaggaggatggatacagccgcgaggctaaaaaaacggagtttcctcttcctatgcttaaaagtctgatttacagctgttatgttgtttgtaaggaaacaaaagtgcatagtttagattttttcttggtggaatatgttggtgctgggactttatgagatagtcttataagaatcacgattttctacagcctgtcattgagccaagaaagtccagtttatgacacgtatgtactagtgaacaccgtcctcgatctgtacgaaatgtgacatgtttagggacatctccatgctgtcactctgtgatttgccctcttatgtttcttgggtcatagtggccaacgggaaagtcaaaattttctaagcaactttaagtaagttcttggaagacttagtgctgttttaaagtccagtttagaaagtaacttaattttaataccggtactaaaaattcgaaaatttcttctttaatcagattgcaatatggttaaaagagcaagactatttggacattgcgtgggcttatatctcccttggtttaacaaggtcattggtagagcaagagtggtatagtatcatctactctacttgaggctgtaaattttcattacagggttttgtaaatgtatccacgagaccatgatgcatagtaatggtgctcaatagatgtaagcatttaaaggcatttcgaatgaccgtgtattaataacggctttaaagattaatgctctttagaatg

SEQ ID NO: 546840 - DNA, 151 bp, Homo sapiens
ggttgagtcttctttcttatacataggtactatgtagaacagactcaatacgattgattgagtctgagtatagcagatattattggtactcccttaattcccgtgttccctggaaactttatagtaatactgattgtgaaacgtgactatg

SEQ ID NO: 546841 - DNA, 162 bp, Homo sapiens
caggaagaggaaggaaagagcaatcagatactcagtaaggtggctgggtgcggtctctcacacctgtaatcccagcactttgggagactgaggtgggtagatcacaaggtcaggagttcaagaccagcctggccaaggtggcgaaaccccgtctgtactaaa

SEQ ID NO: 546842 - DNA, 194 bp, Homo sapiens
tccccacactcccaggcctccagggtccgggccactcgtttccagcagcacacacccgtcctctttagctttcagcccctccggaagaagcctcgaatgggcttttgaggacacaaggtggggtgccctcaagccccaaagagcccctcatccttcctttgggaccaaatgtgccttccccagttgaaacttga

SEQ ID NO: 546843 - DNA, 1099 bp, Homo sapiens
ctctggagctcggaggttgacttcccgtcttgtgagctcttcccttttacatatagataagtgaaaagcaaaaggcattgttccttttttatgttttgtatcacgatctcctcatcctttgcatgtcgtccgtttggcatccctgttatgttaggcctctgctggatccagaccctcacgagaggctccccgcccacaggtgctcacattctggctcgggggacgaggttgggcttcgaggtggtgtgcttcagcctctggctgcagccccttctcacctatagtgaggccgggaagatgaccgggagtgccaggctcatgcatcctctgctgcagggaggagatctggaggtggggactgaacagcctccccactggctaagagaaacacgtgcagagaagcgctttgctggagggcaggcacctgtgggtgcccagacaggggagagagggatttggacctaaggcccagtgagccctgacatagcacgtggattctgcaggaaggtcacagacctgccttgtttgcctctggttctgagtacctctcctccttactgcaatgtcccctgaaggtacactctggctgcttcccacacactggtgcagaagcagaggccatgctcctggatgcctgcttgcctgatgctagttcttctctgtcccctgtgccctgtccatctgtctcctcccacaggtggggggcgggcgggggcatcctccacatccctccacatgttcctttaccttccttatctgtcctggctgcgtccctcgggttgagccgtttcacgctttcattgtgcgtccatcccgagggaaactgtagacagtgtgaagccacttctagtgtacaggggtcaaccagtgttttctgtaaagggctagatatttaggccttgtgggctgcaggctgtgtcacagccactaagctctgctgttgtattgtaaaaccagccatagtcaatacacaacgagtggtcagggctgtgtgccagtaaaactttatttataaaaatgcacggtgggccagatttgccccaaaggccccagtttcccaacctgtggtatataggattgcttctcccgtaaaaaaaaa

SEQ ID NO: 546844 - DNA, 297 bp, Homo sapiens
gcaatggtttcacgaccacatatcaccttaaacatgaaggacatgctgttcactggtacgtcgtggtcaaacatgcgcgtgtttgacgaccacgtagcagccactaaaagattatttaattccagattggaaatgacattttagtttatcagattggtaacttatcgcctgttgtccagattggcacgaaccttttcttccacttaattatttttttaggattttgctttgattgtgtttatgtggtggtcaaacatgcgcgtgtttgacgacgacgtacgtggtggtgaaacatgc

SEQ ID NO: 546845 - DNA, 271 bp, Homo sapiens
tgcacgagctggaggaagagacagaagaggcctcgccagcaattgtactcggcaccacctcctctgtgctgtccacctcctctgtgctgtccatgctgtccacctcctctgtgctgtccacctcctctgtgctgtccagctgtccacctcctctgtgctgtccacctcctctgtgctgtccacctcctctgtgctgtccatgtgctgtccacctcctctgtgctgtccagccccctgtgctgtccacctcctctgtgccctcctctgtgct

SEQ ID NO: 546846 - DNA, 3278 bp, Homo sapiens
ctctggagctcggaggttgacttcccgtcttgtgagctcttcccttttacatatagataagtgaaaagcaaaaggcattgttccttttttatgttttgtatcacgatctcctcatcctttgcatgtcgtccgtttggcatccctgttatgttaggcctctgctggatccagaccctcacgagaggctccccgcccacaggtgctcacattctggctcgggggacgaggttgggcttcgaggtggtgtgcttcagcctctggctgcagccccttctcacctatagtgaggccgggaagatgaccgggagtgccaggctcatgcatcctctgctgcagggaggagatctggaggtggggactgaacagcctccccactggctaagagaaacacgtgcagagaagcgctttgctggagggcaggcacctgtgggtgcccagacaggggagagagggatttggacctaaggcccagtgagccctgacatagcacgtggattctgcaggaaggtcacagacctgccttgtttgcctctggttctgagtacctctcctccttactgcaatgtcccctgaaggtacactctggctgcttcccacacactggtgcagaagcagaggccatgctcctggatgcctgcttgcctgatgctagttcttctctgtcagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatccttga

SEQ ID NO: 546847 - DNA, 990 bp, Homo sapiens
gtcttgatctcctgaccttgtgatccacccacctcagcctcccaaagtgctgggattacaggcatgaatgaccgcgcccagccgcaggcgcaacttttttgagttttcctggccaggcgcagtggctcaagcctgtaatcccagcatttgggaggccgaggtgggcggatcacttgaggtcaggagttagaaaccagcctggccaacgtggtgaaaccccgtctccagtaaacatacaaagccattacagggcatggtggggcacgcctgtattcccagctacttgggaggctgaggcaggagaactgcttgatccggggaggtggaagttgcagtgggccaagatcatgccactgcaccccagcctgggcaacagagcaagactccgtaccaaaaaaaaaaaaaaaaaaaaaaaacaggtctatattattccagtttcctaattatcaattttaaacacaagaaaatttggggccgggcaaagaggctcacacgtgtaattcccagcattttgggagacgccagggggggagcattcacgaggtcgggagatgggcagaccattccggggctaacagggttgagaccccggtctttacttaaaatctcccaaatttcgccggcatgggggggttgtgccgctggaagtcccaagtacctcagggaggcaagcgcaaagaatggcttgaaccccaggagggggcggatgtgttggtgtagcccaaggatcacaccagtggatctccacctggcgtgacaagcgcgagactgctccaacacaaaaacaacaacaggggggggcggcaaaatttcaccggggggccagagttacgctaccaggtttgtgcacgggcccatgcgggcggataacgaagaccgggcggttaaaacgtcgactgcacacacctgaagtggaagcactcttcgggtgacatggacacaccagagtagcaggaacaataggatgtaaccgcttcggaagcggtttaa

SEQ ID NO: 546848 - DNA, 2868 bp, Homo sapiens
cacgaggatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatccttga

SEQ ID NO: 546849 - DNA, 2528 bp, Homo sapiens
gagagccccagcaggtatggggcgggatgcgctgcctggggatgtcccccatgtgtgtgggtgaataacacgtgccggttgttttgcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatccttga

SEQ ID NO: 546850 - DNA, 232 bp, Homo sapiens
aataactagcctataccatgctctgccagactcactccagaacacacaggcattcttactagccatcgaacatgccatccaacctatcatattctacccataccctctatctggaggcctacatagcacattaagtattacccataaggtctctgattaaaaatcaactctgcaagcatggggagcagtggcatcatgccatataatcccaagaacatttgggaggctagag

SEQ ID NO: 546851 - DNA, 459 bp, Homo sapiens
aaacctggggacccgtttatagcaccgatggtatgtggaccctggcagagtcagcaaggtggtattcaaatgaatgaagtatgaaaaacacctcaggctgtgcgtggtggcttacacctgtaatccttgcactttgggaggccgaggtgggcggatcacgaggtcaggaattcgagatcagcctggcgaacatggtgaaaccccgtctctgctcaagataccaaaaaaaaaaattagctgggtgtggtggcatgcacctgtaatcccagctactcaggaagctgaggcgggtggatcacgaggtcaggagtttgagaccagcctggccaacacggtgaaaccccatctctattgaaaatgcaaaaaaattaaagattagctgggcgtggttgcacatgcctatagtcccagctgctggggaggctaaagcaggaggatggctttagcccaggagtttga

SEQ ID NO: 546852 - DNA, 3773 bp, Homo sapiens
  misc_feature (3763)..(3763): n is a, c, g, or t
ctctggagctcggaggttgacttcccgtcttgtgagctcttcccttttacatatagataagtgaaaagcaaaaggcattgttccttttttatgttttgtatcacgatctcctcatcctttgcatgtcgtccgtttggcatccctgttatgttaggcctctgctggatccagaccctcacgagaggctccccgcccacaggtgctcacattctggctcgggggacgaggttgggcttcgaggtggtgtgcttcagcctctggctgcagccccttctcacctatagtgaggccgggaagatgaccgggagtgccaggctcatgcatcctctgctgcagggaggagatctggaggtggggactgaacagcctccccactggctaagagaaacacgtgcagagaagcgctttgctggagggcaggcacctgtgggtgcccagacaggggagagagggatttggacctaaggcccagtgagccctgacatagcacgtggattctgcaggaaggtcacagacctgccttgtttgcctctggttctgagtacctctcctccttactgcaatgtcccctgaaggtacactctggctgcttcccacacactggtgcagaagcagaggccatgctcctggatgcctgcttgcctgatgctagttcttctctgtcagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatccttgatttggggaagacattccttagcggaggctgtgcagcctcccgcccctgcatggcccaggcgggacagctgggctcgctcttttctgtccgtttcctgctgtgttttgccctctctggcctgtgacgtgctcctggcgacttcttcctcgtgccctctcttttctgtcctctctgtctcacagcctcgtctcctaagccctccgtcctcatggctctcttccctgtctgtctggccatgtggggacagaagcttctctcctggaccctggcagctcggtcggggccacagcagtgatgctcatgtgcgcctctgatgacagaagagtgagctgggacttactttcagcaagtagtgctccgcagtctgcactgctcaagtggggggggggaattgacgcagatttattggcgggggcttttttcgaagatacctttggcagtaagaatagtggcaaatttaataaggggatatgcactgcttaagntgtccatccg

SEQ ID NO: 546853 - DNA, 3122 bp, Homo sapiens
ctctggagctcggaggttgacttcccgtcttgtgagctcttcccttttacatatagataagtgaaaagcaaaaggcattgttccttttttatgttttgtatcacgatctcctcatcctttgcatgtcgtccgtttggcatccctgttatgttaggcctctgctggatccagaccctcacgagaggctccccgcccacaggtgctcacattctggctcgggggacgaggttgggcttcgaggtggtgtgcttcagcctctggctgcagccccttctcacctatagtgaggccgggaagatgaccgggagtgccaggctcatgcatcctctgctgcagggaggagatctggaggtggggactgaacagcctccccactggctaagagaaacacgtgcagagaagcgctttgctggagggcaggcacctgtgggtgcccagacaggggagagagggatttggacctaaggcccagtgagccctgacatagcacgtggattctgcaggaaggtcacagacctgccttgtttgcctctggttctgagtacctctcctccttactgcaatgtcccctgaaggtacactctggctgcttcccacacactggtgcagaagcagaggccatgctcctggatgcctgcttgcctgatgctagttcttctctgtcagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtg

SEQ ID NO: 546854 - DNA, 784 bp, Homo sapiens
taccacaggcacacggggaatgatgatttcattgtagccctcacaagtccttagcatgttgaggtacatgaccatttttctttgttcgtatagcttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatccttga

SEQ ID NO: 546855 - DNA, 380 bp, Homo sapiens
  misc_feature (380)..(380): n is a, c, g, or t
aagcggctggtacggcgatttgatgcgaacgcgtcgacctcggaaagtgatgctaaagaaaccggattgccatttatgaactcctttttaagggagggaggtcatgtgtggccaaaagaaggatgtcacatgcctaagcaccctgggagcttggcagacaagaatgtgcccaaccttcatgtcatgaaggccatgcagtctctcaatgtccctgagggctttaccgtttgaaaaaggggaaaccaagggtatctttgccccatgggggaaggaaccaatttttccttaaccttggtggtatacccctttaacccgaaatttggacagggggtttaattcccaatgtaattctcccccgtgatttaaccctttccattccn

SEQ ID NO: 546856 - DNA, 118 bp, Homo sapiens
tgggggttacccctgggggggattttttttttgtttcaggggggtttggggggaaaaattttttaaaagggaattttaaaaagccccccccccccaaaaaaccttttatgtttttttt

SEQ ID NO: 546857 - DNA, 306 bp, Homo sapiens
tttctctctgaccttttgcctgttcctttttctccccaaggcaggaatcttctcccacctttcttgctgggagctggccataaagaaattctctggcctgctttatctgacttagttgataggccgttcattcattccagggagaatcctgccctccatcatggaggaagaaaagactgcatagagaccaagatgactctggacaggccatgataggtttccctatcaagtttatagacttccaccaacccttttcatccagcatagggcaacaagagatagactccatcccaaacaaaacaaaac

SEQ ID NO: 546858 - DNA, 2370 bp, Homo sapiens
ctctggagctcggaggttgacttcccgtcttgtgagctcttcccttttacatatagataagtgaaaagcaaaaggcattgttccttttttatgttttgtatcacgatctcctcatcctttgcatgtcgtccgtttggcatccctgttatgttaggcctctgctggatccagaccctcacgagaggctccccgcccacaggtgctcacattctggctcgggggacgaggttgggcttcgaggtggtgtgcttcagcctctggctgcagccccttctcacctatagtgaggccgggaagatgaccgggagtgccaggctcatgcatcctctgctgcagggaggagatctggaggtggggactgaacagcctccccactggctaagagaaacacgtgcagagaagcgctttgctggagggcaggcacctgtgggtgcccagacaggggagagagggatttggacctaaggcccagtgagccctgacatagcacgtggattctgcaggaaggtcacagacctgccttgtttgcctctggttctgagtacctctcctccttactgcaatgtcccctgaaggtacactctggctgcttcccacacactggtgcagaagcagaggccatgctcctggatgcctgcttgcctgatgctagttcttctctgtcagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtggtggtcaaacatgcgcgtgtttgacgacgacgtacgtggtggtgaaacatgc

SEQ ID NO: 546859 - DNA, 184 bp, Homo sapiens
ctgctccccatctttctatctatctggctggcacggaaggacagaacttgcatgttggtgaaggaagacagtggggtggaagaagtggggtgggacgacagtcaactctagagtaaaaccaagctggcccaaggtgtcctgcaggctagtaatgcacgtttaatcagcagtgccattatttttt

SEQ ID NO: 546860 - DNA, 229 bp, Homo sapiens
tagtccacggttggctggcgcagtggaagcccaggtccagttcaaacttgtatgggtgggtgatggtggtactgggaaaaacgaccttcgtgaaacgtcattggactggtgaattaggagaagaagtatgtagccacctgtgggtgttgaggttcatccccgtagtgttccacaccaacaggaggacctattaagttcaaggtatgggactagccaagcgtggactagg

SEQ ID NO: 546861 - DNA, 2321 bp, Homo sapiens
ctctggagctcggaggttgacttcccgtcttgtgagctcttcccttttacatatagataagtgaaaagcaaaaggcattgttccttttttatgttttgtatcacgatctcctcatcctttgcatgtcgtccgtttggcatccctgttatgttaggcctctgctggatccagaccctcacgagaggctccccgcccacaggtgctcacattctggctcgggggacgaggttgggcttcgaggtggtgtgcttcagcctctggctgcagccccttctcacctatagtgaggccgggaagatgaccgggagtgccaggctcatgcatcctctgctgcagggaggagatctggaggtggggactgaacagcctccccactggctaagagaaacacgtgcagagaagcgctttgctggagggcaggcacctgtgggtgcccagacaggggagagagggatttggacctaaggcccagtgagccctgacatagcacgtggattctgcaggaaggtcacagacctgccttgtttgcctctggttctgagtacctctcctccttactgcaatgtcccctgaaggtacactctggctgcttcccacacactggtgcagaagcagaggccatgctcctggatgcctgcttgcctgatgctagttcttctctgtcagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagccca

SEQ ID NO: 546862 - DNA, 1429 bp, Homo sapiens
  misc_feature (117)..(117): n is a, c, g, or t
ggagacttggagtatggacttttgagttaatgctgaaatgagttaagactttgggggactgttgggaaggcatgattgatttttaaatgagaggacatgagatttgggaggggccanggagagaatgatatggtttggctgtgtccccatccaaatatcaccttaaattgtagctcccataattgtgggagggacctggtgggagataattgaatcataggggcagtttctcccatactgttctggtggtagtgaataagtctcacgagatctgatggtttaataaggggtttccccttttgcttggctctcattctctcttgtctgctgccatgtaagatgtgccttttgccttccaccatgattgtgaggcctcccagccacatggaactgtgagttcattaaacctctttttcttcataaattacccagtctcgggtatgtctttatcagcagtgtgaaaacagactaatacaccactcctctaccttctttattttctcagtgtggaaaatgcctgatgaaagctttggggccctcacagatgcacaactcaagtgctgattctatcacttatctaccagctctgtgaccttgaacaagccgcttaaccttgctaagcctctgttttctcatatgtcaaatggtgataataatgcctacctcccgaggttgttgtaagaattataagcacaaatgtatgtaaagtgcctggcacaaagtaggtgctcaataaatggtagctattataatactaaaaaaaaacaaaaaaaaaaaaaaaaaaaaaaaaaaaaaaaaaaaaaacaaaaccaaacaacaccgaggggagcggggcgcgcccccaaaaaaaataaactccccaccgaggagggggcccacaaataataagcactagaacaacccagtaccgttttttctagctaacaaaagcagggcgcgcccacaaatagtagggagggagccgcaatataataatatataacagaaaacgacagatagcgagacacggagggcttataacaacaaacgcacccttcagtgacagagcgagaaaacacgtaagtcctaacatgatgaggaaaaacactattttgagggaaaaaacagcagcagaccccaaaacatacaagggagaggagggaggggagccacccaccaactactgggggcgaacaacagacaaacccacccccagacaggaacgaagtatatctataacaccgcccacacagaagaggcaactaataaaacataacaacctcagacacaggcgctattacaacggcatcgtgaagacacaacaccccaaacgcacactaaaacaagatcgttacgtcggcgcaacagtgatcaaaagaacagttggtcgacctaacgcaaggaactaacatttaattttccataaaacaaaaaaaatttgatcaccacc

SEQ ID NO: 546863 - DNA, 236 bp, Homo sapiens
acacgaggtgtaatagtccccgagagagaacggaatcaggcgaatgagaacacgagtgtgtgtggagagagagaacggaatcaagcgaatgagagcgtgagtgtgtgtggagagaacggaatcaagcgaatgagagcgcgtgagtgtgtgtggagagagaacggaatcacatgaatgagaacgtgagtgtgtgtggagggagagaacggaatcaagcgaatgagagcgtgagtcca

SEQ ID NO: 546864 - DNA, 382 bp, Homo sapiens
tggggggggacttgggttttcagttcataaaaaaggttttcccttttgaccctcccaattttgttccccccgggggcctggaactttaactccctccctgaggggggggaattaaaacttttaacccggaaggagagatcccccctcccaagtttgggggtaccaaactggagccccggggggatggaaacttttttatggcttttggcagggacaaacttggacccaaaaccgatccataaaaggggttccccaccctttttttgcaacatccccaattttttcccgtttaaggagggcctttttcaaatttataaatgggctttctttgtaaaaataaatgttttttgcccccctttttgatggggggggaaggggtcca

SEQ ID NO: 546865 - DNA, 1145 bp, Homo sapiens
gcttagttgccattgtccgagacccagcggctctggctcgctctgccttctcctactataaatccaccgtcatcagccttccgcaagtcaccagtctttggctgccttcctggccaatcctacgaggcgttctacaggcctggggcccgtggggagcagtacgacgtcggcaacttactatggtttgactttggcctggcctttcccccagagaagagggccaagagagggaatattcagtccccgcgcagagacgcgccaaggccccgcacagctgcaggtcttgccttctggtgctggccctcgagcccaacacctcaatcccaatgcccgtcagtccatcctgtttccactgttactgatcatcgcaggccagatatcaagcgcctgcctcgttgcgattaggggtcttcatccttcatccagtggggtctgggctggctggactctgtctttgacctggtcatggctggctgagtacttcgatgacgtcattggttctgctggcagatgacctgtgctggggatctagatgacgtggtgggcttcatgcacaatgcacaggctggacatcacaggcagggcctacagcacttgtcagcaacagtggactgactgcgggaggacggcagccgactgcacggggcccgagcctggaacaactgggaacctggggcacactatagtgcacgtcaaccgagactctgggaccgggatagacgaatacggccagggccggctgcaaacagctgtggccgaagctccgggactcgaccgagacgccctagcgaaacatcgcctggccacggggcgacgggtacggaccccgcaatactccacgaacacgcggaaccagccacgacacgtgggggacacgaacgggagagggacacaactcgcgcacggcattgggcgccccaaagaacgagaggaacggggagggactgattcccctggcgacacaccaggcgcaagtcggaggtaaaggaaaccagaacgggtaaagggcccaaggaaaggcactccccaaagaccctaccgtagtgaggaaaaccatatgcagaccaagatcagcggaaccacaaatgtcgacgagcaccatgcgcagcagctgcacagatccccacccgggccaaatgaacacg

SEQ ID NO: 546866 - DNA, 185 bp, Homo sapiens
cgttacccctagcttctctatcttttagggtatcatctaaaaggctactactgtaacttctgctgtctaactctgggttttcatttaatcttgggactagtctctccttgtcaatagaatagatgacttaactttaggtcagttaatatgtttgcccctgttctactctgtaaactgatatttta

SEQ ID NO: 546867 - DNA, 80 bp, Homo sapiens
gcagggcccgaaagaggagctcaagacacctgaagcaggatataaatagcaggaataaagagctggcctcagaaattaag

SEQ ID NO: 546868 - DNA, 81 bp, Homo sapiens
gacagcagcttctacatctgcagtgctatagttagcggggttgagacccagtacttcgggccaggcacgcggctcctggtg

SEQ ID NO: 546869 - DNA, 191 bp, Homo sapiens
tggcgaatcctcctcctactttctcagatacccgggtaacagtcctcatagtccagatatactgggactcgtgtccaacctctctaaacctgggtctctgtttcatagaatatcaaatatcaggttcaggcccctgtgtgcaccagtatactggggttcattcccctgggtgttcaacatatctggattca

SEQ ID NO: 546870 - DNA, 185 bp, Homo sapiens
cttagactacagctagacagataggtcagagaaaggcaggtatgattagagttctgctttggagagaaggagcacggtgaaaggaggagatggaggaagtcagaaatagattctgttttctgaggcctaaagcaccctaacataacaagactgtaacaaaggctatgggagttatgagccagaaa

SEQ ID NO: 546871 - DNA, 470 bp, Homo sapiens
cgaacgtggagcagaagaagaagcgcaccttccgcaagttcacctaccgtggcgtagacctcgaccaactgctcgacatgtcctatgagcaactgatgcagctgtacagcgcccgccagaggaggcgcctgaaccgtggtcttcggcggaacaacactcactgctcaagcgcttgagaaaggccaaaaaggaggcaccacccatggagaagcctgaggtggtgaagacgcacctgagggacatgatcatcctgccggagatggtgggtagcatggtgggcgtgtacaacggcaagaccttcaaccaggtggagatcaaaccagagatgatcggccactacctgggcgagttctccatcacctacaaacccgtgaagcacggccggcccgggatcggtgccacccactcctcccgattcatccccctcaagtagcgaggccaataaagactggttttggtccctggaaaaa

SEQ ID NO: 546872 - DNA, 1182 bp, Homo sapiens
  misc_feature (900)..(901): n is a, c, g, or t
  misc_feature (905)..(905): n is a, c, g, or t
gctcttttgcctgctgccattccagtaggatgtgacttgcttctcctggccatggttgtgaggcctccccagctatgtggaactatgttgagaaggaacaacatgatctaagtctttagaaaccaagagccacgactagctgaggacacaagaattttcacaaaacaaagtagagtgattccatagatcactattatagctgcattaccagtcctaggacagaatatggatgctgaaaaatgattctttcaaagtgctgagttgttgcctcacgcccagttgtctggcatctcttcactgaaactattacagttagatctcatctctatgggtggaaggttgttgttctcaactcagcaggaaatgtcttatgaagaaaatggcccctgctccttaggtagcaggccataggcaaatactgaccctcttgccttctgaagctaagctccagcttcagtatgcacttgcttacctccttcccctgtccacactgcttttacttgctccctgtctcctgagagcattcattaataaattgcacacatttgaatccctatctcaggtattgctcatagagagtccaacttaagaaaaactgcaatccttatttatattctgtttcattaagagatgtaattgtgaaagaactgaacatataaaaaaatcagctttatcatgttttttatccttgtcacgccatgtcacctgagcaacacagtctgaatactaaattgtgagtgtgagtgcatatatgtgatggtaggtttttgtcctgttttcaatcattcataaaaccaaacatgtgtcccttaattatgctctactacatccacaacttattttattcataaaaatattgtggggtagatattatcactgttttcttgatggggaaatttnntatncacaaagttaaatattccctccaagggcataacatttttaattggtatagtcatgattcaaattatatcttctaactataaggccagtgtgaatggtactccactacagtagactatcccttagttggtttctactttttgccttgttatttccgtccatgcttggttagtacctacttttcttttttcttgaaaaatttcctcctccttctatcttccaaaaattttgttccctatgaaaactggtttttttgcattggtttctccaaattccaag

SEQ ID NO: 546873 - DNA, 213 bp, Homo sapiens
  misc_feature (192)..(193): n is a, c, g, or t
tggcggtgcagagctcttaagttaaataaggtctcattggtcaatttgggttttggtggccgtggcttggggagtcttcatcatgaaatcttggccggggcctatgtcgggaggggtattcccaaggtttgctccaaggggtgaatagttcagggtataacatttaagtcttaaatccatctggagtggatnngggtataatggtgaagggga

SEQ ID NO: 546874 - DNA, 271 bp, Homo sapiens
aggatacacgacacctcctcttactaagaaaatacaacacttatatattttctattatatcctatggtacaacaattacatattgaaatccacatatctaaaatccaaacatacaatctgctatatacaccatcatgtgcagtggcacagccatgggaggtgctataccttaaccaatgttccagctataaaaagcatgaatgaggaaaccttgtgaaagggataacatcttagatatatatcaacacccaaaatgcactgcaggtagcga

SEQ ID NO: 546875 - DNA, 1209 bp, Homo sapiens
  misc_feature (927)..(928): n is a, c, g, or t
  misc_feature (932)..(932): n is a, c, g, or t
gctcttttgcctgctgccattccagtaggatgtgacttgcttctcctggccatggttgtgaggcctccccagctatgtggaactatgttgagaaggaacaacatgatctaagtctttagaaaccaagagccacgactagctgaggacacaagaattttcacaaaacaaagtagagtgattccatagatcactattatagctgcattaccagtcctaggacagaatatggatgctgaaaaatgattctttcaattttttattccttgacatcaagccaaaagtgctgagttgttgcctcacgcccagttgtctggcatctcttcactgaaactattacagttagatctcatctctatgggtggaaggttgttgttctcaactcagcaggaaatgtcttatgaagaaaatggcccctgctccttaggtagcaggccataggcaaatactgaccctcttgccttctgaagctaagctccagcttcagtatgcacttgcttacctccttcccctgtccacactgcttttacttgctccctgtctcctgagagcattcattaataaattgcacacatttgaatccctatctcaggtattgctcatagagagtccaacttaagaaaaactgcaatccttatttatattctgtttcattaagagatgtaattgtgaaagaactgaacatataaaaaaatcagctttatcatgttttttatccttgtcacgccatgtcacctgagcaacacagtctgaatactaaattgtgagtgtgagtgcatatatgtgatggtaggtttttgtcctgttttcaatcattcataaaaccaaacatgtgtcccttaattatgctctactacatccacaacttattttattcataaaaatattgtggggtagatattatcactgttttcttgatggggaaatttnntatncacaaagttaaatattccctccaagggcataacatttttaattggtatagtcatgattcaaattatatcttctaactataaggccagtgtgaatggtactccactacagtagactatcccttagttggtttctactttttgccttgttatttccgtccatgcttggttagtacctacttttcttttttcttgaaaaatttcctcctccttctatcttccaaaaattttgttccctatgaaaactggtttttttgcattggtttctccaaattccaag

SEQ ID NO: 546876 - DNA, 305 bp, Homo sapiens
ccgcggcgtgttcatgcaacatgattgagatagaaggaatgcccataccatgctggaaccagggagaaacacccatgttaagccagggttgtgactttgtcaatgttctggctgatgtttcatgtgatgtaattcaatctaacatgcccattgacatagtgatgaaagataaactttttaaatataaatttaagaactagtaacactttgggaaactttaaagtgtatgcaaagctgtcaaagacaaaaccccatttgatcgacacaatttgtcaaataggtaacagctgcggacccaggggctt

SEQ ID NO: 546877 - DNA, 837 bp, Homo sapiens
  misc_feature (1)..(1): n is a, c, g, or t
nccgtggtaacaaatacggggtgtggtgttttaatacgccgcgaatcgaccctgtgttggtcccccgccggacccattgggtgagatgtgtcgtagccacactttttctcggtcctcgtgggtgtattatccgccggtgtggtagagcccagcgtgatatgttcggtgcgtggtagtgcaccaactcccctggtgttgtggcccctcaccgcaggaggtagtgtacacctgggcgcccgcccgcaccacaccgtgtgttttaatggccccttttttgtgttaaacccgcgcctgttaagtgtgtgtgccgcggacacagcccgccccaaagtttgttgggcggttccccagaggagtattttagtctccgcgtcgtcagcgatccggagattcttttggtataagggttttgcaccaacaggtggtcgaaaaacgcccgttggggtccaccaaatccgtgtccctctccgggagttttctccccccgacgtagatccaagagtaaaaaaatctttggattgcgggagattcagaggctctaggagaagaactctgtgctcctcaaggagagaagggcaatacgcccccctctgtagggaggggcagtatttaaactctatgtatgttagtcctcgacatactgtaccagtcttctgtaataggaaagtcatatagatcattgaatagcgcggctacaattccacctctcgggtccttgccccccaagctattatgcatagctttcttgcgggcagctctcagacatgagaaaggacaggcagcattccctttcgcgcgtgacttattaaagagcttatcctcggcggatcatagaac

SEQ ID NO: 546878 - DNA, 174 bp, Homo sapiens
gtttataaaaaaccctaaaccttcaattccaaagaaccaaaaatccccccttccccccgaacaatattaagggggttgggttttgccccaaaccctttttcttttctttcgggccgggtaaagcttttaaaaacaaatgagttttttaaaaaaaaaaagtttttaaagggggga

SEQ ID NO: 546879 - DNA, 976 bp, Homo sapiens
  misc_feature (694)..(695): n is a, c, g, or t
  misc_feature (699)..(699): n is a, c, g, or t
tacttcagtgagacaagagaggggactatatagaagatatgtttatgtctttggtgttttaccccgatcattttacagaatgtgcacctgtgaatgttggctgctcattgttcatgtttctgctttctgcaggttgttgttctcaactcagcaggaaatgtcttatgaagaaaatggcccctgctccttaggtagcaggccataggcaaatactgaccctcttgccttctgaagctaagctccagcttcagtatgcacttgcttacctccttcccctgtccacactgcttttacttgctccctgtctcctgagagcattcattaataaattgcacacatttgaatccctatctcaggtattgctcatagagagtccaacttaagaaaaactgcaatccttatttatattctgtttcattaagagatgtaattgtgaaagaactgaacatataaaaaaatcagctttatcatgttttttatccttgtcacgccatgtcacctgagcaacacagtctgaatactaaattgtgagtgtgagtgcatatatgtgatggtaggtttttgtcctgttttcaatcattcataaaaccaaacatgtgtcccttaattatgctctactacatccacaacttattttattcataaaaatattgtggggtagatattatcactgttttcttgatggggaaatttnntatncacaaagttaaatattccctccaagggcataacatttttaattggtatagtcatgattcaaattatatcttctaactataaggccagtgtgaatggtactccactacagtagactatcccttagttggtttctactttttgccttgttatttccgtccatgcttggttagtacctacttttcttttttcttgaaaaatttcctcctccttctatcttccaaaaattttgttccctatgaaaactggtttttttgcattggtttctccaaattccaag

SEQ ID NO: 546880 - DNA, 229 bp, Homo sapiens
  misc_feature (9)..(9): n is a, c, g, or t
  misc_feature (62)..(62): n is a, c, g, or t
  misc_feature (67)..(67): n is a, c, g, or t
  misc_feature (69)..(69): n is a, c, g, or t
  misc_feature (96)..(96): n is a, c, g, or t
  misc_feature (167)..(167): n is a, c, g, or t
  misc_feature (177)..(178): n is a, c, g, or t
  misc_feature (206)..(206): n is a, c, g, or t
gtgttagtntttctttaaatatttgttagaattcagctgtgcagcgatcgattcctggctgnctctntnttgggagactttttattattaccttgntcttattacttgttattggtctgttcaagtcttctatttcttcctgactcaatcgtggtaggttgcatgtntccgggaatnnattcatttccccagtctttccagttttntagtggtgtagtcattcataata

SEQ ID NO: 546881 - DNA, 545 bp, Homo sapiens
  misc_feature (145)..(145): n is a, c, g, or t
ctatgatctcgactcgttaggaagggagaatgtggtgaggtgctgtagttatgagatgggattatttttcccgtgaaaaaaatctgctggtatcaactcaatgaaatgtgtaactccaagggtacagacaagcattcactatccngcagggacaagccacttttagagataatagggcaatacagatcttacttaacctctcccacatctaaacactaaaactgctgaagtggcagcaaattaaaaaaaaaaatttactatgctaaactaaatgccaattaagaaagtgaaaaggccgggcacgggggcttacgccggtaatcccagcacttggggaggccgaggcaggcggatcacgaggtcaggagatggagaccatccgggccaaggtggtgaaacccggtgtctactaaaatttcaaaaattagcggggcgtggtggcacatgcctgtagtcccagctcctcaggaggctgaggcagaagaatcccttgaacccaggaggcagaggttgcagtgagccgaagtcgcgccattgcactctag

SEQ ID NO: 546882 - DNA, 771 bp, Homo sapiens
gctcttttgcctgctgccattccagtaggatgtgacttgcttctcctggccatggttgtgaggcctccccagctatgtggaactatgttgagaaggaacaacatgatctaagtctttagaaaccaagagccacgactagctgaggacacaagaattttcacaaaacaaagtagagtgattccatagatcactattatagctgcattaccagtcctaggacagaatatggatgctgaaaaatgattctttcaaagtgctgagttgttgcctcacgcccagttgtctggcatctcttcactgaaactattacagttagatctcatctctatgggtggacaggaaaaaattctgagaatgatatagtcgaagtgataccttgaaggtagaactgtgcactgtggtaataacagaaacagaaagacatttcttctatataaacccaggatgtcgtccagcggcagctcccatcccttctattgactggtttttccaggcttggcaggaagctcatcacttggatttcccgtattttcttgtcatgtatatatccatcccttttcggcacttggcaccctcctctcttctcatttaagggacagatcacactcttcattgacgcccatgtccttctttctggccatgtggttgcaaagactggggtgcctgacacatgcccaggtgtggattcttgcctgctcccggacttggatgcgcttgtccagcactttctcattctttcgccggtcgccctgcctccgtttgcttgcttta

SEQ ID NO: 546883 - DNA, 267 bp, Homo sapiens
  misc_feature (33)..(33): n is a, c, g, or t
  misc_feature (44)..(44): n is a, c, g, or t
  misc_feature (63)..(63): n is a, c, g, or t
  misc_feature (69)..(69): n is a, c, g, or t
  misc_feature (72)..(75): n is a, c, g, or t
  misc_feature (78)..(78): n is a, c, g, or t
  misc_feature (80)..(81): n is a, c, g, or t
  misc_feature (83)..(83): n is a, c, g, or t
  misc_feature (114)..(114): n is a, c, g, or t
  misc_feature (121)..(121): n is a, c, g, or t
  misc_feature (135)..(135): n is a, c, g, or t
  misc_feature (152)..(152): n is a, c, g, or t
  misc_feature (192)..(192): n is a, c, g, or t
  misc_feature (206)..(206): n is a, c, g, or t
ccatctgctctcgtgcttgaggggctctcaggngcaaacctganatgatgaacatcaaataangtcatngcnnnnggntnncnatcaaccgaattaactggggaaaccatgagncaatatngacataaataagcnaattgaactctgattanagttgagatagttgagataactgaaagtttgattttattncaaaagtatctccntactatatacttaacaattacaaagatttcacagtggagaagctggaaggcagcacctgaa

SEQ ID NO: 546884 - DNA, 413 bp, Homo sapiens
  misc_feature (27)..(27): n is a, c, g, or t
  misc_feature (224)..(224): n is a, c, g, or t
gatcaaggttggtttaggttttggtanaggtaaagtggcagcaaagggcccccattgtgccgttccttatgaggtccccccttttaggggcccttagggtgggtttcgcatggaaaaagccctttaggttaggggttcattgtggggaaccttgggcccctgtatgggggccccatggggtccccctggagccccgggggcccctgttccccctgggtcccccnggggggggcaaggggttttttccctctcctgtccctgtgttgagggcgggaaaaaaagggggtcaaacccccttccccccccctttcttacagcggggtggggggggggggggggggggtttttttttttttttcctttttttttcaattttagggtggccaaaaaaaggaaaagccgtttttttccca

SEQ ID NO: 546885 - DNA, 428 bp, Homo sapiens
ttcctttggacagagatgattttatggcgctgattttgctatgtaaatagccttttttttgagacagccccactctgttgccaggctggagtgcaatggtgcgatcttggctcactgcaacttctgcctcctgggttcaagcgattctcctacctcagcctcccacgtagctgagattacaggcgcccgccactgctcccggctaatttttgtattttagtagagacagggtttcaccatgttggtcaggctgttctcgaactcctgacctcaggtgatccgcccacctgagcctcccaaagtgctgggattacaggcgtgagccaccgcgcccggtgtaaataggcttttgcctcttgggataatcctaaattaatttttccacagtgtatttttacctgcagtatgatttgcttttctgttggttc

SEQ ID NO: 546886 - DNA, 527 bp, Homo sapiens
  misc_feature (127)..(127): n is a, c, g, or t
gcactgtagagactgacaacttaaactaatgtgtatctatttagactcctacatcaaaacttcatggaaactgcaaaccaaaaatctacagtagataaacatcatgaggaaaagcattcactatccngcagggacaagccacttttagagataatagggcaatacagatcttacttaacctctcccacatctaaacactaaaactgctgaagtggcagcaaattaaaaaaaaaaatttactatgctaaactaaatgccaattaagaaagtgaaaaggccgggcacgggggcttacgccggtaatcccagcacttggggaggccgaggcaggcggatcacgaggtcaggagatggagaccatccgggccaaggtggtgaaacccggtgtctactaaaatttcaaaaattagcggggcgtggtggcacatgcctgtagtcccagctcctcaggaggctgaggcagaagaatcccttgaacccaggaggcagaggttgcagtgagccgaagtcgcgccattgcactctag

SEQ ID NO: 546887 - DNA, 282 bp, Homo sapiens
agaggcacaaggaggttagagaaagaccatctgtgggggcagggatagtgtgtctgagctcagactccttgggcagggttgctgtggcctctgggcgatgggagtggtggttaacaggccaatggagttacgttctaagggagattatggctgcctctgctgcttcatacacatcaccagggaaataggggaaagccggcagtgacagaccacagccagcaaggccagtctcactcctgcagtgcttccccaacagccaacagaaccaaatttatatccatg

SEQ ID NO: 546888 - DNA, 183 bp, Homo sapiens
tgtctacggtttcttcgcatgtgtggtcaaggtggcagggcctccactctgtcactccgggtttatggcgggttcttctactaattcacgacttttcgcttcgaagcgacggcttctccaatcctgcatcttattcctatttctgctgttcgcgccctgaatgagcctacagataataagcat

SEQ ID NO: 546889 - DNA, 172 bp, Homo sapiens
tgactcagaggatccctgttgctaggctggagtagaaaaggggggcgtctctttgagcattaaattcagctaccaatggcagggcacggtgtctcacctgtaatcccatgcactttgggaggcaaggcaggcaggtcacctgaggtcggaagttcgagactagtctgaacaa

SEQ ID NO: 546890 - DNA, 132 bp, Homo sapiens
ctgccagatatctgataacctcttttctacataataattaatgttctcccttctcaactattatgaatgtactctgctttctttactgatgatcaatctaacgttccatattacattcttgcccatctctta

SEQ ID NO: 546891 - DNA, 768 bp, Homo sapiens
ggagcaagcccaaattgtctgccacggaaagtagagatcacccagtgcgggtagttatcaagcaaaatgacagtgagatcctacagagcacgagtgcccagaatggcagtgactcgtgcagcccagatggagctgctgcaactgcatggcttcagcattgacagcggcaaaaacaaccaaggcacagtagggcgtccatgtcgagcatcacgtacaatatcatcgatctctctctatgcactacggaacaccaaacctggcgaggcttagaatgaaagccaagagatgtgaggacgaaggttgccatggacgtagaatcaaatgaaggctgaaatgggaatactccatgcgtaatccggaaaattcgcacaaaccaatcagaacaggacacgagcacgcacaactactccactggaacagcagaagtgaaacaaaccccaatgacaaagaatcagcatggaaccaaaaaacaacgtggcgatatcaatccagtgatacaatgaaagaactacacagaaccatcttgcattgggagtgaggaatgtgcgaaaacatggcagttgcacaacgtcaaatttgctaacccaaaaagaagtgaaaatagcacgagcaaagaaacaacctggagatcgcccatgagaggatcacagaaacggcaggaacaccgcttgagaacggcgaggcaaatggcacaaggagaaacaaaagggaagccaaagaagatgaagactgggcaccatagggacatacgccagaaacggatgatga

SEQ ID NO: 546892 - DNA, 992 bp, Homo sapiens
ggtcgactcaacgctgtgtgtcgtgaaagttctacctcgtaccagccgatattgtgcatgatgaactgagtcatatcaatctctgacgccaatatggactgcgttgattctggcgactaacgatccagactactgggcatctgatctagacatggcggtggtgtcaactaaagagccatgtgaacacatttagtagcaagcgaggactgtcgagaatgccgaagatggagctccattcatatgtagtggccgtggcgatcgtatgtccactattcacgtgacatttctgtacgacgttgaacacgggggctactcgagccattcgctatctcgcttggtgtgatgattttggagaccttgcgaagtacatatgtgatctatcattgtatgccccggtgacactagcagacttcatctatccaaccatgatcaccacgtggatcatcatcgagagcgtgacttgttgcgtgctcctgaacttgatgtgcctgagtggctgcttgcgatgcaaattgtgcaagcgtggatctcttcgcaaccgtagatggtgcgaggaaccgcagatgttagcaatggcccgttcttgagccattgattaccaacccgtggggtgctggttagaaagagacatatgcgtatgggttttggttcgccatggatggacatctccagagaatgtgcgaggtgtccccatcggtggtatgcctcatgcgcctcttaacacagtccccacgtagacggtacgattggagtgaacgggacatacttcggttttaaggcggcacaagttgcggcgaacacggatattaatccactattaagacgtaaggagaaagtttggcgtgctcaactatattacgcccgaaagaaaagcgctcaaggcgattttttggctaggccaccgaactttttaacgttggtggtatggggcccctttaggcgttggcaatccccacttttcgtcctagggccaagcccaaagattgcattaa

SEQ ID NO: 546893 - DNA, 213 bp, Homo sapiens
ctcagcgtcgccgagtagtgggaactacaggggcccggcctgcgccagctaagtttttggtatttgtagtagagacggggttcaccatgtggccaggctggtctcgaactcctgacctcaagcgatccacccaccttgatctcccaaagtgctaggattactacagacttgagccattgcgcctggcctgaaattatctatttttttttcttg

SEQ ID NO: 546894 - DNA, 151 bp, Homo sapiens
gtcagaccctggtgacacaaatcagtgtggacgaagttgtgcgcaacaacttcgtccactatgatatgaagaagtgtgtggttgcacacgccgaagccccatacatgagctaagtctggatactcggagatccgtgtggacgaagttgttg

SEQ ID NO: 546895 - DNA, 115 bp, Homo sapiens
cctgagtgtaaacgacggcagtatagctgtatctggagtgtcacaggacggcgagtatagctgatcctgattgtaacaggacggcgagtcgtacgctgtttcctgattgtaacag

SEQ ID NO: 546896 - DNA, 283 bp, Homo sapiens
aagtagatgacgccatgaatatatacgtaaatgtattttggcgtacgttgggtctagggtgtagcctgagaatagggtagatcagtaataaagcctcctataatggacactacagctcctattgatagaacatagtagaaagtaagctacaacgtattacgtatcgtgacgtacgatgtctagtgattagtttgctaatacgatgccaattaggcgacctacagtgaaaagaaagatgaatcctagaggctcaagagcactgaagaacatccatttcatattg

SEQ ID NO: 546897 - DNA, 721 bp, Homo sapiens
agcggaactgtagcttatcagagaagctctgtagtcctacactgaagtgtgttcccttggctgtgcatatggggctgggtttggttgaacttccattctgtataaatgctagaacacagttactacagattgattcacaaactgcatgtgctggtgcttgaggcagccaagaatggaatgctcgtggaagagcatatctatatcttaaaaaacactcagacaggagttaacggacagctttaagtaagttccttgtgtctaccacttaatctttatcaactttgattttagttcagggcttagctcatggttggagaaaagtggaacataagcaatgtgcccattccaggtgttgaagaatccaggaagtgttcttaccttctgacttgtatgaacgttatagaacgcttggctttgctctaggttgtcatgttcccgaatgagccatctgtcagtatattcacttaattcttactaatttcagtcttcctgtaaaaggaaacaacttacatattgatgcttcaaatcctagaaagtgtagaagaggtttccttaaactgttaaaactatgagtgtctgtatataaaggatgtaccgttactcagctttctgctccctaaggccaaacagtgtttgtcttcagtgtgaagatttacctgtaaaagactacttgtagatgtcaagcagattatagatcatattatccaataaaatgggacct

SEQ ID NO: 546898 - DNA, 489 bp, Homo sapiens
  misc_feature (277)..(277): n is a, c, g, or t
cttgaaggatctggccgggctcagaattcaccttctacatttgagggaggtgctgggtaaattcactccatcgaatcatcaccaattcggcatgggatggggggcctaagatggatgcggggtatggtcactcggtggaacttcgaaatatgtggggtgaaacatttcataacgcagggcaaggtggtggagcacacccagcaataggaagggcaccgagtcttacatgtaaagaaaacgtacaagtcagcctggaagaaagcctcccccctcatgngcggcgggggagaaggccgagctcccgacagggcaaacagctcactaccggggaaaaatgctcttcccgggtgccgcgggggccacaggcaaaacatgatctaggtaaccagcccttcaggatccttagaaaacaaacgggatacacagacatgcacgggatacgtcacagtccagatgggacgcacgcacaaacagatacacacacaggat

SEQ ID NO: 546899 - DNA, 426 bp, Homo sapiens
  misc_feature (3)..(3): n is a, c, g, or t
  misc_feature (38)..(38): n is a, c, g, or t
  misc_feature (59)..(59): n is a, c, g, or t
  misc_feature (411)..(411): n is a, c, g, or t
  misc_feature (420)..(420): n is a, c, g, or t
canacaaaaacaaaaacaaaacaaaacaaaacaaaacnggtaaggattccccctgtttnccctctctttaattttaaagttatcagttcccgtaaagtcctctgtaacccaaacatactgaagacagcaacagaagtcacgttcagggactggctcacacctgtaatcccagcactttgggagatggaggtaaaaggatctcttgagccccaggagttcaagacccagcttgggcaacatagcaagactccatctcttaaaaaataaaaatagtaacattagccaggtgtagcagcacacatctgcagcagctactcaggaggctgaggtggaaagatcgcttgtgcacagaagttcgaggctgcagtgagctatatgatcatgtcactgcactccagcctgtgtgactgnatacagatncctaac

SEQ ID NO: 546900 - DNA, 108 bp, Homo sapiens
gtttcttctacacacctgtctccctgaagggctgggacagccctggtacgattcaggtgaaattagcaggctggggattcacggtgggacagggtgacggcagacgct

SEQ ID NO: 546901 - DNA, 715 bp, Homo sapiens
cctgtaataccagctactcaggaggctgaggcaggaggaatcgcttgaacctaggaggcgaaggttgcggagagccgagatagtgccattgcactccagcctgggcaacaagggcgaaaacttcgtctcgaaagaaatagaaaacatacactaaaaaaaaactccatagaatctctgcgagactgctggggacgtccgcactgaaagacagagaccatgacccgggaacctgaagggtcaaaccctggggaggtctcagggcctagtttctccactcacgtgaagatatctcagggataaagagtgtgagtgcctcgcccaggttgagggggcctcacgccggttcacgccggtataatcccagcacttggggaggccataaaggggcgggatcacgaggtccgatcaagaaccaatccgggcttaaacggcgggtgaaacccgcgcgtctacttaaaaatccaaaaaattagccggggcgtggtgggcagacgcgccttgtagtcccagctactcagggagggcttgaggcttgaaaatcggtttgaacccggggagggcagaagattggcagtgagccgagatcggcggccattggcactcttggcctggggcaacaaggagcaaaattttggtctcaagaaaaggaaaactggcgttagaaatggcgcttcaacgttaaggtcctggggagctacgctaattcatgggagag

SEQ ID NO: 546902 - DNA, 1047 bp, Homo sapiens
ctttccccgggcagggcagagccggtctcacccccgctctctccccggccccgcgccgctatggcgagagggagccccctcccaacccgggctcgagcggcggcggcctcagccggtcatctggaactatcgtgacgaccaggcgggtgccgtcccgctcgagcgccagcgcctcgcggcactccgggcacacccgatccagttcccctttcctccccatccctcacgttggccggcgtctgtcccgcagacgcaccgactccgaacgcgtaatgcacaatgacggtgagtaacgagggcccccggatgacccctggtacaccacctgtgaggagcctaaacgctcatgccagagggacgcgaggcacgacggatcgcagatggaaacgaggaccgcgtaagggacacgcccaccaacagggactaagccaccgcacagacaccaaaacgcactaaatcaaggagcggattgccacagggaccgaagcgacacagcccaccacagaggcgaccacagcgcgcggatagggcaacgacgcgacaaagccactaggagcaagcaccaggaaggagcacacagcagggcatggaggaagcgataccacgccctaacaccactcatagcgctggtggcgaccaccacaccgagagagcgaagcaatgcaagaaaacgacacacgcaatggcccaaaggctacacgcagccagcggccgaagcactagacgacaggaccaacattagcccgcgggcacaacaaccactgcgggcaaacgcggacaaaagccaagcgggaaggggccaccacacacaccacgaagagacatagagcagagcaaacaccaacaaatggcacaacacggtacccgcaacggaacacagcacccggagaaagactatggcgacaacaccgaaacaaggcagaaccacgcagtgacactctacaaaagatacgaaggatacgtgcgcaactcaatggaaacaggacggacaacacgacacacagagcgaaaccaagagagagacaaacgagcacaccccagcgaaga

SEQ ID NO: 546903 - DNA, 851 bp, Homo sapiens
cgcggtggctcacgcctgtaatcccagctctcagggaggctaagaggcgggaggatagcttgagcccaggagttcgagacctgcctgggcaatatagcgagaccccgttctccatgaaaaagggaaacaaaaaaacacaaaaggacaaaaaaaaaaacaaaaaaaaaaaaaaaaaatttttgtgcgcggcggctcttggcctcccagaaaagtgttttaaaaaccttttgcggtgtgggcggcgcgggggcgcccacaaggaagtggaaaggagcacacgtgtggcgccacagagggtggccccccaaagagagaacaccgtggtggccaaagagaaaaggggcgcgagggggcttctcacacacacaatataaaaaaagcgcggccgcgggggggagaccaacacgagagcgtgggtctttggcaagacaaaatctcccagaaaagggggagagtacagaggaggagggcgcaacaaacaggggggacgcctctaaacaacaacagagggggggctccaaaaagagagaaacggcgcaagattatccacaaaatttaacgccagcgaaacacccacacacgtgtggtgggggtggtgagaagagagagaagaaacagataaaaaaaaaagaacggacgggacacggacaggcggagaaggaagacagagaaacccgcgacacgaacacagaccaccaaacgaacggaaggacggagagagcagagacgacgggagcgacagcgcagagacgacgaaaaccaagcggaagagagacaacggagcgcagcaccccaacgcaacacaaacacccacagagaaagacaaaagaaaaccacaacagaaaaggaac

SEQ ID NO: 546904 - DNA, 1163 bp, Homo sapiens
tttttttttttaaagggggtctcatttatggtcacggttccaaaggtacaaaaaaaattagaaaaatacccccgaactcaaccccacccccgacaacatgttcccccaacgacaaataatttttcccaaaaccacaaacataaacggggtccggggtattaccataaacgaggtgcagcctaagaaacgagttatagaagaaaaattataacagggattcagaattatatcacattcgtggtcctctgcgggcccgtggagagagggtaaataattcccatagtggggtccatagtcctgccccgaaggggttttcccgatctcgtgagtggacaaagctcctttataacaaaggtgggtgttgggcatacggggttaagaagatcctccgtggtgccttcttcttcttctggggttttctcttctggtgaatctacaggggggttgggagctctctcttgggtagactagctaactaaaatcactttaattcagggccaccgttcactattctcttgggacttcagctctctgggtgggccgggagagaagcatagtgggtaggaacaacctcggacttccatatggacgacaggcccatccatgggtctgtggcactccatactgggctatgacgactatcggggatctatggcatgagcttctcgccaagttcctaaatacacctgggctccagagtcctaacaggggaccaacaccaaagggcgcataaaatcaaaacagacaccagtctgcagtgcaatacaccacatagtacaacaaaaatctcggcgaaccaaaaaacatacaaagagacccaacagggcacacctaggaacaggctccacagcacccagagaatcacactcaaaaatggcccccaacagggaacccctggagagacgcccctcacaaagagcatcccaatcgcggaagaacagcctcggagggaaacaaaaactcgcccaaaaccgactcccgacagacaaaaaggaaactcgcccaggagctcccagaaacaacagaagagacagtgacaagcggcgcgggtcaaacacaaaacaggcagtgtccacagacgaagagctggtgaccaaaacgaggatcgagtgacgacaacgcgagcaagcaacgcaaaccaacatcggccgacaaggagcagc

SEQ ID NO: 546905 - DNA, 263 bp, Homo sapiens
tttccttattcaggttgagcactcctgagtagctgggaccccaggcgtgtgccaccatgcccagctgatttttgtatttgtgatggagatggagtttcaccacgttggccaggctgacctcgaactcccgacctcatgtgatccgcccgccttggtctcccaaagtgctgggattacaggcgtgagcaccgtgcctggcatggccaagttttatagttactctagctatggagtagatgttttcagttcagaattagggaatt

SEQ ID NO: 546906 - DNA, 387 bp, Homo sapiens
ttcggcacgagcttgccaatccatttcaggaaatttacaatcatataacaataatggtatatcatttgccatttcgtaaacaggcctttgaggggttttctcaatatcagtcagacgcaagacaatttccggcacttcaagtgattgaccaactaagaaaagaatggccatcatgcaacgaacttggtgccataggaatgctgaaccaatgagatcaaaacaatagaaagtttcagaaaggggaagaatttttgagcttattattgttcgtttaaaattggtaatttgttttgagccatcaagcttacaaaaattcctgaagtctctctctccaacaaaatatgatgcggctttagacattttttcaatattaaggttttttccatt

SEQ ID NO: 546907 - DNA, 113 bp, Homo sapiens
  misc_feature (107)..(107): n is a, c, g, or t
aactcaaataggagctaaaaaaaaaaaaaagaatcaatgaaacaaaaaattaattttttgaaaaactaaaattgatagcactagctagactaaccagcaaaaaaagntagcaa

SEQ ID NO: 546908 - DNA, 523 bp, Homo sapiens
ccacccaaaaaaaataataaaaaataaaaataaaccaagtaggcaaggctatggagttaagggaacgcttaggaacgcttatgcgctgttggtgggaatgtaaacgagttcacccactgtggggcacactttgtagatttctcaaagaactgagaaagcaactagcatttgacccagcaatcccactgctgggtgtatacccaaaggaaaataaatcgttcaacggcactgcgcccgtatgttcattaccgcactatctgcaatagcaaagacacagaatcaacccaagtgctcatcaatggtgacttggataaagaaatgtggtgtatatatactacggaatactacgcagccgtgaaaaggagggaaatcatgtcctttgcagccacatgagtgcagctggaaaccattatcctaagggaactagtgcaaaaacagaaaaccaaataccacatgttctcacttaaaagtgggagctaaacatggggtacacatggtcataaaaatgtgaacaagagacact

SEQ ID NO: 546909 - DNA, 360 bp, Homo sapiens
  misc_feature (29)..(29): n is a, c, g, or t
tctctgataattagaaggctacaggaaantgttttgttttgttttgttttgggtttctttgtgtgtttttagagacaggatcttgttctgttgccccaggctggagtgctatggctcaatcagagctcactgcagcctcgaactcctgggctcaagcaatcctcccacctcagcctcccaagtagctagaactacaggtatgcatcaccacgcctgactaattaaaaaaaaaatttcttttggttgcgtgcggtgtcttggcacccgtaatcccagcactttgggaggtagaggtgggagcatctcttgagcacaggagtgcagggctagcctgggcaacatggcaagaccctgtctcta

SEQ ID NO: 546910 - DNA, 292 bp, Homo sapiens
tttttgggtcatggaacacacacaggcgcacaaaatataggtaccaagtgtgatgaatactctctaatttgctcatctctctcctttcccttgagagcgcacaactcgagaaaattagagaggtgcgatgtctatttccactgcgtgacttggtgacgtctgacctgacgaggcagcttcagacgcacaggcatcagtgcgctgctagctgctctctcgtgtgtacagctacagtactacgtctataacctgagactagctgactctagagtaatatatatataccaaaaaa

SEQ ID NO: 546911 - DNA, 119 bp, Homo sapiens
ccgcggtttatgtttttacgagctaaaggtctaattggagctgtagccaggctaagaggtatcactggagctgtagccaccggcctacaccagcaccacatgcaagtgcgggatccgag

SEQ ID NO: 546912 - DNA, 183 bp, Homo sapiens
agcgctcagtgcccgagctggtcccctgccattccgggaccttttttggagacattttcgagtccaccacccgagtcaccctgcagtggccacacccacaggcccccgtgcctgcagcactactggtgcctgaaacacctggcctgctaggaggctccaataaagctaacccggaccagaaaa

SEQ ID NO: 546913 - DNA, 263 bp, Homo sapiens
ctactactactaaattccggctcctcgaccttccttctaaacctgtgcctagtgctttagagggaggaaaatctggccaggtgcagtggctcatgcgtgtaagcgcagcactttgggaggccaaggcaggtggatcacctgaggtcaggagttcaagaccagcctggccaacatagtgaaaccctgtctctaccaacaaaaggaaagaaacaacaaaagttagccaggcgtggtggcgcgtgcctgtaatcccagctactcag

SEQ ID NO: 546914 - DNA, 789 bp, Homo sapiens
aagtggggattgtttgtatcccaaaaagaacacagttgggggatcaaatgttgatactaacgagagaaagtggcctttattaaaagataagaaaaaagtatggtcgacaaaaataaacgagataaaccattgctcggtatgaaagaatatatattagaattgttggatacattacggacacacgcgtctccatcatcgtagggatgcgcccccccccatgtacggttacacagggcgcgagacaccccccacatcgtgacataattggtgcaagaccgctttacacaggcctatattacaagttacacctcgccgatcttggggtggcccaccacaaaatatgttttatatcaacgcggtacatacacctcgaggtgacaaatatgtatgcgcgagtgatagtggtctcacagacacgtgtcatacacacacgcatataaatgaggagagtggacaaacaattttcatacgccgcccccacattggtcttagaggtgtgaaaacatatacgccgcttggggcacacactttctttttaaggagagaacaaaacaacacattctgggcgtccgtccacaattgcgggggacttcaccaaatgaaaagtcgggggccgcgcaggagagagatgggctgtgagttgaaaagcggcgcgcatgacgtcgcccgcaagagtggctgagcgatgccctcgcgatgttgtctctacgggaacttggtgcagcaccagagaggggaaaaaggagtgagagacaagcagaacgagaaggccgcggcccacattagcaa

SEQ ID NO: 546915 - DNA, 266 bp, Homo sapiens
aacataccttaccaggagaagaaaagaaggagaagaggaaaaggaagcaggcgaccagacaaggcgaaggcagaggcagaagaaggagaaagaaggcagaagaagaagaactaagaagaactaagaagaaggagacaggagaaggagagacgaaagaagacaaggagaagggagcagaagaactaagaagaaggaggaagaaagaaggagaaggaagaagaaacatggagacggcagaagggtaggtatgatgaagaaggaagaag

SEQ ID NO: 546916 - DNA, 1034 bp, Homo sapiens
tattacagctctcagggacttataatatttccagtctgtacacaaataaccagggaatgttggaattgggtgggtggaaagctgggatgcaagtcatctctgcctattacgacaaaagcctatcgaccccagcagccagcacaggcaggtcctgcatgctgaagcaagcaatagccgggagaataacccacaattatgaaaagctaaggtgctattttcttaccgattcccacccagcagcagtgctattattcccatctccccctcccagtctttcctccggcccaatacattagaggcaccaagggtgaaagaaccgcgggggacggagggtgtaatgcaggttcttataagatacggcacacagatgaacgcagtctcctgtgacgcttaggggtagacagaaatcgacgcgggcaaaagtatcaaccctcggagatgcgagacggagatcgtggcgggcagcacgcccctgtgcgtcctgtcgcgcgtatgggatcaccattcctcgggctatcccgtatgttctttccgcccacgtctggccccggagataaactatcttgtgggggctcgttaatgtcacactgtatgggcgctcactggcgacgtgttagcgcacattatcgcgaacttcgcgagtatcgatacgagtacacaaacatggcttgtcctttgacccccaactgtcattgttttccccgctgtgtgggcctaggcagctccttgcgggaacaggccacaactgtcccatacacaataaccacgtgtttgcacaatgcgctcgtgaaaacgatagcgccgtcaagaaggtaggtgcccacactgaacaggagcaggtcggtagagaccctgtgaatcaagggagaacgataaaagagccagaacagccccaattgagtggtaccaaacaacagaccggtggagcaccgacagcacaatcgtccacgagagactaggcgacgaacagagaccaccagtaaagagcgggtctgaattgacaggaagcacgggctgcagtgaacaaatgtgtc

SEQ ID NO: 546917 - DNA, 452 bp, Homo sapiens
  misc_feature (3)..(3): n is a, c, g, or t
  misc_feature (75)..(75): n is a, c, g, or t
  misc_feature (99)..(99): n is a, c, g, or t
  misc_feature (105)..(105): n is a, c, g, or t
  misc_feature (108)..(108): n is a, c, g, or t
  misc_feature (123)..(124): n is a, c, g, or t
  misc_feature (132)..(132): n is a, c, g, or t
  misc_feature (150)..(150): n is a, c, g, or t
  misc_feature (156)..(156): n is a, c, g, or t
  misc_feature (159)..(159): n is a, c, g, or t
  misc_feature (174)..(174): n is a, c, g, or t
  misc_feature (194)..(194): n is a, c, g, or t
  misc_feature (199)..(199): n is a, c, g, or t
  misc_feature (204)..(204): n is a, c, g, or t
  misc_feature (212)..(212): n is a, c, g, or t
  misc_feature (249)..(249): n is a, c, g, or t
  misc_feature (264)..(264): n is a, c, g, or t
  misc_feature (267)..(267): n is a, c, g, or t
  misc_feature (269)..(270): n is a, c, g, or t
  misc_feature (277)..(277): n is a, c, g, or t
  misc_feature (279)..(279): n is a, c, g, or t
  misc_feature (291)..(291): n is a, c, g, or t
  misc_feature (300)..(300): n is a, c, g, or t
  misc_feature (302)..(302): n is a, c, g, or t
  misc_feature (321)..(321): n is a, c, g, or t
  misc_feature (369)..(369): n is a, c, g, or t
  misc_feature (386)..(386): n is a, c, g, or t
  misc_feature (433)..(433): n is a, c, g, or t
tgntttgagcccagcagggccttgagcatggcatcggccgatatgcgcaccctccgcagtgggggccgcttgaanttgccccgcagatcaaatagcttntggttnatnttctccagctccttnntggttttntgcaccctcacctccatnttgtanttntcctcttcagccgcntcgattttggcgtgcagctntttgnagatntcctgcanttcagaaatggagcccgggatatgcagcggcgggcanttctccgccaggtanttntnnttttttncntcatggcggctnttctccttntncagctccgtggccgctatntgcagcatcacgctcttcaggtgctgcctgcgggccgtgatggccctnttccgcttctcctcatntcccatcctgaggtcctgagcttggagcctccttcaaggacaatgtnttggaattccccagggtga

SEQ ID NO: 546918 - DNA, 214 bp, Homo sapiens
tatttttctgtgaccatcaattaatgatagcatatgctttaactctggtagcacaaaccctcattaattgatggttgtgctaccagagttaaagcatatgctatcatgtatctttaagaaccttattttgataaaatgtaaattgtgaaccctgcacatttagtatccccaggccccaaatcctgttccaatgaaaaaattaaaacctgatacg

SEQ ID NO: 546919 - DNA, 365 bp, Homo sapiens
accactctgggaggccccgacggggctgatcactggaggccaggagtctgaggacagcatgctaacatggtgaaaccccatctctagcaaaaatacaaaatatcagctgggaatggtggtgcacacctgtaaaatcagctactataagaggctgaggcatgagaatcgcatgaacccaggaggcagactgcagtgagccaggatcgtaccacagcataaccagccagggcaacagagagaggctagtactcaaaaaattaaaaaaaagaaaataaacaaatgtaacatttgtctagcatgcttcaaaaatgttaagtcatgggccagagggagtggctcatgccagtaatctcagcactttggga

SEQ ID NO: 546920 - DNA, 382 bp, Homo sapiens
ggtataatatgatgtcatgcagccaatccaaacgggagatactactggggtgggccggtcaacttggacattgcaaaacatgggacaaatgattgggtagtattggatgaatgggaggggtcatggtactcaatggagaaaatgaattttaaaaataaggccctttttccacacaaattgtccccaataccgtaaattttggttttttgtgttggaacaacattttggaccatatatgtatatggaaattttctttaatcacattatattcctataaaactctcaaccacacgagatgtgacattttgtgagtgtaggatatattacactttagcacatgattctctttggttctctacatttctctcgctcaccaagagtc

SEQ ID NO: 546921 - DNA, 339 bp, Homo sapiens
tagccctcatctcgtccatgtcctccacattgccagttacatcctttgctacatgcccctcgttattttactgttcggattagtgcatgatacccactcagcgcatacatgaggtttaactaccttgcgaccgcaatctggacagatttgctccgttgatggaataataccgttcacacaaccgtatccgcacatagtgcttcgatctagttctatcaatatagcccttaccagcattaatcagagcgaactcacctgattttggtatatagtcgtggatttgtttctgcaatgcaaaatccttggatggtgtgagattattctacaagtctgggtcag

SEQ ID NO: 546922 - DNA, 375 bp, Homo sapiens
atcctaactggctatataaatagacagctgattccaacattctaccataaaaatccaaagaatgttgaagagccaaacagctttgataaaagtgagacaaaagttaaaggatacacattatctgattccaaggcttcttataaagctacacgtcattgattctgtatggtactggcaaaaggagagacacattctatgtatctatctgtctatatatctatatggaatataataaagagttcagaaatagatccacaaataagatcaattgaattttggcaacgatgaaaaaataattcaatggagccaggacagaattttcaataaatgatgctgaaacaattagacatccatatgcaggaaaaaaatgtttga

SEQ ID NO: 546923 - DNA, 246 bp, Homo sapiens
cacgaggtccatctacgagaccacgcgcctgggcatgttgaaagtcacaccggctgcgatcctgctggtagcgcaggcggtcactggcttcctggtggaccccgttccgaaccagcgcctgtatgtccacgaggacgtgtatgcggctgtgacgagccccgagcttcacaaacagatgttgtctgccgaaaatgccgtcatcggctatatagacccctactccgccagcatcatctccctcttcca

SEQ ID NO: 546924 - DNA, 379 bp, Homo sapiens
ggcatttcctttcccttcctgttttcctctcccttttcctttggtgcagcatgatttttttaattttcagaccctccctattttcatgaacagttaccctctgtccccccaaccaaaaacaactcatggcctcctttggcccctgtgtaacctttccaacctgtggctttgccaaatggaccccggtcccaaagggatttttttttttttaacaatgatatccccgtttgggtccctttttaagcttgtaacccccccccccgacttataatttttaatgtattttcctttgtttaaactgctgcttcctctgtttccttggattgtgcccgttatcagtggcttttgggttcaaagtaataaaaaattcccaaactta

SEQ ID NO: 546925 - DNA, 134 bp, Homo sapiens
agagggtcagtagaagatagagaccagtgctgataggacagaacaggcagtgtctgaaaactagtccgataccatcatggtctttgagggaaaatctgattccactggggttatcatgtccactagtggactca

SEQ ID NO: 546926 - DNA, 289 bp, Homo sapiens
tttttttttttgagatggaatctctctgtcgcccaggatggagtacaattggaaaaacactgctcaatgcaacctctgcctcccgggttcaagcaattctcccgaattagacttccgggtatctgggactataggggcccgcgaacaagaccgggttattttttggatatctaagtgtacagatgggcgtctcaacactgttgaacagtctggtctcgaatctgacctcgtgatatgcgcgcgtctggctctcaaagtgctgtgatctcacaagatactctgtctagac

SEQ ID NO: 546927 - DNA, 205 bp, Homo sapiens
cccaggaggcggaggtagggtgagctgagatcatgccatagcactacagcctgggtgacagagtgagattccatctcaaaaaaaaacagacttccagggaagggaccagggcaccattcgtaaggtgtacacttcgtggtatttcaaagcatctagtggccctcacaggatagtaactggctcagctaaatcactggtaggaaat

SEQ ID NO: 546928 - DNA, 356 bp, Homo sapiens
agatggagtctcactctgcaggcaccctggagtgcagtggcgcgatcttggctcactgcaacctccgcctcccgggttcaagtgagtctcctgattctcctgccacagcctcctgagtagctgggactacaggggtgcgccatcacttctggccaattttttgtattttcagtagagatggggcctcaccgtgttagccaggatggtctcgatctcctgaccttgtgatccacccacctcagcctcccgaagcgctgggattacaggtgtgagccaccgcgcccggccgcaacctcatcttaactaagtccatatgccgacgaccgtagtcacaatagggccacattctggtcgac

SEQ ID NO: 546929 - DNA, 107 bp, Homo sapiens
  misc_feature (14)..(14): n is a, c, g, or t
ttgggggggggggncccccccccccccccccccccagaaagggggatgttggggggttggaagcccttgaacttttttttttattaaaaccttgttttaagccgcca

SEQ ID NO: 546930 - DNA, 1553 bp, Homo sapiens
  misc_feature (425)..(425): n is a, c, g, or t
  misc_feature (998)..(998): n is a, c, g, or t
  misc_feature (1011)..(1011): n is a, c, g, or t
tggacaacaattaatttatttattggaggggtgaggcaggcaagcggggagggaggtgtaggggtgacctcttcttccctcacaggcaccaggccttggtttctcctcccagaataagcataaggctcggcaggggcttgaggggaggtgaggcagggaggagtgcagtggggccgtggtggaaactcagagaaaagcgtggggctcagaggttaggaagctgtgcacgcgtgtgggggggtgtgggggggtgaaagggtggaggcagaggctcaagaggtgtgaactgtggcagcctcggagaggggaggggctccaaatttaacaccgaggaactttgcgaggtgtgttagaaagttaaagagtggggcacctcactagagagggtgtgaacacagaagaacagttgtgggagtctcagaganggggatatctcagaagaatctccaagagaagaaaagtgtgtgggtgtctccagagagtgttagagaagccgtggaggcccacagggtggggggggttaaaggagggtgaggccagaggctcagcgcggggagaaaagtgggcaagcctcagagaggggaggggtctcaaaccattaaacccaggaacactataaaagggctcataagagggttaacaaagggggaactcccagggggggggcagagagggctccaacgcggtgaagccacaaagttccagggggggtgcaagggcaagggtctcgtgccaaaaagctctcaagagggtggccgggttctccagaaagtgtgcaaacaaaggggcggtgaacacgcggggggacctccccttccctggggggaagagtggctccacaggggctggtggaaacaggaaggcccccaagggggggcgtcataaccgagagaactaaccatcttgagggggccctccccacaggggcggcagccccccagggggcgttccggggaagaatactaacaaagttaccgaccccagagaagtgttttaanagagcgggaaagntccccacaagggcggtttcttgtgggctacaggggcgaccacggggggcgggaaagatatcaccgcttgggtgggggaacaacgcgggggccgcattaggtggtctcaccaagactgggcggggggccccaaagcgggggagcacccacaaggggtcaaaaaaagcctccgaagggaaccatcataaagttccagggggggcgggcacacacagacgcggttatatgaaaacatgtgggcccagtgggtgctccacaggtggtgttccggtacaccgcagagttttcttgtgacacacggtggtgaaatcgcgggggggcccccaaaaaaggagaggcgaacaataatggcaaaacacggtactaagcttgtgcatcatagcatcacctaataatacacacaatacacaacactgatacaacatcaaaacaaaagagaaaaacaaagactaccatagtcactaactcaaacgaccaccaaaacagtcatagataaagtcgaataagacatatgcaccaacttacaacagagcagcaaaccaa

SEQ ID NO: 546931 - DNA, 335 bp, Homo sapiens
agtacgataagcatagatgtcttatttatttgtttctgtcttgtacggtgtcaactcgtatgcttcagtccttctcttattggattaggccaactctaaaccctctagcttatagtatggcattttcctctccaaagaaataagagctcgcccttctcagcctttcttaggcaactgagaattacatgagggtgtctggaagaaacactccctaagatgtgcaacggctctgagtaggatttcccctcagaagaacgtacttagggtgtaatctcagctagcaggtgccaataaggagctgatctcccatgccttgagcccctgacacactgtgc

SEQ ID NO: 546932 - DNA, 1407 bp, Homo sapiens
  misc_feature (621)..(621): n is a, c, g, or t
ggctactctctctaagccatacagtgccatcctcatctctgaagcgagacacgctctcgcacaccgggcaagactgagcaggatacccttcgtggcaccctcaaggtgccacaacggactgaggtaacacacagcatcggtcatactgaccccgtcagttttccctgagaacagtgatcctgctcctgaactcgtcgaatgatataggaccagtcactgctagtgtcgggaacacgtagtaacactaggggatggaagacgcgaaactatcggaatattccacacgtcgtgctctgcgtgggtccaatcccactatgtgtgtcaggtgatagtagagtcttatctgctcgtcgaggagtggccgagatgtgtgcccatactcagagcttcgcatgggactggaacactcatgccgcaactcttggggatctgatacacagggccaactagccacgtaggctgactgccgtgcgaggccaattactcacagggagtgtggctcgcacggtagttgcgccactttcctcccgtctgtacgatacccgaggagcatttgtcatgcgtagcggattctccgaagcattcgacaacgccattactaagggctttattggggaaatnagttcgcctgcggagtgatagttgccgagagataaccacatggtacgccatgggcacttgaaagaacgccaaacggtcgaacgaaggttcgcccgtagtgccgttagtttgttgcccggcattttcatccagctctccgaaacccagcgaggctaaacccgcttgaattctaatcctaggtgcgtcaccgttagattacggcgttagtggcaatagaggcggtagggttcccaaatcgggctaccatatgggcacaacccgtcgggcatcacaagcctttgacctacaaagcggcctgtgacaaggaaccacagaaatcccgaacttagttttggtcggccaaccagcctaggggacctctaatgcatgtaggacaaatcaagcgggcgcttggacgcttgggattctttccgttcacccaacgtattcgggaactccccccatactatgtgggccttgtcactgctggaaccgtgggcaccgcgggcaccacttcggcggccacgttggcccacatctggtttccatcggcggggcaattatcttccaaaacctgcacacagcggcgcaaaaacacatccctttttgaaatcagcagggcttaaaggacatggggtgcggggaaaaccaattccattaccaaactggtcagcctggataggccttcttccaaagcacccctgtaacacacggcgttaagtatgcggctcttaggttgttagccgttgggcctatcgagggggcccaccacagtgcatttccataccggaattcctctgcggacga

SEQ ID NO: 546933 - DNA, 167 bp, Homo sapiens
agagaacgagaagaacgaatcattacaggtcctgcaataaaatacactaggactttctacatggaaggtggagaaacagaagacactctgaagaaattgttacaagaatgacacacccagtgaataggaagttcctggggatcctcatacgcgtcgcacctgcaggc

SEQ ID NO: 546934 - DNA, 103 bp, Homo sapiens
gatagaattcgagtcggtaccttattgtagagggtttaatatccaaacataggtagatacaatcagatcaagtgttagggagggtgaaagcctgtaatacaag

SEQ ID NO: 546935 - DNA, 512 bp, Homo sapiens
tcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtagaggcccatataaaaagaccaaacaacaagctagagatacgagatagagtagccagagaccagagaaccgaaacacggaaggagtaccacccagcatagaagctaagactagacccgaggaaggtcctcatgtttcgtgcctgtcattctcggatg

SEQ ID NO: 546936 - DNA, 380 bp, Homo sapiens
atcgcacggtcggatgtgctgcactctaaagttcgacgttgaactcgcccaaatagcaagacaaacgattgttatggaaaacatgtacttcccagtatgtagaggtttgacacttaggatcaccgtaacatttaaagcatgaggcccctctccctagccccgaaaactggtagggctgaacgtccaaggcaccgtgagtcgtggaacgtttcttggccagcgtatcacgtcgaaggtcgtgacatcaaggcgaaggctcccaaggtcaagatgccagatgtggacatctcagtgccaaaaatagagggtgacctgaaaggccccaaagtgcaggcaaacttgggtgcacctgacatcttaatctggggcccaagcctgct

SEQ ID NO: 546937 - DNA, 1078 bp, Homo sapiens
  misc_feature (50)..(50): n is a, c, g, or t
  misc_feature (65)..(66): n is a, c, g, or t
  misc_feature (115)..(115): n is a, c, g, or t
  misc_feature (120)..(121): n is a, c, g, or t
  misc_feature (148)..(148): n is a, c, g, or t
  misc_feature (162)..(162): n is a, c, g, or t
  misc_feature (170)..(170): n is a, c, g, or t
  misc_feature (176)..(176): n is a, c, g, or t
  misc_feature (203)..(203): n is a, c, g, or t
  misc_feature (210)..(210): n is a, c, g, or t
  misc_feature (235)..(235): n is a, c, g, or t
  misc_feature (237)..(237): n is a, c, g, or t
  misc_feature (316)..(316): n is a, c, g, or t
  misc_feature (329)..(329): n is a, c, g, or t
  misc_feature (341)..(341): n is a, c, g, or t
  misc_feature (344)..(344): n is a, c, g, or t
  misc_feature (349)..(349): n is a, c, g, or t
  misc_feature (368)..(368): n is a, c, g, or t
  misc_feature (492)..(492): n is a, c, g, or t
  misc_feature (523)..(523): n is a, c, g, or t
  misc_feature (525)..(525): n is a, c, g, or t
  misc_feature (530)..(530): n is a, c, g, or t
  misc_feature (553)..(553): n is a, c, g, or t
  misc_feature (555)..(555): n is a, c, g, or t
  misc_feature (559)..(559): n is a, c, g, or t
  misc_feature (564)..(564): n is a, c, g, or t
  misc_feature (575)..(575): n is a, c, g, or t
  misc_feature (580)..(580): n is a, c, g, or t
  misc_feature (630)..(630): n is a, c, g, or t
  misc_feature (638)..(638): n is a, c, g, or t
  misc_feature (646)..(646): n is a, c, g, or t
  misc_feature (770)..(770): n is a, c, g, or t
  misc_feature (793)..(793): n is a, c, g, or t
  misc_feature (860)..(860): n is a, c, g, or t
  misc_feature (1023)..(1023): n is a, c, g, or t
  misc_feature (1057)..(1057): n is a, c, g, or t
ttagtgtttgaacagccactggctcccgttttttgtgccccacaaggggnttactacgcgtgccnnctatgagaacaaagtttgctccctcggcgcccgctgcagcaagatgctnaacannggtggagtgacataccgtgatcagccntggcatcgagaatntctgtctntaccgnatgccagacgccctggcagggcagcanttcaccncccgggatgaagatccctactgtgngnctgttttggagaatctttgcacctaagtgcagcagtgcaagcgccccatcgtaggactcggtggaggcaagttgtgtcntttgaagaccganactggcaccacnacngcttntcctgcgcccgctgctctncatccctggtgggccagggcttcgtaccggatggagaccaagtgctctgccagggtgtagccaggcagggccctaagccagggtcttcctgtgatatcaggctttcccataccacgggcccagnactgtggctccttttctaaaccacctctggnantcagntccccccgccaaaaaaaagggtntncttntgggntccagtttgtntcccnatccagcatccccaaactggtactccctgacccaggcccccaatcctggntctaacanagcctccntgagtcaagccccctccccacacctggactccagaattcaccctctcccctgcagtctgggttcccagattgagtcctctccccaaatcagggctctagacccgagccctccaaacctggactntgggacttaggcccccttaaatntagacttctctttataggtttcaggtctcctatgggtgcctgggaagtccttgaaagtggactgttntcaggcttgacctgccccaccccatccccgcggttgaggctgtgggggcagcagatcaggagcccactgataaggggccctagggtacagggtgctgcccagcaggtcgccaccgagtgtcttctcattttatttcagctccattttgcccataaatgggcanaggggtgagattggctcatcccccttccagattntgcaataaaacggtgtgagga

SEQ ID NO: 546938 - DNA, 1050 bp, Homo sapiens
  misc_feature (50)..(50): n is a, c, g, or t
  misc_feature (65)..(66): n is a, c, g, or t
  misc_feature (115)..(115): n is a, c, g, or t
  misc_feature (120)..(121): n is a, c, g, or t
  misc_feature (148)..(148): n is a, c, g, or t
  misc_feature (162)..(162): n is a, c, g, or t
  misc_feature (170)..(170): n is a, c, g, or t
  misc_feature (176)..(176): n is a, c, g, or t
  misc_feature (203)..(203): n is a, c, g, or t
  misc_feature (210)..(210): n is a, c, g, or t
  misc_feature (235)..(235): n is a, c, g, or t
  misc_feature (237)..(237): n is a, c, g, or t
  misc_feature (316)..(316): n is a, c, g, or t
  misc_feature (329)..(329): n is a, c, g, or t
  misc_feature (341)..(341): n is a, c, g, or t
  misc_feature (344)..(344): n is a, c, g, or t
  misc_feature (349)..(349): n is a, c, g, or t
  misc_feature (368)..(368): n is a, c, g, or t
  misc_feature (464)..(464): n is a, c, g, or t
  misc_feature (495)..(495): n is a, c, g, or t
  misc_feature (497)..(497): n is a, c, g, or t
  misc_feature (502)..(502): n is a, c, g, or t
  misc_feature (525)..(525): n is a, c, g, or t
  misc_feature (527)..(527): n is a, c, g, or t
  misc_feature (531)..(531): n is a, c, g, or t
  misc_feature (536)..(536): n is a, c, g, or t
  misc_feature (547)..(547): n is a, c, g, or t
  misc_feature (552)..(552): n is a, c, g, or t
  misc_feature (602)..(602): n is a, c, g, or t
  misc_feature (610)..(610): n is a, c, g, or t
  misc_feature (618)..(618): n is a, c, g, or t
  misc_feature (742)..(742): n is a, c, g, or t
  misc_feature (765)..(765): n is a, c, g, or t
  misc_feature (832)..(832): n is a, c, g, or t
  misc_feature (995)..(995): n is a, c, g, or t
  misc_feature (1029)..(1029): n is a, c, g, or t
ttagtgtttgaacagccactggctcccgttttttgtgccccacaaggggnttactacgcgtgccnnctatgagaacaaagtttgctccctcggcgcccgctgcagcaagatgctnaacannggtggagtgacataccgtgatcagccntggcatcgagaatntctgtctntaccgnatgccagacgccctggcagggcagcanttcaccncccgggatgaagatccctactgtgngnctgttttggagaatctttgcacctaagtgcagcagtgcaagcgccccatcgtaggactcggtggaggcaagttgtgtcntttgaagaccganactggcaccacnacngcttntcctgcgcccgctgctctncatccctggtgggccagggcttcgtaccggatggagaccaagtgctctgccagggtgtagccaggcagggccctaagccagggccacgggcccagnactgtggctccttttctaaaccacctctggnantcagntccccccgccaaaaaaaagggtntncttntgggntccagtttgtntcccnatccagcatccccaaactggtactccctgacccaggcccccaatcctggntctaacanagcctccntgagtcaagccccctccccacacctggactccagaattcaccctctcccctgcagtctgggttcccagattgagtcctctccccaaatcagggctctagacccgagccctccaaacctggactntgggacttaggcccccttaaatntagacttctctttataggtttcaggtctcctatgggtgcctgggaagtccttgaaagtggactgttntcaggcttgacctgccccaccccatccccgcggttgaggctgtgggggcagcagatcaggagcccactgataaggggccctagggtacagggtgctgcccagcaggtcgccaccgagtgtcttctcattttatttcagctccattttgcccataaatgggcanaggggtgagattggctcatcccccttccagattntgcaataaaacggtgtgagga

SEQ ID NO: 546939 - DNA, 134 bp, Homo sapiens
agaccatccacttgctccgctctgacatggctggagaaggttgaggtggggtgtgcagacttgggcgctggagctcgagtgcgcggaaatggataggcaaaggaggaagaaggcatggatgaaaacggtggatc

SEQ ID NO: 546940 - DNA, 424 bp, Homo sapiens
ggggccgtttttctttttttccccgggtggggtttggtggcccaattacaggtcattgcatcctcaatcaccccggccttagcaatccttccccctttttggtgggggtaccgctccccgcccccctgggttaaaatttttttttttttgggcgggttttttttttttccccgggttgtttccgggtcctggggtcaggttgtcccccttcctttggttcccaaggccccggcccagtttttgcttttttcctttccctctttccccacaagggggttttttccctttaatggattggccttcctaaaatgggttttttggtgggcaaatttttttagctgggaattttaaattccccctggaattttttttcctgccgtttcccttgacttattttcccattaagggttgttttgggtttcca

SEQ ID NO: 546941 - DNA, 700 bp, Homo sapiens
  misc_feature (602)..(602): n is a, c, g, or t
ggaaatctggccactgggccaaggaatgcccgcagcccaggattcctcctaagccgcgtcccatctgtgtgggaacccactgaaaatcggactgttcaactcacctggcagccactcccagaggccctggaactctggcccaaggctctctgactccttcccagatcttctcggcttagtggctgaagactgacactgcccgatcgcctcgtgagccccctagaccatcacggatgccgagcttcgggtaactctcacagtggaagacggcaggaatgtcaggcctctgagcccaagccaagccatcgcatcccctgtgacttgcacgtatatgcccagatggcctgaagtaactgaagaatcacaaaagaagtgaatatgctctgccccaccttaactgatgaccttccaccacaaaagaagtgtcaatggccggtccttgctttaagtgatgacattaccttgtgaaagtccttttcctggctcatcctggctcaaaaatcacccccactgagcaccttgcaaccccactcctgcctgccagagaacaaaccctctttgactgtaattttcctttacctacccaaatcctataaaacggncccacccttatctcccttcgctgactctcttttcggactcagcccgcctgcacccaggtgacataaacagccacgttgctcacaaaaaaaaccaaaag

SEQ ID NO: 546942 - DNA, 119 bp, Homo sapiens
catgctttatagacgcacagtacgaatcagcatatgatgattcataatttcagtttactagatctgaagttttgaagtaaacacttttcagtttccttctacttcaataaatagtatga

SEQ ID NO: 546943 - DNA, 169 bp, Homo sapiens
agagcagggctcccgagtacatgagctcccgggcctccgtgtgcttgctctgggacatgtacctgaagaacagggtccggtacatctggtgcgcctcgtagtagtcgcccttctcgactggcgcgcagcttgccctccacacgctggcacagcacgcggttgcggccgc

SEQ ID NO: 546944 - DNA, 2011 bp, Homo sapiens
  misc_feature (633)..(633): n is a, c, g, or t
  misc_feature (962)..(962): n is a, c, g, or t
cacgacagccaggttatgagcacggtccactgttagtggttcgtatatagttggagactctcgtgtggttcgtgcctccactgtcgtgggtgtctttctgttggtggtcactgcactcacgtctgtctttttggcctgttttttcaccacagatagtgtctctatagttgtggggcggcctcattatgtagtgagggcggtcgtggggggtactctactccatagcgcgtcttggtcgcttctgcgaaggagggcagtcgcgttgttggtagtaatcccaacgagagttgtggggaataacacactaagtctttgttcgctctcaccctcccggggcggatatttttgtggttacaaagttgcttctcttcgggaggaaattatttcttgcgcgatggattgatcgtcgctatcagatcttgttcggtgatgctgagtggtgaggctcctacgttgcttgttagtattggcgcctcggcttgtgccgtcccttttcgtagtgttcactgactttgttgcgtcctctgttgtggggggaagctacgaagtagccgatccccctttttcccgcgcgcttgttttaggtggtcgttccaacaatccttaggtgagaattacaattttctcgggatnggggggtgcctcctccaccaacacgtcgctctgttcgtctccacacagggcgaatggatgtctcctctgggggagagtgggttttatcaacaacggtgactccgcgagactcccacgacgttgtggtcctctaataagacggcgccttcttgctttacaccgagggtgtttctcctcgtaggggccacctcctttcgcgcgggggaccatgtagtatttaccacaggggtccccaccatagccagaacgccagggttgtctgactacgaggaattgactactcccttctcgcgaaatgttttgttagggccgcctctcccttctcaggngcgtcacacaatacccattggttgcttcttgcctcacataagctgtggcttgggcaaagaatgtggcctctttacccgccgccgtctctcaaaagaggggggtttctccctccgcctaagtaggggggcaacatctttctggagttatcccccccccgcagagcggcgcctcacaaactggcgacgccgcccgccccctccttctatgtgggcgatcagtgggtgagcaccccttctcgccgtgtgtcagagatgactcctcccttcgtcaagagggggcgatactctcagagtgttgtatcacgcggcgcgccccatcggggcgcacaccaacaaagtccggagatattctgggggacggcacatcttgcggcgtacccaccccgggaggtgcgacacaatccgcgctttacaccattatttctttctcacaccgcggttgtggcgaataaagctcccaaggcaaaagagggctatattacgacacctcatcttctcggctttacaaaggaatagttggggacggtattggagcccgctcgagaggttcaccacgcagggtagcacaggggtgaacaaagagcatagtgcacaaacaaccacaggggactattacttcctgcagacgcgttatatgcaacaaccacttctgggcggtttcattatctctggtatccatctgtggcgcgtgttctaacaccctctctaggcacacaccacacagaagatgttctcgagacatggcttgagagaacatgccacagtggcgacacaattatatatcgggcagaaagtgggagatgctctcgcctcataagcgaatagaccggctagagacagcgcgagagaagagagaagttgctacacaagaggagctctaggcgccattgtcatcgacgtgaacgcccgtggggtgtcatacgcgcggatctaaggctctcatagttttggcaatatccattaacaagaatttccggattttatccggctccaggctctttctgggttagaagggacgcctctattaaaacacatggattttgccacca

SEQ ID NO: 546945 - DNA, 847 bp, Homo sapiens
gatcatcgacggacctcgagcggctcagatcttcgcaaatactgtggacaatgcccgcatcgttcggcgagcattggacaatgcccgtcttgctgtcttggatgactttagagtctagtatgagacagagtctggccttgcgccagtctgtgtgagaatcgactatccatggtgctccgcaagggtcagttgatgatcagccgaatatcacatcgaactgtcaggctggatgatcagacgattctaggactctcaagggggagctgttctgcattgaatgaggtaacctagcgaagaggaagctaacacacgtgtcctacgggcccagattgccagctcgtggggttgaccgctgcgaggctagatgcccccaaatctcaggacctcgtcctaggattcatggcaaacatccgtggcccaaatatgacgcatggctgtgctcggatatgaaccgagaaggagctggacctagagctactggtctcatgcagagttgaggagacgcaccatcagctggtctgccaccacggtcctgctgagtgttgcgacgctgctgaagacgcattgcctctatccgagcttgagagcgttcagtccagctccttgcgggatcgatcctggactccgatgagaatgatcttgaaggccagccttgggccgacagtgctttgcggaccgtgggagtgcgcgttatcgcctatatgatgggtgcttggcaaccgggtcctgcggagcctgagtcaaaggtgggcagaccccgggaaggtgcaggcgggcccaggttaggccctcaggttgggccagggggggcccccccccccgggggggggggattgagggcggcgcc

SEQ ID NO: 546946 - DNA, 484 bp, Homo sapiens
  misc_feature (13)..(13): n is a, c, g, or t
  misc_feature (74)..(74): n is a, c, g, or t
  misc_feature (180)..(180): n is a, c, g, or t
  misc_feature (197)..(197): n is a, c, g, or t
cagtgattggtangatgtagcgatcctggttgttttcaatgccgtgcagggattccttgatgtccttgatgcantcggtgatcgtctcccgctcacggttgagttgggcgttaaagctggcgatctcgttgatggtgttcacgttcagcagtgctttgaagcgcgcttcgaatcggggcncgtcgtccttctgcaantcgttgagcatccgcgcatactctggcagcgccgccaggtctgcgtccatctccacggtctcagccttgaactgattcttgaagcggtgcatgggcgcctgtaatacggtcatttagttgtcttcaggtgagcgttctccgcatcgatacgtttttgtagccattggcgaacttgctgctcgtggttgtcgcaagattcgaccgatagcacgtgctcccccagcgcttgctggcgccagctagctaatagcgtgatctgcgcttggctcagcggcgcatcatcccaa

SEQ ID NO: 546947 - DNA, 332 bp, Homo sapiens
  misc_feature (210)..(210): n is a, c, g, or t
  misc_feature (230)..(230): n is a, c, g, or t
  misc_feature (254)..(254): n is a, c, g, or t
  misc_feature (258)..(258): n is a, c, g, or t
cggcccgaataaaaaaatgtatagaacaggaaactttccgaggtaactgaaatgttctgcttgattggagtggtgattacatggttacatttatcaaaattcattgaattgacatttaagatctgtgcatttcactgcatgtaaattttatcttaatttttaaagataaaatctgttcaactattttgattgctaaatattttggctaanagaaaacagaaatttgttgnagagtaggagatatgcctgttatnatgntttatctttgatagtgatctctgaatgactctgaactctacatttcagatctgctctgtgtgatggatatattg

SEQ ID NO: 546948 - DNA, 196 bp, Homo sapiens
cgccatcgagaaccatgggccaggggaggtactgcagtaagtcccggttggcctggagtcacgcgaattatcgaagctgggcctggcaagaggccgctggacaccacgctccagtcgtcagcccacttcctagctgaacagcgcgagggggaggcagagagccgtgtccccaccatggccgggaattatcccagta

SEQ ID NO: 546949 - DNA, 202 bp, Homo sapiens
aatgcgagcagtagtctgtttctgtgttgtgtagcagagctgagtggtagactttacctgtattcctatctggggtgatcctaaagatgaaagaaaacaaaaaaaaaaatggagtaaatgtggtacagagatgggactgaggtacagactgatgtatttaagggtcagactagtaatgagtagtaaataagccatggagatc

SEQ ID NO: 546950 - DNA, 109 bp, Homo sapiens
aacgactggtcctcacgctatcgagtggctgagagtatggagaatcacttgcaacctgccgaggtggatgttgcgtatgagcttgggattgtaccgagtatccgagtgc

SEQ ID NO: 546951 - DNA, 739 bp, Homo sapiens
acaggcatgtatccatgaactgcactattataaactattaaaatgatagatgtggagaaagtaattattccaacacccatctgccatgcgatgttaaaaaaaaaaaaaagggacagaaaaatagcacaggtactcctcacggcaaaaagatatccatgcgtaaaaatcaacaactccagtcaggggaccaggaggagctcggggacgcagacagattcctgggatgatgattttttttatgatcgtagtaaaggaataggtaaagtcttggatgtcagtgaagtggcaacatagccaaaaagtggggtacctttaaggaaatgatgtggtaagtctccttaatggtatcctgaggtaagtttacctacgggcagcagatttggtaagaattacttttaacgaatttcattctttaggtatggtcatggagcatccaaccatattataataggaaagtctttggtaaatcggtggtcgtttaaaggtacatatatctggtctataataactggatccaagaatgatgggacaggcaaacaaggttgacaaatcaattctgagactttaacacaagtggacacaggtgggacagattagaaaccagagggggactagctaaaaagcgagcatcactcaagtgaggaggggatccctatgccttaacgatccccgtaaacacatagccaacaagccttagcgaagcataaacacatacacaactggataataaagaacagac

SEQ ID NO: 546952 - DNA, 299 bp, Homo sapiens
  misc_feature (81)..(81): n is a, c, g, or t
  misc_feature (138)..(138): n is a, c, g, or t
ttttttttttttagaatcagccgggtggtttttaaaaatttcccgggaagggtttccattttaaaggcaaaaaccagtggnaaaatcaaaggggtcgagggggttaaaaatgttttggggattccctggttaaaagcnaaaaaacttttttcccattaaaatcccccgtgtcccgcaaaaaaaggttaagctgtattttattgcccgtttttctgaaaaaggttagtttttttcaggatcccccaaaaaattttgtttagcccagggataggaaaaataaaattaattgtataggttta

SEQ ID NO: 546953 - DNA, 325 bp, Homo sapiens
aattttaaaagggtttttttctatccctttaaattttggcccccccccccctaaaaagggtggggttttttcccgggaaaattttttccccaagggggttttttttttggggggggggggggcctttccccccctttttaagatgggggccaattttccccccaaaagggggggccccccgggggtttttttttccctttttttcccaaacccaaaaaaaagagggcccccccctgggggggttttaaccccccccgcttttggggcccggtttttttttttttttttaaacccaccccaaaaaaaaaaaaaagggggggcccga

SEQ ID NO: 546954 - DNA, 397 bp, Homo sapiens
  misc_feature (175)..(175): n is a, c, g, or t
  misc_feature (240)..(240): n is a, c, g, or t
  misc_feature (254)..(254): n is a, c, g, or t
agccccagggcagggggccctccctcctcagttttgtgtttggatacagggagcagccaggagactccctagggccccccccatggggggggtcactcacgcactccccatcccttagggcttcctggcctactgcatccttgtgggagtcagggaggagggcccgttgggtagntggggccaggtttttctcccccccccctgcagattttttgctgcttccactgacacccttttgantggaatgaactggntgggcttgtcagggggccccccaaaaagggggccctgccaggtagctgggggagtggcatggggcaggggcccagttttcagcagcagaccctctggacagttttttcaatccctgtttttgaataaatattttcagcgccca

SEQ ID NO: 546955 - DNA, 881 bp, Homo sapiens
ccgagtgtcagtgcccagccgcagcgcaggagcgagcgcctgggtctcgtaggagcgagacacgaagagaggggctgtctgcggggtgtggtggcgggttcgctatgtggatgacgattcgaggtccagcagcagctcctcctcatcttcgtcttccaaccaggaaaccgagaaagaaacaatacaccccctaagaagaaggtagagtacacgtcagcatgagcgaaaaactccaaagtcctctccatcagcgccaagagaattcagaaggagctggcggacgatcgactttagacccatccacgcgtaattgctagtgctggatcccgaaaggtcgataagcatccgtatgcaatggagatcaagccattctagggcctccaggatcctgtgtatgagggtggtgtatactttctcgatatcacttttacaccagaatatcccttcaagcctccaaaggttacatttcggacaaggaatctatcgattgtaatattgaacatggtcaaggtgttattttgcttggacatcttgagaagcactaattggagtccaacgactaaccatttctaaaggtcctccttatctatctgctcacttcgttacagactgtaagtcctgccagagcccttggctgggcacaggttattgccactcaggtatattgagcaacagaaggcagaacattgacagaatggcccagaccagtgggaccaaggagaatacggctacagtaaatttgggggtatcacaactttctttacaattaattttgtcttgtcacgagaaagagcagctgccttattgatttttgaaggggggtcagggacagggtgggggagatggtaagagaagaagggtaatttctattagcaagatat

SEQ ID NO: 546956 - DNA, 458 bp, Homo sapiens
  misc_feature (57)..(57): n is a, c, g, or t
  misc_feature (60)..(60): n is a, c, g, or t
  misc_feature (108)..(108): n is a, c, g, or t
  misc_feature (229)..(229): n is a, c, g, or t
tggcgctgttttcccatcagcaccatcacgccgggttacctggtcagcgtggaaaanacncactggcggaacagcgcctcgtattcggttttggtataaataaacagnatgcgtgctgtgccgctcataggcgaggtttatcaattcagtggctaatgtcagcgccagtccttcaccgcggacggattcactgatagcaacgcatttaataatatttccggcaattccnaccgcacgcgataagcttttcatcgcgggttacggtaataaatacttcgactgtggtgtcaacgctcaaatcattttcatgcaggaattggcgatttccgccatttttttattttctgaacgttttacgcgggtgaaaatatcattgccgaacataataaatagtatcctgaaggtgcatgttgttatcgatttgcaacgaatgttgttcaatgttgcaaactgataac

SEQ ID NO: 546957 - DNA, 424 bp, Homo sapiens
ttttttttttttgagatggagtctcgctctgtcacccaggctggagtgcagtggcgccatctcggctcactggcagctctgcttccaggttcaagcgattctcctgccttagcctcccgagtagctgggattacaggtgcatgccaccatgcccggttaatttttgtatttttagtagagacgaggtttcaccatgttggccaggctggtctcgaactcctgacctcaggtgatccgcctgcctcggactcccagagtgctgggattacaggcgcgacgaccgcgaccagccagcccttttcttctcaaagcagagtcggggaggggacctaagccaggccccgacccactccatgcttaattggcagctgaatggcacggcccagtgaaagccccccgcatctgccctgcgggagggagactt

SEQ ID NO: 546958 - DNA, 317 bp, Homo sapiens
  misc_feature (26)..(26): n is a, c, g, or t
  misc_feature (87)..(87): n is a, c, g, or t
  misc_feature (280)..(280): n is a, c, g, or t
ctgttgcccaggctagaatgcaatgncgtgatcttggctctcactgcaacctccacctcccaggttcaagtgattctcctgcctcantctccctagtagctgggattacaggtgttcaccaccacgccaggctaatttttgtatttttagtagagaaggggtttcaccatgttggccaacctcgaactcccaacctcaggtgatccacctgcctcagcctcccaaagtgctgggattacaggcatgagccactgtgcctgggccaataaactatattttntcaagccaaagtaggacaagcacagtttttaaaaggg

SEQ ID NO: 546959 - DNA, 903 bp, Homo sapiens
  misc_feature (514)..(514): n is a, c, g, or t
  misc_feature (811)..(811): n is a, c, g, or t
agcggtctttactaaaaatacaaaaattagctgggagtggtggcgtgcgcctgtagtcccaactacttgggaggctgaggcaggagaatcgcttgaacccaggaggcggaggttgcagtgaggcgagatcacgccactacactccagcctggcgacagagcaagactctctcaaaaaaaaaaaaaaaaaattttttttttaaattgggctgggcttgggggcttgtgcctgtagtctcagcaaacttggggaggcttaaagtacgtaggatccgcttgagcctggggaggttcgaggctgcagtgacgctgtgattggtcgccactggtgcttcagcttgagtgacagagtgagacccttccgtgacttcaaaacaaaaaacatgtggttctctccttcttctctccgtggtcttctttactctcttattcccatttgtgagtgttaggtgaacttttataaacgtgctttggataagtttaacttcttaacacacaaagaagacctttgtaanatgagggcacaaccaccttaaaggtggagcatgtgccccaatttaacaacccagtgctacctactagggactaacgaaaattctgacttttctcaacaaacagattactctacattaaaggaattcctttcattattaacacaaggttcttctcgtgtgtagctaccatcttcaaaggcttctaaacttcacctcagtgttttaacctgacaagttcccttgtgagcccccttttaagcgcagggcagcgcaatgtcgtggccatctacgctgtgtggcccagtaacgctgattctncacattgggaatccagttttcccagtccttttaaaataaattctgggccaatagcgaatacaccgatcacgagaacactcaatcgtcaccta

SEQ ID NO: 546960 - DNA, 189 bp, Homo sapiens
ctagaggtatccccaccgctcgaaaaggggccttgtatgcgcatcgcagctggctacctgtcagaccgggccatggcaaaggcggtactgtccatcttcgggaaccctcgccattgcctgttgttgttcatgatggctggcatgacagtggtccatgtaccgcttccgggtaacagtgaccagtgactc

SEQ ID NO: 546961 - DNA, 186 bp, Homo sapiens
cactcatcgagcaagagatggccatgcaaaatatcccgggctatgccatcgcggtcatccgggatggtcgtgtcgtctactcgcgcggctatggctacgccgatctcgccactcgccgacctgtcaatagccggacggtctttggcctcgcctctctcaccaagacatttacagccctcgtactgc

SEQ ID NO: 546962 - DNA, 509 bp, Homo sapiens
cctatatctctacaaaccacaaagacataaggaacactatacctataatatcggcgcatgagctggagtcctaggcacagttctaagcctcctatattcgagccgagctgggccagccaggcaatctatctaggtaacgaccacatactaacaacgtaatacgacacagcccatgcaatatagtaataatctatctatcataagtaatacccatacataatcggaggctataaggaaactagactaagtttccctaaataatacggagcccctcgatataggcgtattactcccgcataacacaacataaagctatctagactactaactctactcctctactacctaactacctagctacgcatactagcaatagtagaaggccggggcaggaacaggtagaacagtctaccctaccctaaagacagggaactaactcccaccctagaagcctccgtagacctaaccatactaataccttaacaactagcaggtagtctcctctatct

SEQ ID NO: 546963 - DNA, 111 bp, Homo sapiens
aaatccaaaccccatggggaaattttttttttggtatgggttttttttttttatgggccccccggggggggttcttgggaaaggcccctttttttttaaaattttttggga

SEQ ID NO: 546964 - DNA, 93 bp, Homo sapiens
ctcagtgactctggcttctatctctgtgcctggagtgtagaccgctataattcacccctccactttgggaatgagaccaggctcactgtgaca

SEQ ID NO: 546965 - DNA, 282 bp, Homo sapiens
tactaaattcgcgaccgcgtcgacctccagcccagaaagcacctgctgtttcaccttgcactgttatgttacagagacggcttctttccataaacctcatgaaccaacctcttctcacttccaacttttattgtgcagcttccttacctctcagctttcatagaatcgaagagagttagggcctggctctggattcaattttggccaaggcaatgttacagctgtttgatcttctatccagaccactaaaactttctccgtcgacgcggccgcgaatttagt

SEQ ID NO: 546966 - DNA, 322 bp, Homo sapiens
  misc_feature (2)..(2): n is a, c, g, or t
  misc_feature (71)..(71): n is a, c, g, or t
  misc_feature (74)..(74): n is a, c, g, or t
  misc_feature (120)..(120): n is a, c, g, or t
  misc_feature (191)..(191): n is a, c, g, or t
  misc_feature (257)..(257): n is a, c, g, or t
  misc_feature (301)..(301): n is a, c, g, or t
anttcggcacagagcgctgaccatgccattagctaaccgcacccggttcagctcgcctttcttggccagangcncggttggactcacgggcggggcatgatggtggtgggtacgggcacntcgctggcgctctcctccctcctgtccctgctgctctttgctgggatgcagatgtacagccgtcagctggncctccaccgagtggcttcaccatccagggcggcctgcttggttcgggtctcttcgtgttctcgctnactgcctttcaataatctggagaatctttgtctttgggcaaagngatttccaagcaaagatcttc

SEQ ID NO: 546967 - DNA, 807 bp, Homo sapiens
  misc_feature (36)..(36): n is a, c, g, or t
  misc_feature (192)..(192): n is a, c, g, or t
  misc_feature (195)..(195): n is a, c, g, or t
  misc_feature (216)..(216): n is a, c, g, or t
  misc_feature (249)..(249): n is a, c, g, or t
  misc_feature (264)..(264): n is a, c, g, or t
  misc_feature (334)..(334): n is a, c, g, or t
  misc_feature (353)..(353): n is a, c, g, or t
  misc_feature (744)..(744): n is a, c, g, or t
  misc_feature (768)..(768): n is a, c, g, or t
  misc_feature (780)..(780): n is a, c, g, or t
  misc_feature (790)..(790): n is a, c, g, or t
acaagtacatgactatttcaggatttcaaattgagnaaaccattgaccgcgagacttctggcaatttagagcaactactccttgctgttgtgaaatctattcgaagtatacctgcctaccttgcagagaccctctattatgctatgaagggggctggaacagatgatcataccctcatcagagtcatggttnccnggagtgagattgatctgtttnacatcaggaaggagtttaggaagaattttgccncctctctttattccntgattaagggagatacatctggggactataagaaagctcttctgctgctctgtggagaagatgactaacngtgtcaccggggaagagcnccctgctgtgtgcctgcaccaccccactgccttccttcagcacctttagctgccatttgtatgccagtgcttaacacattgccttattcatactagcatgctcatgacccacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaaccngtaaaattatgatgattgtattcnaaagattaatgnaaaataaacntttctgtccccctgaaa

SEQ ID NO: 546968 - DNA, 682 bp, Homo sapiens
ctggaccgcgggccccggcctgggggcactgctgcaccgcgcgcacctcgtctcctccccgtccatgccagcggaggttccccggttctcgggccgtgtcgcacaaacaccacgcagtacactcagacgcgacaagatactacagtagacagacagatgacacatgaatcacagcatcactagaacaaaacacactaaacttcgaccataggcatatatgccatcaacatcaatcagagactaaagactatcacccatcatgaaaagtagagacaataaacgcgacacgaacacactccgtgtcccacaacccgcacgactgcccagctgcatactctaaacgaccacacaatgtaacgatcaggacacagggtagcacgcacggacaagagaccacaagttctaggcaagtacgatgacattacaaccaaacccatgacgtgcaccagcacactagtcaaccaggaaccacgacaaataccaatataggaaccacaaactacaaaaaacaacgcaagaagtatgaaccacacgtaccatctccaccacaattagcactaataaaagataaacatgaaccaactagagcagagagaaaacacaagaagaacacaacacacatacacaatacaaataagcaagaaccgcaggaacgcagaacagaaaaaaagaaacaacagac

SEQ ID NO: 546969 - DNA, 808 bp, Homo sapiens
  misc_feature (35)..(35): n is a, c, g, or t
  misc_feature (51)..(52): n is a, c, g, or t
  misc_feature (59)..(59): n is a, c, g, or t
  misc_feature (71)..(71): n is a, c, g, or t
  misc_feature (83)..(84): n is a, c, g, or t
  misc_feature (91)..(91): n is a, c, g, or t
  misc_feature (137)..(137): n is a, c, g, or t
  misc_feature (145)..(145): n is a, c, g, or t
  misc_feature (157)..(157): n is a, c, g, or t
  misc_feature (159)..(161): n is a, c, g, or t
  misc_feature (436)..(437): n is a, c, g, or t
  misc_feature (492)..(492): n is a, c, g, or t
  misc_feature (579)..(579): n is a, c, g, or t
  misc_feature (581)..(581): n is a, c, g, or t
  misc_feature (583)..(583): n is a, c, g, or t
  misc_feature (592)..(592): n is a, c, g, or t
  misc_feature (595)..(595): n is a, c, g, or t
  misc_feature (609)..(609): n is a, c, g, or t
  misc_feature (611)..(611): n is a, c, g, or t
  misc_feature (613)..(613): n is a, c, g, or t
  misc_feature (616)..(616): n is a, c, g, or t
  misc_feature (628)..(628): n is a, c, g, or t
  misc_feature (631)..(631): n is a, c, g, or t
  misc_feature (664)..(664): n is a, c, g, or t
  misc_feature (668)..(668): n is a, c, g, or t
  misc_feature (672)..(672): n is a, c, g, or t
  misc_feature (684)..(684): n is a, c, g, or t
  misc_feature (686)..(686): n is a, c, g, or t
  misc_feature (694)..(694): n is a, c, g, or t
  misc_feature (697)..(697): n is a, c, g, or t
  misc_feature (701)..(701): n is a, c, g, or t
  misc_feature (725)..(726): n is a, c, g, or t
  misc_feature (763)..(763): n is a, c, g, or t
gcgatggctgctgtggccgtggctgttcgcgaggnctcgggatccgggatnnaggcggncttccccctggncctggggtattnnggttggnaatgaccaaataagaaaatctgcagcttcggaaggaaaagaaacanctagtaanaagaaacggaangnnnaaaagggggcagataccatgatgactggtctctgctgttatctgcagcccaatgtcaaggcccaaccagagaactgccagaatcgggcattcagttgggcactcctcgggagaaagttccagctggtcggagtaaggccgaacttcgggctgagcgtcgagccaagcagagaggccagagcgggccctgaaacaggcaagaaaaggggaacaaggaggaccacctcctaaggccagccccagcacagctggagaaaccccctcaggagtgaagcnnctccctgagtaccctcaggttgatgacctacttctgagaaggcttgttaaaaaancagagcgtcaacaggttcctacacgaaaggattatggatccaaagtcagtctcttctctcacctaccccagtacagcagacaaaacncncngacccagtntangagcatcccatccncngnganccacccagccanggngcgactcggcctgcagtactcccagggcctggncagnggcnccaatgcccggngnattgcccngcntcgngccttgcagcaggtgattcaggannacacaacaccgcctaatgaagaactctccagggatcnagtgaataaactaaaaccctacatgagcttcctgactcagtgccg

SEQ ID NO: 546970 - DNA, 858 bp, Homo sapiens
  misc_feature (36)..(36): n is a, c, g, or t
  misc_feature (192)..(192): n is a, c, g, or t
  misc_feature (195)..(195): n is a, c, g, or t
  misc_feature (216)..(216): n is a, c, g, or t
  misc_feature (249)..(249): n is a, c, g, or t
  misc_feature (264)..(264): n is a, c, g, or t
  misc_feature (334)..(334): n is a, c, g, or t
  misc_feature (353)..(353): n is a, c, g, or t
  misc_feature (795)..(795): n is a, c, g, or t
  misc_feature (819)..(819): n is a, c, g, or t
  misc_feature (831)..(831): n is a, c, g, or t
  misc_feature (841)..(841): n is a, c, g, or t
acaagtacatgactatttcaggatttcaaattgagnaaaccattgaccgcgagacttctggcaatttagagcaactactccttgctgttgtgaaatctattcgaagtatacctgcctaccttgcagagaccctctattatgctatgaagggggctggaacagatgatcataccctcatcagagtcatggttnccnggagtgagattgatctgtttnacatcaggaaggagtttaggaagaattttgccncctctctttattccntgattaagggagatacatctggggactataagaaagctcttctgctgctctgtggagaagatgactaacngtgtcaccggggaagagcnccctgctgtgtgcctgcaccaccccactgccttccttcagcacctttagctgccatttgtatgccagtgcttaacacattgccttattcatactagcatgctcatgacccacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatttcaaggctaagcttctgattaaagtatcatggttacaaatgtaatataatcagaagcttagccttgaaattgtgaactcttggaaatgttattagtgaagttcgcaactaaactaaaccngtaaaattatgatgattgtattcnaaagattaatgnaaaataaacntttctgtccccctgaaa

SEQ ID NO: 546971 - DNA, 161 bp, Homo sapiens
gtatgatacacacagtagcttagaatagatgcggtcatattcttcttggcttcggttcttcagccctcatggctggcatcacatatgcctgcatgcattaacaccagctggcctacccctataatgatcctgtgtcctaaattaatatacaccggtggtat

SEQ ID NO: 546972 - DNA, 125 bp, Homo sapiens
ggttagcatcaccactaataagacatactgataccatgttaccttccaattatgatgcacatgagaaggggcacaaattgtcacattcgtgtgagatgttgtctagaaactgtgcaaatctcagt

SEQ ID NO: 546973 - DNA, 351 bp, Homo sapiens
tgatgctgtacgagagatcctgaaatacgatgatgtgacagaaaaggtgaacctccagaacaatccaggtgccatggagcacttccacatgaagcttttccgtgctcagaggaatctctatattgctggcttttccttgctgctgtccttcctgcttagacgcctggtgactctcatctcccagcaggccacactgctggcctccaatgaagcctttaaaaagcaggcagaaagtgccagtgaggcggccaagaaatacatgggaggagaatgatcagctaaagaagggagctgccgaggatggagacaagttggatattgggaatactgaaatgaagtttagaggagaac

SEQ ID NO: 546974 - DNA, 266 bp, Homo sapiens
aattccacaagtggaaacctaaaaaaaacaacggcgtctctactgcagactaataacaataaaggagatgacatcaacacagatcttgctgctaaacggcgccaaagccctacatggtgggggggccgattgccggaaaactgaaaaacttaaaccccatgaggttctgtccaagaggggctacgaaccaccacgagccacctttcaggcctatcaaaccacccaagacccaaacaacaaagcggccaatgaagggaggactatac

SEQ ID NO: 546975 - DNA, 130 bp, Homo sapiens
tggtcgttctagaggatcccaacgtcgggccatcctggacaacagcacttgctgagtgaagtcaagcccatcctagagaagctgacccaggagcaggatgtggacgtcaaatacttaccgcaggaggctc

SEQ ID NO: 546976 - DNA, 416 bp, Homo sapiens
tagaccttaatcaaagcatatacccaggatgaagttaggcgatagaaattgaaatctggcgcaagtatgatatagtaccgcaagggaaagatgaaaaattataaccatagcataatatatgcaatggactaacccctataccttctgcataatgaattaattataaataactttgcaaggagagccaaagctaagacccccgatatccagacgagctaccttagaacagctataagagcacacccgatctatgttgcataatagtgggaagatttataggtagaggcgacgaacctaccgagccttggttcatagctggttcgtctctcgatagattcttagttcaactttaaatttgcccacagaaccctctaaatccccttgtaaatttaactgttagtccaaagaggaacagc

SEQ ID NO: 546977 - DNA, 228 bp, Homo sapiens
gctgactctagatgatcccaagcgttagcgaggcataatgggtgcttctaaagggcttgaaaatcacgaagtacttgggtatttaaacaccccctcctttgtttacactttaatttgtctttgtgtggatgcctttcatcatagatagtacaaaggcagactgagacgcagactgtccgcacacagtcgcacaacctctaaattagtgagcttgggagttccctcgtt

SEQ ID NO: 546978 - DNA, 105 bp, Homo sapiens
ccccgccctgccccgtcccttcggcccccccctaatttatttccgtgggtcctgctgctgtgactgcttttgtacctttacaataaaaaattttttggtttcaga

SEQ ID NO: 546979 - DNA, 154 bp, Homo sapiens
atggaacgcctcttcgaagtccgctcccataccaaccccgccaagaggctcgataagctcttctccgacctctgcaagctaggtctgaggcactgggatcccctcctcagaaaaacaaaaaacccgaaggctcgcgcctccgggtctttcttga

SEQ ID NO: 546980 - DNA, 105 bp, Homo sapiens
ggcagagaggagatacaagaaaccagcatcgaggtccagtttggaattgtaatgattttggtgttgtatcatttgtcctctcattgggtctgtctgtatctctct

SEQ ID NO: 546981 - DNA, 325 bp, Homo sapiens
  misc_feature (2)..(2): n is a, c, g, or t
  misc_feature (32)..(32): n is a, c, g, or t
  misc_feature (46)..(46): n is a, c, g, or t
  misc_feature (67)..(67): n is a, c, g, or t
  misc_feature (159)..(159): n is a, c, g, or t
  misc_feature (224)..(224): n is a, c, g, or t
  misc_feature (230)..(230): n is a, c, g, or t
angaacttgggaaacacttcctacaggaaggnaacaccaaagctgncattttattatttttagggtnttgctttgttgcccagggctgggaatgcagtgggcacaattcaaggttcactgcaggactgggtgcagtgggctcacacctgtaatcccagnctcacgcctgtaaactttgggagggctgaggtgggcaaatcacacctgaggtcagcagtttgagnaccagncctgggccaacatggtgaaatcctgtctctaataaaagtacaaaaattggccaaagtgctgggaatacaggtgtgagccactgtgcccacccata

SEQ ID NO: 546982 - DNA, 133 bp, Homo sapiens
gatggatgtctgtagagtgttctgctatttctttacccctattccatcatttttttctaaagagaagcaatgtctatagataccccacatctctaagtctctcgtcttctggtcctacctttcccaaaataat

SEQ ID NO: 546983 - DNA, 133 bp, Homo sapiens
ggtggtcatcagagacacagattccttgttataaccaacgtgtcctcagcttgtacctgaagttatatcattttttattctaaactgctctgcagcttctattctgaacactattaaaacatataccactgtt

SEQ ID NO: 546984 - DNA, 247 bp, Homo sapiens
tccccttcaaatgggcacagaatattgcagaataggaaattgaggcccagaagttatagtactggctgaaggacagcctcctagaatgtgggagaacagagactccaccctggcacctaggctccagagttctaaagaaattttcaaagagattcaacaccattaaaagcactcctatgatccctcagctcagccaaaccgatgctgtctaagcgcgtcctgtatttctgtgcccatttcaaggtgt

SEQ ID NO: 546985 - DNA, 293 bp, Homo sapiens
tagtgcggctatgtattagcacaggtctgagagaatatactttatatgtacttgttgctgtttattcatttgtacacaggaagtgtatgttaaatttagtttgtataaaattgctttggactgcagatttcctccatcaagatgatcaaacaatgtctaagaaactatgtgatatggtttggctgtgtccctacccaaatctcatcttgaattgtggctcccataattcccgtatgttgtgggagggagccagtgggagataactgaatcatggggatggttccaccctgccg

SEQ ID NO: 546986 - DNA, 927 bp, Homo sapiens
gccaagctccaggagcttccgaagaaacaggaccagagagggaaggtgacctgaaagtcacagacataattcttgtagagctgaacaagaatccaagcctgcaatctgcaggagacgagagatctttctgctgtctatatctcttggaaaggcacatcctaagatctttgtcagattatcctgtggaatggaaaatgcctaaagtcaataagaagtccggaatagctacaccccagagtggctgggacgttgattgagccaacatactggatgaattagactcaaaagatgagagaagctgaatacagaaccgcatgagggaaacgaggaacacgtggaactctctgttggtaccagtctctcaggatgccaaccagccaggaaaacgcggctacagtcttcgacctcttgtacaagcggaaagcacgactcaggcaagatgaactctatgatagtattcgtactctaaaggaacggctactgcatgactaaataaacctgcattagcaggagtgcgtcactacgcaaggatatggagaacttgtgctgcctgcggtgcattcaagactacgggacacctaacttcagaggacagaacctgcaatcgtgcccgtcgttgcccatagaaatgcagagcctgagaagcgtggggccgtaatcactcgagttgcacaactacttgtggctcgtcagtggctgcgttctggctgaaggctcatgggaaggcgacaacccagccacgtgcggaacatccttgggaacatttcgataagggtattccactgcccgtgttcagcagggcaagaaccccattcgctgggagaaaccaaggaaggatgaaagtgtggcaccaaggccccggacagtcgggtaggccacgggaactcctttatggggtgaaataggcttgcggcttgccgtaatcag

SEQ ID NO: 546987 - DNA, 1484 bp, Homo sapiens
  misc_feature (857)..(857): n is a, c, g, or t
ccgtgttggttgtcagacacaccactacttgtgtttcaccctcccgcccgcaccaagcaagtttttgtgttgtttgcgggtgctgttctaatcccccaccaccgtcccctcttccattgcgctggggtgtttttttgttttgtccgccgccgtagttgttttcttcttccggtgcgccgctccctctcttcctgtccttcttttttttgtggtgcggtcttctcactccgccgcccctccgcatacgagttggcgtctgtcttttttttaattatggctgccgccggcggcgactttatttttgtgttatgacgttcattctataatatttttgcgtctctcccggtattaaaaacaaaccaccccccccccccttttttttttttttgtggtacgtacccacaacaataacaacccccgctactaacacaacttttttctgctgcaccaccacgcgaagtgaaccatccaccactacagcagtgatgtatgtaagatgaatttttttcgcccaacaacacgggccgctgttattaataaatagtcttcgtgtgttcatgttcttctattttctgctctcttgtgtgtttttctctttgcgcctttgttcttgtgtgttgtcttctcgtgcttctgcttctcttgtggggggcggcgtctagtgagagcttcctcctcgcaggagcattttttattatacaacaacacctctgcggagcacccccgcggtgcggaagagaagtggtgtgtacaccaccacgcaacagctgtgctggctgtgtgaggagagactgagacgactacttctcctctcccccacacagtggtgttgtcaccacacacacagtggtggggcncgcagagagagactctttgtgatgtgtgcgacacaccactactgtgtgtgtgtgttgtttttattatatagagtgtcactctctcccccacataagtgatgagagagacactcactcctcgtgtatcacacacgagagagatcctctctctcttgccatctctctctcatatataacctcaccccgcgacactttgctctctctctacagagagagagagataggggcgcctacactgtctctcctcttctccaccacacagtggcgacacacacacacgcgcgagagaggttgtgagtataagacaactctgtgtgtgtttcgtgtgtgtgagagatatatatatgtgtaatgaggcacacacatatatttgttatatatatattgtctccctcttgaatagaactctttttattttttggtgttttttttgacgaagagtgagcgcctcttgtggccccccctcttccccctctttttgtgccccccacactctgagagagaggtgattgagaaggctcttttgtgttctccccgggagtgtggggtgggagggccccccggggttatccctgtatcactgtaatttgggcccccgtgtgtaaatataaagggcccccccttata

SEQ ID NO: 546988 - DNA, 108 bp, Homo sapiens
gtcagtctacaggcccatctccccctcatccgctcttcctcctgccagctggggctcctcaactgcccgggtgtggggcaggctcccagttccttctctcgtctcagg

SEQ ID NO: 546989 - DNA, 433 bp, Homo sapiens
  misc_feature (41)..(41): n is a, c, g, or t
  misc_feature (73)..(73): n is a, c, g, or t
  misc_feature (88)..(88): n is a, c, g, or t
  misc_feature (111)..(111): n is a, c, g, or t
  misc_feature (132)..(132): n is a, c, g, or t
  misc_feature (135)..(135): n is a, c, g, or t
  misc_feature (149)..(149): n is a, c, g, or t
  misc_feature (161)..(161): n is a, c, g, or t
  misc_feature (173)..(173): n is a, c, g, or t
  misc_feature (215)..(215): n is a, c, g, or t
  misc_feature (262)..(262): n is a, c, g, or t
  misc_feature (283)..(283): n is a, c, g, or t
cagttgttccctaaatgccttagagcctgctaaaaccacanttctttatgtgtatttgtgaatgttggcttgntgtgggcacacattnggttgaatgcatccttgaagttntgaggcacctaccacatttgntgntgcatattcatggntgcttttagaantcagaggagaantagattttaggggaggggttccccttcctcaggcactgtcgngggggtgtagaaaggaataatgtgtcctttacactgtcagtttcctntgagtgaatgtagtagacctnttagtcatcatttacttcattattaccagttatgcactaataattagtggtctgctaatatctcgtctaccaatcatcttcagcaataaacatgctttaattatcagctgataattaatgtagccataacaaataaacccccaaatgtca

SEQ ID NO: 546990 - DNA, 470 bp, Homo sapiens
tgaatcctattgaggtactaaagtgtactagacgttgtttgtggtgatggtcgcacaactcatgaatcagtcgggtgccagtcaaggtatgtgaacttattagataggtacaaaagtactagtggtttacaagtggcaaaaccccaattatttacgcaccaacccaatagttcactatagctgtaaaaaaaataataaagtatgggaggctgaggtagggagatcacttgagggcaggagtatgagaccagcacggccaaaatggtgaaatcccatctctactaaaaaatgtaaaacacataggctggtgcactggtggtaggcgccatatcattcacagctactcgggacgctgagacaggagaatcactagaactagggaggcggaggttgaagtgagtaagaggtagtgtcaacttaactgtagtctgggcgacagagggagactccctctcaaaacccgaacacta

SEQ ID NO: 546991 - DNA, 551 bp, Homo sapiens
tgctttgctgaataccgatctggccctggtgtgaggatctgggtctgtcaatatctgaagaggtaggaatccggtacaggtatgggatctgcatctgtcaatgtctgaggaggtaggacctggccctggtatgaggatctgggtctgtcaatgtctgaggagttaggaatcgtacaagtatgaggatctgggtctttccatatctgaggaggtaggatctgggtctgtccatgtctgaggaggtaggatctggcatgaatatgacgatctgggtctgtcaatatctgaagaggtaggaatctggtacaggtatgaagatctgcatctgtcaatgtctgaggaggtaggacctggccctggtatgaggatctgggtctgtcaatgtctgaggaggttggaattgtacaagtatgaggatctgggtctctccatgcctgaggaggtaaggtctgggtctgtccatgtctgaggaggtaggatcgagtctccccatgtctgagagtagatctgggtctgtcctgtttgtggagtagcactggtaccgagctcga

SEQ ID NO: 546992 - DNA, 144 bp, Homo sapiens
aagaatattcgaatccaataaatacccccctgttctcacccaaatgctgtttcttagctaacttgctctgacaacctactgatgtaacttctttattaatgtgaaatatttatcttttgaaataaaattcctcgtgctgaatga

SEQ ID NO: 546993 - DNA, 127 bp, Homo sapiens
ctggagcagttcatgagtccaggccatgcgctccttctgtcttgtagctctgagccccagctctaccgggtcttggccgctctgtgctgtatcctttgtcatcttgccagcaatcaggcaaagcagt

SEQ ID NO: 546994 - DNA, 141 bp, Homo sapiens
cataccaaggtaacctaggtagagagagcccctgtacacaggagtacccttctagcgtagtcacacgtaaaccccgcgggacagcagtgtatgtaggtcctcacagacacacagcctgagtaaaaagggcagtagccccag

SEQ ID NO: 546995 - DNA, 247 bp, Homo sapiens
gattgctactccatgtgatgtggctggacgcacaggccggggtttcgagcactgagtgctacttgctatagcctgctccccatcagggccctaacttctccctggccggtaccaagtatgggtcaggatagactgaggcctcttgatgtttgtgcaggcagagcgcgatcgcatcatctcttcccaaccttcagccatcttcgtgccagcctgctgcacatatgagttcgggtatccgagctcgata

SEQ ID NO: 546996 - DNA, 111 bp, Homo sapiens
agccaaagtggttaaataggattaaatctgcctgcagggagacgtaaagctgccaacgttaccctgctcacatcactagtagagggagaagctgtcctcactacatgccat

SEQ ID NO: 546997 - DNA, 1461 bp, Homo sapiens
ctccggcgtggtgtttgttgtactcaatggtggtccacccgttgtttcacatacggtggtggctctggtggtgcgcgtgggggtacccgtggtgtgacccgctttccccggggggtgtaagtgtattgttgccgccgtacagggagatgttttgggtggggttcaccgagcggcggcctcgcaggggttttttttttgcctagtagaaggtggggacggtagttatttggtgtgtcaccctagttgtgtggctgggtacttccctcgcgaggtgtggggcggcactacccccgggggttggttccccggtgtgttgttcgtcaaccaacaacgatacccagcagatgggggggtgtggtgggtggtccccgtgtggccgcctctgtggttggggggccgcccccctcttgggggtgcccctttctggtgtcgccagcagacgctcctcgtcgtgtgatgcactctgcccccccgtgtggggcgcccccacggacgcgcacgcgtctctctgctggttgtgtgcgccccacgccgcacgcgcctctgtgtgtgggagaactctccccctctctgtggcgtgtctgttgtaacactggtgcgccacactctgtgtgtgagagttgtgtgggacgacacacagaccgcagagcgagagaagagagtgtctctaccgcgctctctctctctcttgatgaacacactactgggcgtgtgtgtgtgtgtgtgcacaccgctctcgtgtgtctgtgtgtgtgtgggcggcacaccgcccacgacgactcctctgtgcgtgtcgccgcacactctcactgtgtgcgcgcccacccaccacactctcacacagagagagagagaagagagagagagagagagagtgtgtggggactgctggagaggcgcccccctctgcgagacgccacacacgtgtgtgcgcacacagagagaggtgtgacacacactctcgtgtctctctctgtctctctctgctgtgtggtgagtctctctctgtgtcccactcgtgtctctcttgtgtgatgagaacataaatgagagagagagtcctccacacagagagagactctctctacacacaccctctggcgtgtgtgtgggtcgtcacacacaaacacacacccacccacacagagagttagtagagaggcgcctctcatgagagcgcgcactctggggtcgtgtgtgttgtgtgccctctcgagaacacccacactgttgggcacgtgcgcccctatattgggtgtgtgttgtagagagtgtgttgtgtgagcccctctccccaggtgtgccacccggtctccccccaccccccctcccacgggtgtcggccacccccaccgcaccccccccccccccgtccccagttttccccccctttctccccccccccccccccttttttataaacaccccccccttaatctcccatttcaaccccccccttta

SEQ ID NO: 546998 - DNA, 1153 bp, Homo sapiens
gctcacgcacgcacacacgcgcacactcacacggtgcgcgcgcagcccctccgtgcctgcgggcgcagcggtgggctgctgtgtggagctgctgaagtggccatgtgtcctggcgtggctggggcggctgtgctgtgcactgtgctccgtgactctgcccgtgccagggctggctgtgctccagccgtggatgggcgacgtggatgctggccacgtgtgagccgtgcccgtgggtcgaggctgtgctgtgcggtgacggctgaaggctgctgtggctgtgtctgcatgcagtccatgcgatgctgcccacgggaagcttggaacccccatggcgtcctgccgctgtgcgccctggcatgcatggccttttaagcttcctttgacagcccaagcgcgaggattcaccggaagctccacgttgtgggaggcaaacctgaagcaaaacttcgcatggatctggcagcttagcccttttaacacgaatgctttgttaaaccagcttctaactttagcgggaaacggggttccccggcaacgactttgctatttcccctttagaatgtgccaatggctggatggagccgagcgagaaaagccccgctaccgagggaacagtgggcacaataggacaaaccttttctggagaagctggcctatttccctggagaacgagtgtcaagcgaaaaggagcagaagcagaaagaacctttcctcaagggaagcaacctggccctggccccgttttttacggtggagaacccgtgtgttaaaatcccaaacatttccaaagcccctggcgcggaagggggggttcccctggctagatgcgctttttccaacatttcctttttgcaagacggctccaaacgtttctgaacagaagaccccctagagaagggaagaaagccgcgcaagccgccgaaaagtttttcccccggtaggaacacaagccaaaccgttaggggcggcactatttaaacccgacgggatattccccccacggctcggcacacacggcgggaaggttggtttatacaccccccctatttttggcaaacccggaacactgggaacccgaacgtcgtggtttttaaaaactttccggcccttggccctttggcccttgtagtgccttttaccccccccgaaaagg

SEQ ID NO: 546999 - DNA, 518 bp, Homo sapiens
  misc_feature (74)..(75): n is a, c, g, or t
aggatcgctgggtcagtgatcctcatacatttcagaagatgacagatagttatgttctctgaacacagtggatnnagttaaaaatcaatgacaaaaacaaaatatctcaaatgttggaaaattaagcaaacacttctgaaataacttggaccaaaaaacagaacacaatgaaatggagaaaatattttgaactgaatgaatacaaacatatgcgaacttgttaaataagcctaactccaggcacaaaggaaaatttatagctttaaaacatatattagaggccgggcacagtggctcatatctgtaatcccagcactttgggaggccaaggcgggcggatcacctgaggtcaggagtttgagaccagcctgaccaacatcaagaaacgtctctactaaaaatacaaaattggcaggtgtggtggtgcatgcctgtaatcccagctactggggaggctgaggcaggaggatcacttgagcccagaggatcacttgagcccagaggatcacttgagccca

SEQ ID NO: 547000 - DNA, 1765 bp, Homo sapiens
  misc_feature (1235)..(1235): n is a, c, g, or t
  misc_feature (1584)..(1584): n is a, c, g, or t
tgggaacgatatgtatcctgagtaagatatcttacgagattagtcattgatgtccgcgttaggaatcggccaatgtaactgactgccatatcgagatatgtcttacgtatgcatataccgaactagttcgacattggacctagaaatcagacgtggttggacagctatcgctattgaaggttgtgcttgcatgcttagacttcatttatctcccacgtgatacttggaagcaatctagtaccccgacccaccatcccacgcgtacctgtgccttcgactagacgcgaagaatcacatcggtgattatgtcgcactcgtgtctcattcggtacacacgtaaggaaacacagtaactgctctgttgtgtcatgactttgtgtcctacacagtcactcattagctgggcgagggacttgcgccattggaaactccatggaaatgggctatctttaggagttccttcttgtctagggactgcagtcgtgaataatagcgctacaaaaaggcaattgtggatcgaacgagaaggaacacgaatgaggtacacgacgggacactggggtggcacccattgacgcgctggggaaatcagtacccacacgcatttggcgcctctatacgacgtatgcgacccttccgatagactcgaaaaggcgatcgatagctccaccggcagagaggcatgcgtacaacggcccaagtagtcacccatagactgaaaagacgcgcatctgatgagcaaattcgaaacctcgagtggtactcgcgcacaagaatacgcttttgattacatcgacgttgtgtgaccccattcgaattggaccactacgaagttagcataaccgaccatttttttgagtaggcaaatctgtctcttgtccgccgaataggcaacagccctagcaacggacacttcccggtcagtgcgataccacgaaaatctaagaagcggaaaggcacacttgactatcctccatgaaactttagcacgtggaaagcctgcccctccgtctgtcaacatgcgtagacgacacttttttcgatcgagcgctaaatttcgcctcaccgctctcacgtgtgaccagagcgttactttagaggatcacattggcgagaaggtaggagcccagttagtgggtcccagagaaatgtcgtgcaacagaagttttgccaccacaaaatttgagtcccctcttaatggcttcgtatcgtgaatgtacatgttggcttaccgnaccaagggccgccatgtttcgcatttggagaccccttcggtcgaatgtgggctgccaattgacataacgctagtgcgagctcccgaaaagaacttgggttaggaagacttacgcaacccaacacactaaggaacgctggaccctgcgcaccatcgcgggcagttccagacaaccacatcgggaaatctcaccgtctcgcctcgtatcagactatcgggcgcaaacacacaactattccaaaccagagtgcgggctgtcagagcgcatccccacaatcgctctaccatcgtgctgggcacgaccaacgaagtgttgcttacacccgcatatatagcgcgtaccagcgcanctctctgaaccttcatacaaccgcaacaacgtgaacgtcacgggaacttgcgcgtgcttgattagcagcgtacacgacaagctctagtctataccacaaactaagctggtgcgacaacagtgagcatgtatcgttgtgaagcagcgcaggaaccagcaccacatctcttggttatatgaca

SEQ ID NO: 547001 - DNA, 253 bp, Homo sapiens
tactgtggtgttccgtggttctagaactggtcatgaacagaactggtagtggttcaaagagtttagagagacgatggattgattaaatgcatggggctttgttgtggctgttggaagaaccgttacagctgttagtgaaagctgatgaggtgagatataggccaagtcagaattcacttcactgtgagtacaattgaaggaaaagatgagtttgactgttgttggggtaatgagaggaggttgcatccattgt

SEQ ID NO: 547002 - DNA, 1236 bp, Homo sapiens
  misc_feature (83)..(83): n is a, c, g, or t
  misc_feature (87)..(87): n is a, c, g, or t
  misc_feature (92)..(92): n is a, c, g, or t
  misc_feature (97)..(97): n is a, c, g, or t
  misc_feature (118)..(118): n is a, c, g, or t
  misc_feature (120)..(121): n is a, c, g, or t
  misc_feature (126)..(126): n is a, c, g, or t
gtaagcaggccgtttcagcatcaggcaagtggctggatggtattcgaaaatggtattacaatgctgcaggattcaataaactngggnttaantgcgngatgatacaatatacgaggantnnagtgntaaaagagccataacgaagacttcctgagcaacctttactaatgacaggatgttctcgcattaagcagggcactggcacctgcaacttgcaagcactcagactcttgccctaacacgagccacgtgcgaccaaaatactgaacgagcgaacacatttcctaccccttggcaacccgctactcatgcaacacgcagcgcttacttccggggcaacacgcacacaatgcacaacgcacgacagcaacctggcgccacaccagcaacgctaactccactgctacgcctctggacacgctcttgctgccgatttgccacgcccctgcctctactgcacacgaattgcgcctttaaacacgtgtgccacacacccacacaccgaagctctctctaaccgcacactctacttctctaggacttcctgaacaggcaatggctatatctagccataatattacaccaccttaaaccacctgagtccaataccttctgggttcaaaactgggcgccctagggcgaaggctaatatccactggaagacatttctccagtagattccgtttgtaattaggcgtggaaaattataagcgttaaccttggaaaagtgtccgcgttatattaccgtgggtctcacagcacttggttcgatagatgtctgcccaagacaaccttttgtgccaagagcggtcattattcattctgtaagggctaaagggtagggtttcattaagagcataggtcgatgaaccttaatgggcgaagcgctcttccgagtgaaaatggtcccctgaccctttgtctcaagttcgaaagggcgatgatattgccccattcaaacgcgtatgagacgttatggggcaagtttacggaccccttttaactttctcaagagttctaaactatggcggacaaaaggtggcagagtttactttacaagccccttatcgccgggcgtaagaaagcgcattgatgaccagatatcgcggatattaacttgagagcaaagggccgttatcccttgggacgcagttacagagcagggaacaagagaggcgggagaggctcaactatgaccgactccaacgcgaccaccattactagattaatacaggc

SEQ ID NO: 547003 - DNA, 794 bp, Homo sapiens
gggcgctgtcatggcgggtgtgcttgaagaatgaccactggccttgtgggatatggcgtgtgctgcgaatactcctcacgagagcgctaacgaatattgtacactaaagattcttgatgttcttgagtgaagatccctaagataatgcacgcatatacgacaagtatactgaacagacttacaaactgacaagctggctatggtttaaatgcgtgaagccagcatgttgagggatttagaatactcaatcttcaaggcggtcacattagaagaggtgattcttcaggctgaacatgaacgtatgatcctggctagaaaaatgagggaatggaatattatgggagccaccttagttggaagagccctccatgccgatcagtggaatatggccagatgataattattcaagctcgacattttgggtgtgttcatgggaaactgatgtgatttcatatacttctgttatattaagagtcgtgtacttattactgaccattgtagtaagtcacacgaacaagtgatatagtaaaatactgtatggagactgttaacattggtgattatggtccatatggtcatgtgcaatcaatttcgatttataaacgtagtcacagaaagttgtttcagagtatgatattctctgtgaaccagaagaggccatggggaaggacctggaaacgtcattaaggcaaaaatttcctaaaggattcttccctgcagaaaccatcatcaaaaaagtaaactttctttattagtatgtttccactccgtcattctatttttaaggtatccga

SEQ ID NO: 547004 - DNA, 490 bp, Homo sapiens
  misc_feature (8)..(8): n is a, c, g, or t
  misc_feature (66)..(68): n is a, c, g, or t
  misc_feature (263)..(263): n is a, c, g, or t
  misc_feature (277)..(277): n is a, c, g, or t
  misc_feature (310)..(310): n is a, c, g, or t
  misc_feature (315)..(316): n is a, c, g, or t
  misc_feature (319)..(319): n is a, c, g, or t
  misc_feature (346)..(346): n is a, c, g, or t
  misc_feature (355)..(355): n is a, c, g, or t
  misc_feature (367)..(367): n is a, c, g, or t
  misc_feature (375)..(375): n is a, c, g, or t
  misc_feature (403)..(405): n is a, c, g, or t
  misc_feature (410)..(410): n is a, c, g, or t
  misc_feature (418)..(418): n is a, c, g, or t
  misc_feature (445)..(445): n is a, c, g, or t
  misc_feature (480)..(480): n is a, c, g, or t
gctaaaanatagatgctctctgggtttgatgtcggcggcgtaattcttagcaagtctgagtcttgnnnccgcctcagctctggctgccttccggattccactttggcctctaacgagacaccttaaagaacaggctttaaaagatgctgcttccctgttttcttccaggaacacagagaccaacacggtttcaaacaccgggcgagcctctcactatttcctgggaatgttacttctcagcccaacacttctcttcccaagangttcacgttttgtntctgtttttctccccggaacagtacttacaacncaaanntcnttgattttcaaagatgggttcttttcntgtcctggnagagcatcagtnactaaatntcaagttctccacaatgctgcccccccnnngggcntacccggnggccaagggggagaattaacatctaanaacaaggaaaagactcagggggacatttttttggnacccacgggg

SEQ ID NO: 547005 - DNA, 134 bp, Homo sapiens
caggctgtctcgagctcctgggcttaggcatctgcccctcttggcctcccaaagtgttggcgattacaggtgcgcgccgtcacgcccagtgttgatgattctatttttcagtttttgggggacacatggcgaaa

SEQ ID NO: 547006 - DNA, 999 bp, Homo sapiens
caaacatcatactacgtgcccctggtggcatgtggacccggggctcctgggttacaactgtgccgtgacctgtacagcagtgatccagactgacgcgggagagggaacgtgaagcccgtgaacgagacctccgtgatcgtctcaagtctggctttgacgtgaagcctaatgagctggaacccctagcatggggtccctgggccctgggcttggatccctttccccgcaaatgggggctctggcgtctgcagcctggtccaccgtggcctgtcaccctttcccctttcatccgagcgcgtggtgcgccccgtggtagtcggagaacgtctagcgctggcaggtggtgtcaggcctgcggctggacatgtcctatgctgagcggctggcatgctgtagaggctgcatcgcgagacatgggtggcggcccatgggctacctgatgccactggcccggctgggatgcgtcacatgtgactcccgctgtcagcgatcggcattgccctcatccactcgcacctgctgctgcatcagcaggatgctttccattggggcctcctgcctcggtgcgagccgtctcattgagcccctggactctgggtctcggacttagccgggtccgcctacccagttgggactcttgctaaccccgctgtgtctcaccctctgcacgcgaacggggttcttcgtcccggctctttggtggtccttacgggactgcgggctcctttttggcccgatgtctgcggctcatctcctggcggccatggccgggcagcagtgagctgaggcgtggggccggacagcagacgtggtgcggccctcaacccgtggccaggtgccgtgctgccggggatataagtgccgagagggagggagcctgggaaccgttcaacaacgggcctgtgtgggaccccccccgggggcgccacaagaggtgggcccaaggggggagactgggcgacgagatcctcgagctatagataaaacacagagtcgccc

SEQ ID NO: 547007 - DNA, 179 bp, Homo sapiens
ggccaaaaaaatttaaaaaaatggggaaaggatagtaaggccagtcccattaaaggtttgaacaaaaaaaaattttccattggattttcgcccaagtttgcttttttgggccaaacctttgttggaaaaaacaaaatttggcttggtttttaaaaaaaccaaaatttttttccctcgga

SEQ ID NO: 547008 - DNA, 416 bp, Homo sapiens
caggtctctaccttaaacagcttcaggaaggggcgggagttaaaagggttatgattcaaggaggggccgcagaacacgggtgctgacaaacctcttaggataacaggagacccatataaagttcaacaagccagggaaagggtgtaagagttaattcgtgatcaaggcggtttcagagaagttcggaatgagtatgggtcaagaataggaggaaaggaagggatagatgtccccattccaagatgggcggtgggcatggtaataggaagaaagggcgcgatgatcaaaaaaatacaaaaggaggcgggggtccgcattcagtttaagccagatgaggggacaacacccgaaaggatagcacaaataacaggacctccagaccgatgtcaacaggcggcagaaattatgacagggta

SEQ ID NO: 547009 - DNA, 557 bp, Homo sapiens
agcgggggttgcagtgagccgagtgcgcattgcactccagactgggcaacaagagtgaaactccatctcaagaaaaaaaaaaaagaaagaaatggaactctagagaggtttcaggacttggctcaaagtctcagagtgagcaactggcagagctcaggtttaatctcccagatggtctagctctatctagaagttcttaggccttatgctacctatctttctacattctatgtccacgtatgttaaaaggttggtctccatttaaatcattcacgggagagaaccaggtatagagtatggtagcaggtggtaaaaactggcatattggtaattcggttagtagaccaacagggagaagaatggtccagtcagctgaatatctaattggactaccgggatatggggattattttatcaccaggcattttctaatcaggtaaaacttaacatctacagggttttacctaaggtctgagtttggctttatgaaaatttttagtacaatctgatatgaatttgagaatgtttgagatgaattctcataaatgtcaatttcc

SEQ ID NO: 547010 - DNA, 114 bp, Homo sapiens
gtgatctagaggatccgtgtcatccccttcgtgaagctaagcaccaaacgtagcctcttcccagagccagctctgccctggcttccctcgcgatctcccctggcttccctcgcg

SEQ ID NO: 547011 - DNA, 1268 bp, Homo sapiens
ttcctgccctcaacctgggcatcgcccccacccttccggccccccagaacccgctgccatcccccggagcctcccgcgagctggccgcgcaggatgggcgcactcaggcccacgctgctgccgacattcgctgccgctgctgctgctgctaattgctaggaatgggatgctgggcccgggagggtgctggtccccgaggggcccttgtaccggggtggctggcacagcctgtcctccatctccttgcaattgttgaccggctacttgagggcccttgcccaaggcgatgaacctttcggacgtggcttccatgtagtagtgccccggaggcccccaagatactggcacatgggcagtttggtcaggtaccgaagggaatacccccaggtttcatccgtattgcgtgtcattcagaggtcccggaggttggttgagagggcgtcgacgcgttgcaagggtgcagcacggccttacaaagcgctgacttgcccgttgtgatggctccaaaaggacatttggccccggcccttgccgtgggcccccacgcgcattgccccggtccgattttaacttgagttttgcccaacgatccccgcgttccactttggatttaccgcgggcattaaccccttgtgggacgaagtccttaaccactgcctgggaccaaggggatgaggagcccctcgcaagaagttttacatttcaccaggaactgcctaccattccgccagaggcttgctccgtgagcctgggcagccgctgccacacctatgtgtgtccccccacgcaactgggccccatgcacacaacggggactcacgtcgaaaacactcattctccaacgccccggcataacatggccgtttttgcaccgcgagtccgccccatattgccacgcgccgcggcccaacgtcgtcaccaccacttggtcccaccccggggcatagctcattcacctcttgtccgcgcacgggcgaccaagagtgcgacccgagccaaggaacacgacgcaccgacgacgcgaccctttggccaggtcgtcgcccccatatgggtacgcgccaactattggctgacccacgaagaagtctccaccccacgagtctgagcggccgagggacccagcaagctctattctgcagcggaaacccttttgagctgaggggaacacactcgcgggcgggccagcatccctctcgtcgacccgtctcgtacgcacgccatagagcaaagctcatccccctataatatcccttgctgcgccggaa

SEQ ID NO: 547012 - DNA, 582 bp, Homo sapiens
gagcggggacgtcagcgctgccagcgtggaaggagctgcgtgtgtgctgcgggaggacggaagtagagcccgggaccgccaggccaccaccggccgcctcagccatggacgcgtccctggagaagatagcagaccccactgttagctgacatgggaacaaacttgaagtgattgcagtgaatgatgctggcaggacagtcagagacagaacagaagaggaaaatggaaagaatgctcatatcctggaggatattccaggcccactcccatgggcaggtggtgcaagatatggtgagccatcctccagttagttcagaatctcatgcatggacgatgaacgatgacggagcccacagaagccccaagaactcccaacatacttgcgagacaaccaaggtcatactgggccttatgctagggaccacatacgtctgtggagcttcatattttcacctctggacaaagagaagctgagaaaacttacaactaggatactttcagataccaccttatggcctatgacagaatttacagatctgaacactgggtgtgcttatttccaacgaagaggaaacgagaatg

SEQ ID NO: 547013 - DNA, 859 bp, Homo sapiens
  misc_feature (554)..(554): n is a, c, g, or t
ggaggcagcacgcccgccgcgcccctgctctgtatgccgctctctcccgggcggcgcgcgatcacagcagaggagccaccgcgccgggttgatgtggttgggccggggtgaggaggccgcaagatgccgcagtccaagtcccggaagatcgcgatcctgggctaccggtctgtggggaacactcctcattgacgatttcaactttgtctgaaggccaatttgtggactcctacgatccaccatagaaaacacttttacaacgttgatcaccagtcaatggcccacgaatatcatcttcaatttgtagacacagccggccaacgatgcaatattctatctttcctcagaaatactccatagatataaatggatatatctgtgtgtattcgggtacatcaattcaaaagtttgaaggtgattcaaagtttatccatggcaaatgtgtggatatggcggggaagtaacaatacctatatgtgggtgggcataagaaagagctggcttatggaaagggtgatcagttatgaacgaggcaaccttgtgagaaatcttgncatgcagtttttggaatcttctgtaaagaaatcagatgtgtggatgtttatccgaaggatacttggcggcagaacaactgtagggacgttcacagacagtctatgccgggatgtaatcttgtgcacgctgagacctggaatttttactgacaaagcatgcggtcctgagatacatgtttattcttgtaacgacaataatgggccgagccactcaattttaacctggttgacagtgtctccagtcattaacactattcaatttagtttatattaacaatgagcataggcgtgactataaagctgta

SEQ ID NO: 547014 - DNA, 276 bp, Homo sapiens
  misc_feature (33)..(33): n is a, c, g, or t
  misc_feature (43)..(43): n is a, c, g, or t
  misc_feature (154)..(154): n is a, c, g, or t
  misc_feature (157)..(157): n is a, c, g, or t
  misc_feature (162)..(162): n is a, c, g, or t
  misc_feature (166)..(166): n is a, c, g, or t
gcactgaccaagaacagcctggacgccagcagncagccggctnctcgcccacactgaccccggggaagcggcacagaaccggccctccgtgatcacctgtgcctcggctggcgcccgcaactgcaacctctcgcactgccccatcgcgcacagngcntgtgncacncagggcctgccagctaccggagccaccgagcgctgccaccacctgtgaccccgtggtggaggagcatttccgcagagcctgggaagaattacaaggagcccgagccggca

SEQ ID NO: 547015 - DNA, 468 bp, Homo sapiens
atcgatacctaagtgcgtgccgccaccaccatttccggattgcttttgcaactccccactttcagcaatacccccaccattgcgatggccgccagcgttctgctgctagtgccgggctttccgttgattaatgccgtcgccgatatgtttaaaggccacatcaataccggactggcacgctgggcgatcgccagtctgctgacactggctacctgcgtcggcgtagtgatggcactgacgatttgggggctacgcggatgggtgtgatcgaatttctgttagcgttggcgcaggatatgatcctcgccgccattcctgcggtcggctttgcgatggtgttcaacgttcccgtgcgggcgttacgctggtgtgcgctgcttggctcgataggtcatggttcccgaatgatcttgatgaccagcggcttgaatattgagtggtcaacctttatggcttctatgctggtcc

SEQ ID NO: 547016 - DNA, 893 bp, Homo sapiens
tggatccggcgtcagggctgacgggcggaccgaggtgtgagcgcagagtctgtcaggctgggttggtgaaggtgcgcggggcctgggcacggtgttgggagtgcgcggagggaccggccaggcgggctgcaggcaaccgtcagagccctgtggacaccccctcaagcgtccgcagtgcgcgatgaaggcactgatcttagtgcggggggctatgcggacgcgggctacggccgcttgacgctgagcacccccgaaggccactggtggacttctgcaataagcccatacttgctgcagcaagtgcaggcgcttacgcccgcgcgcaggcgtggaccacgtgatcctggccgtgaggctacatgtcgcaggtgctggagaaggaactgaatggcacacggagcagacgtgctggcgactccgaatctccattgtcccattgacgaggaagccctttggggacagctgggccccgtgggctgctggccccgggacctaactctctgagactggagacccatattctttcggtcctcgaacacggtgacgtgatcttgcgagtttccccttccaaggacaatggttgcacgactccaccgggcaccaagtgggccaagtgaaggggctccacaccctgggtgacccacacgctggggggcaccccctcccaagtacggagcatgcgtgcctgctgctgaacgctatgacaacaaggcgcggcactcccccggagtcggtgggcaaagccccccagggcgtcccggtcccagtaacgaatcaccgcaggcgctgtgacaaacctgaagcccgcagacgagcgcgcggacctcacacctcgagcccaacgccatggagaaccgcgggctccacacataatggccacgacggcaccaaaa

SEQ ID NO: 547017 - DNA, 986 bp, Homo sapiens
tggccggatctggctctgacaacctctccatggcgtatgcgcggactacctccggcatgttgttcattctccctctgtatggtatgccaaatggagactggagaagaggaaaggtgctccgtgggacatgctacccgttcgtggcaatgtcatgagggaaaggtgaactgtacacctactttctactacaactcgtatgcgattgatttgtcgcaacataaggggctactccgagaatgagccactgggtcctctggcaatgtctcacatctttgggaggccgaagatgatctcggatgccatccccgagcttgaaggcctccatccacacgcaagggggaagatttccgcgaaggacccttggaaggtgaagccgctgtgacgggtgggacagatttcctttaatttatgaacggcagtcatgttcagcttgcaaaagaccgtgtgcagagtaaacttcgtattttaattcgctctgggtgatcgattactggtattgacatcattcatgccttccaaatcgtgggtggctctgtgggcgcatcaataaacagccgtacccttggaattcattaaaaaataaaagaaccgagcccacggggacacacaagccacaacacgtgggcggcggcagccgacctgggggcccgcccggaacacagacgtgctacacgagaacaagatcgactgtgagcgtgcacgagcggagcccaacagacggggatcagcgtgacagcatgggaccaacaaacggagcagaaccacaagggaacaacacaagccggggccaggacacaacacagcagggtgagggaaaacccacaccacaagacaaaacaaacgccgccgcgcggggcccaccccggagggcagtcgacgacaaaaaataccgacatagggagagaaacgagagggctaaacacgagggcgttaatacaacaacagggggaagcaacagggcaagccacgaaccattcaaaaaagcc

SEQ ID NO: 547018 - DNA, 486 bp, Homo sapiens
cccacaccacctgagtcttataagaggattacaggcgtgagccaccatgccaggcctccttttggtttttgataaatctccatactattttccatagtggttgtactaatttacattccaaccaacagtatataagagttcccttttctttcttgccagcatgttattttttgtcttttaaataatagccattctaactggggtgagatgaaatcacattgtggtgttagtcatatacctcttgtctatatgtatgtcttttgagaaatgtctattcatgtactttgctcatttttttaaatgagtttttttttttaactgttgagatgtctgaattccttgtatgtgctgggtattagtagtcccctattggatgagtaatttgcaaacattttcccctatacaagaggttgtttcttcactctgtggattgtttcttttgctgtgcagaagcacgtaaatttaatatactctcatttggctatt

SEQ ID NO: 547019 - DNA, 910 bp, Homo sapiens
  misc_feature (728)..(728): n is a, c, g, or t
taaagccctgcgtggcaagccctgacgcaccgccgatgatgcccaggaagacagggcgatctggtagattccaagatacttccttaggatcatccaattattggatgattatccgaaatgttgcattgtgggaacacgacaatgtgggctcctaagtcaggatgacacgcctagaatccctgacaatggtccctatctgcggagcgtaaggctgctaggtcggctcgaatgggcaaaacgaaacaccaatgtatgtcgccaatgggcgcaattccgaggcgtcgatcctgtgtacacatacaagcccgagactctgagacgaaaactagctgacgctcaatataccgtggggggaaatagtgagtgcattgtgttggtatcaaccaatggaagtgaccctttcagcatggaagattcatgcggcacattgttatgtgtagggacatactacatggttgtgccagactagactgaccccgttgcacgtggttgcacgcatatgaccccaatgtgtatagtcagcgtgaagagccatatgcccagaagcaaactggttcatcgttgtcacctgaaaaaaaagcgctaccgttttgtgtccaggacttatagtgtattcagccaggctaaaaaatcgtccagggggcccccatggtacaaattccctgaacgttgatagatggcaagctagactcgaacgaacttggcagtatcaaatagtttgggtgatnccctaggtcgaaaagaccaacggctcgtcatggaaactagtgcatcaggaacacttcgttgctccacatatgcttccttttgggagcttaggatccatctcagcggggaggtttctgcaccaattgtgtaagaatgctacaaccccttgaaaatgctctgaatatcacagaaggaaaatctg

SEQ ID NO: 547020 - DNA, 288 bp, Homo sapiens
tggaagggcatggtggatggccgacgcctgtaaccccagcagtttgggaggccgaggcaggcgatcgcttgacgtcaggggtttaggaccagcctggccaatgtggcggggccccatctctgcagggaataaaaaaaattagccaggcatggtggtgggcgcctgtggtcccagctactcggagggctgaggcaggaggatctcttgagccagggaggcgaggttgcagtgagccgggattgtgccactgcactccagcctgggtgacagagcgagactcctccatca

SEQ ID NO: 547021 - DNA, 137 bp, Homo sapiens
ttatccatttaaggatatatattaaacagagagagtctaagtagaactacagtgactaatcagtccctcgggatggtggtgaaccgtgaagcatgctttaaccatctaagacgtgtctaacagcgcgctttgtgggg

SEQ ID NO: 547022 - DNA, 314 bp, Homo sapiens
acaaggtatacctgtttaggtatactgacatgggtctttctgctcccttaaacactaccaaactacaccatgggccagctgcagtggctcagatttgtaattccagcgctttgggaggctgaggcaggtggatcacttgaggttaggagttcgagaccagcctggccaacatggtgaaatcccatctctactaaaaatacaaaacagctggacatggtggcaggcacctatagtcccagctacttgggaggctgaggcaggagaatcacttgaacccgggaatggggaggttgtagtgagccgagatcgctcca

SEQ ID NO: 547023 - DNA, 425 bp, Homo sapiens
atacagagatcgagagaacacacacgcacacacagaccgacacaggacactacacacacaatatactactcacttaggcctgtctgcgcatagaaaaacatctctcagggtcctaacatattgatatcagatacactcccccgaagcgtgtgtggacatctttctttcaagagagaagtgtctccttacaccaggcgcgtatccactaccagtgactctggagggatatgacctgggggagggagtgtgtcatatatctctttgagcgtgtgtggctccgaagtcatatatgtgcctggatcctctgccacgggttaaatttacaggtgaagagtgaggttgtcatgcgctcagatatgcttcctggctctccctcaagagtgcagccttggatagagaactcacagctctgggaaagagaggag

SEQ ID NO: 547024 - DNA, 475 bp, Homo sapiens
  misc_feature (243)..(243): n is a, c, g, or t
gaagtgaatgttgagaaggctcaccccgctctttacccttctgcggaatgccttgccaacacccagtgacgacccccactgcgctcatgaccgaccccaagtacatcatttggtctccggtgtgccgcaacgacattgcctggaactttgagaagttcctggtgggccccgacggtgttcccgtgcgcaggtacagccgccgctttcgtaccatcgacatcgaacctgacatagaaacccctntgtcccagcagtctggcaactcctaaggcggccctggcattggcttggtgattactggctgcactctggggggcggttcttccatgatggtgtttcctctaaatttgcacggagaaacacctgatttccaggaaaatcccctcagatgggcgctggtcccatccattcccgatgcctttccacctaatgaaaggtggtttcactactaagaataaagtgctgaatatcagaa

SEQ ID NO: 547025 - DNA, 130 bp, Homo sapiens
ttaacatcgtgtccttttgatctgttgtgatttagagggtgaactcactggaatggggatgcttgcatgtgtaatcttactgagagctaatagaaaggctattgaccaaacctattgacacgaatgttca

SEQ ID NO: 547026 - DNA, 150 bp, Homo sapiens
  misc_feature (64)..(64): n is a, c, g, or t
  misc_feature (102)..(102): n is a, c, g, or t
  misc_feature (133)..(133): n is a, c, g, or t
cctggtttgtccaggagtagtcccaagtgtatttcatatgaaatgcttcatgtcacacctccantgagcccaccagtatgtcctcaagaccagtcctgtggntgatgctgctggttgggtggatgtggataangaaactctgaaacaaag

SEQ ID NO: 547027 - DNA, 377 bp, Homo sapiens
gcacggcaaaccccgctgtaacccgcataaacccactctttacgccatctttacgccccaccctgcgctcgctctcgttcctttacaccgctcctgcggacaatgcccccacacgcggcaatcgccgcaagacggggaaatttccatgagcgttctggacggagtgtcactgctatgggccgtggcgctgttcatttatctgctggttgcgctgttacgcgcggatcggaactaggagcgggctatgcacagttatgactattggctgatcatcgccttctttgccgtggtactggtgccggcaccctttttggggcggttctactacaaggtgatggaaggccagcgcacttggctcacccagaacgacccaccga

SEQ ID NO: 547028 - DNA, 144 bp, Homo sapiens
cgttgagttattggaagtatgcaagatctggccttgaatcgcacggcttaacatttcgtcagcttcatccagtacaaacatcttgatgtatttgggggacaggtatctccggttaagcatatcaaacatacgcccaggtaagca

SEQ ID NO: 547029 - DNA, 107 bp, Homo sapiens
gccctggaaatcgcaatgctccacagaaacatgtgtaaaatacaccatttatggagtccatgaaggtgtgcctcaaatctcatttagtaaagctgggtagtcacaga

SEQ ID NO: 547030 - DNA, 114 bp, Homo sapiens
cacgccaagctcagactcttatatagcacatccggctcctcttgtccttttgttttcttgcgcatggcatttcactcactctgtcaccaggctggcgtgcaatggtgcatccca

SEQ ID NO: 547031 - DNA, 190 bp, Homo sapiens
ccctgtgctagcaaccagcctcactcgtatctgatcgccattatcgcgaactgtctgaagcgattgatgatgattataccgatccgactaaaatgcacttatgcgcttggtttaaactggtctaactccattctgggtggtttcaacatcagtggctataaaacatatagttacgacggtgacaatgact

SEQ ID NO: 547032 - DNA, 985 bp, Homo sapiens
gatccgaccctcaccccacctcggggttctcgcagccgcggccctggcctgtcactgcaggccttgaccccaacccttcttgccagtagcctggtagcattctctgcccctgaagtctccatgcccaccggtccgcatggcctccctgatcccatgctggagccccatttccctcatcccactcttgcaacaccccgtcccacccattactattctccatacggcacgttgcaccagaacagcgagatcatctacggaccccggctcatgcctatgtcatcaaagcagcccccacagcaatcacatatcccatgaccccgacccagtcgagagcgaaccacatccgccgggccccatccaagggctacgacggcaccaccaggcgcgcccctaacacacacaacagcacaagccacagtgtggccagcgaacgacacagggcgacagcatctgcccatcctgagggaccccgcgacgcacgaaccccgcggcaccgcccccgcgggcccacaactcccccgcacgtactaggacaccacattccccgatgccctgcgccagccgctaaagcgccacacagacacccggaatggacaaacaagacctagaagagagacaccacaaaaaccacttgccagtggcccgcaaacaatcacaagcggatgaaaccccacggcacaaaaaacaacatcacaattcagttcagtgacccaccatggacaaagcgcatggcccacccaactctgcgagccaccactataggccacatagccacacctcatcccacagacggcttagtggcaatctacggacactaggaaacaacccatactagacaagagccggacatcccactttaggacgcgaattcagcaactaaccagattacagcatatcaacaataactaccacggacaggccacttcttccgtatctacacctattcacccggcgcagaaacgtagattgtagcgaacaagcaacg

SEQ ID NO: 547033 - DNA, 887 bp, Homo sapiens
gcgcggtagctgggaccgtcgcttcagtcgccaattatgtagcatctttgtccgcgcccaagagctacacacctttacgaggtgacacgagccaatgtgaaacggtcgcccagatcaaggtctcatgtagcctctctggagggcatttgcccccggaatgactcccgtcgtgctccttgtgcatgttgcgcccctggagtgatgtaggccaccctcttgtggccatgtgcggtggtggtagtgctcctgactagctccttggatcgttgcaaggcctgcatgcttggatggtaaatgtcctattggttcccgtggtccctgtgcttggacagaacgtgagacggtcagatctcctaaagtgttggccaaatcatggagaatgatagacagaaagaatggacatggtcgggctaagcggcggattgcacttacagatcggcgctttgtcaagcgttgtgccgcacctttgggccgtaggacacgaagaggctccactagagtgccacagctacttttagagttcatcttctgctacattcgtgggctgttcgttcgtagatctagatagacacgcccactcttaagttctagatcgataacaaaattcaagaactgagtcaataaagaggagcatcaatgcatgttacacacaaaatgaagaccagaggcgcccattggtctaagtggacggggtggcccaaaaacggccgaggcgcgaggcacaagggagccagacaggcccgatagaatcgtgccgaggataaccccgggctattcttccgttggacctttgatgggcacccttgcagggagaaaccctcggtggagcttgggacaataatccctttgtgtcttacgagaggatagtcatcgacgcgtagtcagag

SEQ ID NO: 547034 - DNA, 280 bp, Homo sapiens
tgtaccccagtggaggccagcttgatgagcagttctacctgcaggctgctgaagctgcccaaacagaccagccatgatgtgccctgtcggggatgagagccaggtcgagtgctccacatggtcagagacaagccagttttctccttccaacctcggggccacctggaacttggcgacaaactcgacatcacccgttcgacacgggtgatgcggttgggactagcgagtctgacttgagtacacgtttcgtggcccggagactgccgtcctggggacacgg

SEQ ID NO: 547035 - DNA, 136 bp, Homo sapiens
tctgaggaagctgggaaataagaaatcgtcgtcttctccacggggtggtgacttatctcccaccccgtggagaagacgacgatttcttatttcacaggtccttggacatcgctttggccttcccagcttgctcaga

SEQ ID NO: 547036 - DNA, 419 bp, Homo sapiens
ccgtccctctctcaacttcgtgccctatcccttatttatttgatcagctatgccttgtatttttccttgcttagactgttatcatttacacttctgtactgttattatgatggcatcttctggctccagtgcgaggaggctcaccgtgctagcactgtgagtccccgctttaatgtccatccacgagttcacagtcacaatagaaagcaaggcccttacagagactcttgaagctaacagtactttaaggtcgaggagccttactgccctggggaattctgggggatatgcctttcgatttctgctctactcgggttcgcccaccacatagatccccatctgtcttgctgtccgaacgtgtgtgatgcagattctgtctcacctatcgcgtgtattccctccgatcccgctcacttcta

SEQ ID NO: 547037 - DNA, 219 bp, Homo sapiens
  misc_feature (30)..(30): n is a, c, g, or t
  misc_feature (96)..(96): n is a, c, g, or t
  misc_feature (104)..(104): n is a, c, g, or t
  misc_feature (114)..(114): n is a, c, g, or t
  misc_feature (176)..(176): n is a, c, g, or t
  misc_feature (191)..(192): n is a, c, g, or t
  misc_feature (205)..(205): n is a, c, g, or t
aatgagaaagtttgaaaaaaagaggtggancggtcggaattccgggatccgcatccgcctccggcctggcctgatttgcgccggtttaagtgacgngccgacgngggctccggntccgttccgacaggcaggccagctggaatgagagatcgcgcgcgggtacggcgcaaaggagnagggggggcggtcgnngggaattgtgcantgggccccgggaaa

SEQ ID NO: 547038 - DNA, 250 bp, Homo sapiens
gggtcagctcgccgaacaggtcggacgctttgcgccgggactcatcaggtgatcagcaccatcagcgcggtcattttgcagccggccagcagcaggcctttcttcggaatgccgtttttatccagctcgccgtacactttcgggaagttgccgtcgttggcggcgcgtaccccggcctggccgaccagcatcatccacgaaccgagcgacgtcaggcaggcgaaggcagtgaaggcggaaaccatcggtg

SEQ ID NO: 547039 - DNA, 272 bp, Homo sapiens
gctcgactctgcacggccctttgaagattcgggctacatgtacacgtgcatgagcgtgtgtgtgatgtgcgcgcgtgtctgtgtgtttgttcatgtctagccggcacgtgagtgtgtgtgtgtgtgtgtacctacagtggtgcttctgagagagatgttcaaaagcaaatctttgccttgagagtagctgtgatgtttttttttttttcttttcttttttcttcttcttcttctttttcttctcctctgagaggacagaggagatagtcgac

SEQ ID NO: 547040 - DNA, 153 bp, Homo sapiens
  misc_feature (60)..(60): n is a, c, g, or t
gtattagcatcatccctctactattttttagccaaatcaacaacaacctatttagctgtncccaaccttttgcttcgcagcccctaacaggccccctgcctaatactaactacctgaacgtgcctacccctcaaaaatcaatgggcaggctaa

SEQ ID NO: 547041 - DNA, 379 bp, Homo sapiens
  misc_feature (319)..(319): n is a, c, g, or t
  misc_feature (326)..(326): n is a, c, g, or t
  misc_feature (340)..(340): n is a, c, g, or t
  misc_feature (344)..(344): n is a, c, g, or t
ccgatgctcagaagtgtcttgccagcaacattcctgctagcatacaggagtgatttcctaaaccagtttcattctagtctgaatagggacaaacaaatcttgaggaagcccaagtgcgtacctttatttttgccccaccaccctctttctgtactcacaatttttgtttgttttttgtttttttgtccctgtcatataatattttggtgcttcaaacttgtaccttcattgtacatcctttctttctcccttgggtcttattataaaggagacaatgtacggtgtaattaccaaaaggatagggaaaccaggatttcangcctctncctgggtctatctnaatncattctttgtaaaataaacatgggttgttggatac

SEQ ID NO: 547042 - DNA, 170 bp, Homo sapiens
  misc_feature (1)..(1): n is a, c, g, or t
ntgtgatctagaggatcctccagaggcacaagggaggaggagaggtgctctgactttttagagtttccagtttttctggttctggttttttcccagcggggattttgggtcttcttgatctgggataagcacagtgcagagcatgggctggggtacgtgggccggtttct

SEQ ID NO: 547043 - DNA, 1152 bp, Homo sapiens
gaagaaggttccagtccccggaaggcctggacctggacgcctggatcaatgagccactctcgtgacagcgagtcagagtgacgagaggcccagtgcccgtcttccacgaggagtgagcagcggtgtccaagcacctggcctgtcggaggcggacgacggaagagctggctcgtgctgcctgagaggcccggaagcaggagcaggccaacaaccccattctacatcaacgagctcgccatcgccacagcaagcggtaccatggacaccccgggcgtggagcacattcccctgtggctgcagacttgacctctccgtgcccttgaaggttccagggcctgcctactgtcaggatcacgtatgtgaagctggacgcgaggacgcgccggcacccggccgaacgctggcagaaggacaagaggaggaaacagaggcaaaggacaaacggagcagacgaggcgagcgccagccgaccaggccccacagccacagacagccgacacagagaccacggcacacgacgcgacactccggacaactggcacccaaagaggagcaacacaatcgagcacagaccgccaccgccctgcaccagtggcccgccgcccgccgcgagcggcggaggactgaacagacaggagcagacaacagggaaacacgccagcaggaggaccgaccggcagtaccccgagcgggcagggcacgggccacagcgccgcccgacgaggacgaaagacgggcaaaagtgagcgacaggcgcaagaacaacaagggagaaaataagaaaaacacactgacacaacgaaggataccaccaacgcggccacccagcggacgacagagaccgaccgacaagcacgcacgaaccgatccgcgccgccgcaccggcaccagaggacgcacggaaaggaagaacacagccgaaaatgcaaagacgggaggaggcggcgaacgggggggggagcgacgggccagcgggaaggctgcagggaaggaggaacacacccgccccggaccacggacgccccgcgggcgcgagcacgaccgccagaccaacaaacagcaaagcacgcaccaggcccccgagagcgagtggcgcaacgcagagcggccgagcgcagccgccgggagtggggagcggggacgggggggagg

SEQ ID NO: 547044 - DNA, 236 bp, Homo sapiens
tggatacagaagcaccaacgagagacacagctggtggaacacacatggccagagtgagagccatgctcaatgaccgtcgccgcctgccctgtagaatacatcaccgctctgcagctgtcctcctcgcctgtcactgttcaatatgctaagaatattccgcgcaaacaaagacaacaccaccctaagcttcgagctgtgcgctggtgatcccagaagccgtcaatcgtccagtatac

SEQ ID NO: 547045 - DNA, 208 bp, Homo sapiens
tcttccttctgttctagtgagtgtatgagaccttgcagagttgtttatcagcatactcaaaatttttttcctggaatttgtagggatgggaggagggggtgcagcttacttgttgtagcttttttttttttttaccaacttcacagagaaagcagttgtcttgcctccaggactgtctgttctggggccaagaaaaggccacactgtt

SEQ ID NO: 547046 - DNA, 357 bp, Homo sapiens
cagtaagggacggtggccggattgctcaccagaaggtggtacggctcttacggccaggactggatgatggtaaaccccggttgggggtacctggcaaggtggtcatgcagggcggtatggcaggtgtggggaagatggccaagtacgggagagaatactttcggtcccttgaagaactggtgagtggcatgtacagaatctatgacatggagaacgtccggctgggacatcatttcaccaattccaggattctatccagtatgtccagaagaatgcgggaaagctgaccaccactatgggcaagtaatgtgcccaatcaccatagtgccattcaacttagggccaatcaccataggg

SEQ ID NO: 547047 - DNA, 616 bp, Homo sapiens
tttcagaaattacctgcgagtaattttttcttagtgattgcagaccgctatgttgcctaggctggggtgaaactactggactcaagcaaacctctcacctccacctgtgtaagggctaggattacgggcctgagcgactgcactatgctttgcaggggcctatgggggcagatccttctatgttcatgggcgcttgggcgatatgtggggttaccgccccactactgtctggagtttaaagagttccaactctctcgctaactgctgactcgtccgtccccgcctctgaccccaccgcggatcccgggccgaacccctccgggtgccggtttatacaggtatcctccccttatcctgcgggacggcgtctccgggggaaatgcttgcgcaccggcgacccacatgtggtttccccgactaagcgcgattacttttctgtaacctcgtcctccggtggtgaatatttgctgccatactccttgggtgttgcatcacaggcgctgaatatcttgcctcgagctccctcgtgggcgtagctctctacccctcatcggcctggagggtcttcttgcttccctggcggggccgcggtctcttttaccaccctttacccccc

SEQ ID NO: 547048 - DNA, 967 bp, Homo sapiens
ttctccccctcattaatgcggcttccatccctatctcggctcatggccaggaccttggtgaattgtttctgtggttgaccgtgcttccctttcacccggtttagggggccaaggcctaggtagcaacgagcgcggttctggcctgctgatccccccatgggtgaagggcaatttcacagttgagctagcttgtaccgctacctgtctttagggaaggacgccactcatcggtatcttgggacgcactgcctcatcactaaccgaagcttcttcctgcggccacaagcaaagctgctctcccacgctttctgtatgcccttgctcccttctaggccccgctggacctctgacagaaaggtgctcgcacatccctgtttagccgtgaatgtctaacgaccatctcgctggagccccgcggaactggggctatacagcctctgcgactgacacgcgttgctcttccggggccaagaaagcgccagatcccccgggagcaacgctctaccctacgaatcgtgttcctcgagtcagatccttcgtttcattcgccccacgcttctccagatcgcacccagtagaccactggatatgatgtctacttcgatccaatgcaacatggcacagtcgcacccagagaagagagactgattgacgcgtcagcgatacttcggtactagcctcgcgaataactagtatcacggcgcacagcggtgtctacagctcactgaagtagcgctcacgcacgtgctctgcgtagctgaagtgcaccaatgggggagtaaaggggcgagcactccacgtgagagaatgctgcctgtggcactgtcccgccatgcctcagtgccacttgacattccttgtcaccagcaaccatactcgagccacctggatgtcccttgtcccaccaactctgcagctccatggccaccccgtgccacccgtaggcagcctctctgctattactcac

SEQ ID NO: 547049 - DNA, 116 bp, Homo sapiens
gcgagtagcatactgcacacgcgaggccacactgcacacgccgagagcccagaccaaaatcgccgatcttcacgtgcacacgccgagtgcccataccataatcgccgatcttcacg

SEQ ID NO: 547050 - DNA, 658 bp, Homo sapiens
tgtaatcgacctgtcccgttgaagaggcgggcgatgacacgggcgatgacgagaagcaccctatgagtacctttaattgattattgctacttcactagcctaatcagacccacaggtcctaaactaccccacctgcattaacattttcggtgggcgtctacctcggagcgaagcccaacctccgaggagtacatgcttaagatttcaccagtctaagacgtaacgtaaactatagctgctagatttagtatccatagtaaagcgtttgtaccagatggtagacaaggttcaccctagaggataaacagcagcacatccctatatctagcagtgccgatatcaaacgatatagggttatacgaactcgcatgtaggatcacggacatcccgagggtgcagtcgctatcatgggttcgtgttgttctaaccgattagatgtgctacgtgatctgagttcatgatccggtatgtaatccagagtctggtgttctatctacttcaaatatcgctccctgtatcgaatagggaccaagagatataaggcctacttcacaatagcgccttcccccgtactagtgatactcatctcaacttagtattatacccaaaaccgcaacctataacagggtctccaactgtgcaaatgaacctttgattg

SEQ ID NO: 547051 - DNA, 957 bp, Homo sapiens
  misc_feature (707)..(707): n is a, c, g, or t
ctcactgttgcctgtttcttgtgtgtgaagggcaggactgaaaacacacaagctccaaactaggcccctggtgaccctcacttggtcagcaatgccatcagtcctcagaacttccttccacgaccctcctcatcagtccttccaagccgcaggcagctttataccccatgtgccatcaccaggctggactgtccaccttggctgaccagactgagccctgatggcttctatttcccaaagccatgccacccaggaagacaagcctgagtctgtaggaggggagctgccacacaggctcccagctgcctgcccggctccttatctacctcttggcagattctacactcagtccccaggcctgatccaatcaaggagttgaggcttttcaaaaacacacactgggagaaaaatgcaaaccaaagcaggtggacgagatggggtgaaaggaaaacaagaatggcaatgttacacaagaccaagagtgcgtgacgttaatgcagaaatggaggctgcacatcacttaaagcagactcccagctggctgtgctcggggcctccagcagccagtgcaggatgcaaaacctggcaagcccacaaagcactgtgcctatgggataaagcaagccagctggcccagggaaagcccgattcctgacactcaggctgcaacaaaatgtctcccaggacaggactgatcacaatactgnttttagtcatccaatattcgtataatgtgttacttttgagaactgaatgccgtacttggggatgcacatgtattttacaattgaatctgattcctggtggtgaacattccaggaggtggtaggcttatggtaaaaaaaaggcgttctacgaaattttactcccgactgggggacaccccagaggtctttgaaatgttcctacggcccggacttatgacaacgaacttgggggcaacacgccacatgaccg

SEQ ID NO: 547052 - DNA, 947 bp, Homo sapiens
cgaccgtgggttcccacgatgccgccaggatttgcgtgatggtgtaaaccacctctgtgtgtaaaaaaccttgtgcaaacacacgggtccttctgagccgcgccttgttttatgttgagacgcgcctcccaagaccgcagaatctgtgttgccaacacagggtcacaacttttggggcgagacctaacccttctggaaaagacaaggagttcgtaactcagccattatgagcccgtgtgccgccgtcgtcttcactatggacggcgccaagccctcttatacccctttctgggggaaaaaactttcctgttgcttcagtgaaagcgatcatgctagcaaactgccctccaaaacacggtctgtcgttttaccaagaagtgattctgtcagcatcaaatgattttccccaacaaaaattctcgtcagatatcttcttgataaattatgaccctgccccctatggataatttttgccgccccccccacccccactcattaaagtaagtctctgtgccacaaaaatcgggtacaatctaattgaccactcgtatatgaggttgattctctacattttcttggaccccacccacacctccgggccccaaacatctctttcaccacctgcttctaggaacgaggtgatatatatctcgtcacatcacctatttgcaaaaatatacttagcccccgccacatgttgcctttataatcaatatcgagcgttcatttcgaaatggctgaaccatctttgagaaacaattcggccccagattttttcccagacagcatttcattccattcacagtgtagattcgtcttgatctatatttattagaaagaatcactcataaacccgccagattttttttctataacagaaaaaggcagcccaaagtacaagtcctgtcccccaggcttaaaaaagaagccctttcccccacataaca

SEQ ID NO: 547053 - DNA, 205 bp, Homo sapiens
ctgagtctagcaggatcccctaggtggaaatgctgactgtgtaagaaatgacggtgcttgaaggcatgatgatgtgcccacatgactctggatctcgaacctgttggcaggatgtgaacaatggtgagctgtgcagcccacaggactgggctgtggctggtgtggacacatgccccccaacgttggccaatgctgagtctctggg

SEQ ID NO: 547054 - DNA, 466 bp, Homo sapiens
tcagtgatgaccatgccctgccctgccctgccctgccctgccctgccctgcccagcaccttcagagccctctgcagaaggttgggcacagggcggcccatctgcgtgtccgttccacccaggagcttctcggcactgtgccggagtggtcagggttgctctgtcatctgcccacagtgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggggcctctctcggcagccacagccaagggtggaggcttcaggtctccagcttctctgcttctcagctgccatctccagtgccccagaatggtacagcgataataaaatgtatttcag

SEQ ID NO: 547055 - DNA, 147 bp, Homo sapiens
gttaacagctatagaccatgcacgggccgtcgtttaacacaaacagttataaccatgcacgggccgtcgttgaccgcgaacagctatgactatgctctggccgtcagttatctagtacacaggctatgaccatgcactggcctgtcg

SEQ ID NO: 547056 - DNA, 368 bp, Homo sapiens
tgatagctgactctagaggaaaaactacagacggtgcatgccgtaccaatgatgcataacatggatcctgaaggtgaaccacagaggagggcagagaattctccgaggaaatggtcatttgatgtgaggacccagaaagacagacatatctacacaaattgatatagcagactactctctgatggggaatggtaaagggacaaggacaaagtgaaggttgctgagaagatacaagttctggctataagaagggcagaggagcagaggcaggagacagaggtgggcaggcatctggcccaccccaggaccctcctggaggggcttggacactgggaggaatgaaggctggcacgggagctggcacgggg

SEQ ID NO: 547057 - DNA, 1218 bp, Homo sapiens
gcggaagtcccaattcacgaagattgagcagtagctgtgagttgctggcgctggagcgattcgtgtggcacgtggagccacggcgtgcgatgtagggggctgaagagcaggcagcagcggtcagcgggcctgccctctgctagccgctttgggtctcggtggataccccgatttcttcctgtatcgtgtgcggacgtagcgctgcggcgagatgcgacactccccccggctcttcggaacttccggtagttcggacactccagatgtaactcccatatggtccagcaagacgagacgacgttgcagcgattgacagctttgtcccgcagaggcttctgcaagtccagtgccttcaagtgtcggtgcctacgaggtggccgaagaaaggccgtgaatcgacgatgcatatggccttgatagcaaatggtttggcagaacttcaaggcgggatctggaactggggttgaataggctcgagtgtgacactgggcttccgggtaaaccggagcattcgcgtggtatcttgacggccgccacgggcaagactgcagagacctaagggagccacgacaaggactagttggattccatgcttaagatccgagctttcgcagcgaagatgcattgcagtctcgctattcgcccaaggccgcaggacccgacaagtcggcttgtgcaggtcttaaccagcggaccttccattgcaaggctacaaacggtccacctaacgaatgccgaacccaactggatttaattctgtgccggacacaattggtcccaatagtgctgattcttggcagattgcaaggacagaattgccggagcaagaaaacgccttgcgagagcgctataaccaagggggcttgcccacttgggcgaaaggctctgcacaggaaggtcttacatgcgaaagctgcagtagccagcgtttaggaggatgactaccgcgggcaagcaaatggggttgccaacaacgggcaggtgctttcctttcaggaaacgagccgtcagcaagggatatgagaaaggccccactatactggacatggaaacgttggccttaggtgaacaggatataaatctatcttccacgaaaaacgcggcgtttccctatactggagctatagaaccgtgtgcaatttttgtcccctttgtatggggcgaaggaaatctcattaaatagcccttccttggcaccgcaggtgtcgacccagcgaa

SEQ ID NO: 547058 - DNA, 194 bp, Homo sapiens
actgacctatctatactgacatatctatactgacctatctatactgacctgcctccccctggtgactacccgccatggaaccgttggatacaatctgcatgacttatctatactgacgctatctatactgacttatctatactgacgcctatactgacttatctatactgacccccgcgccgacaattatggcg

SEQ ID NO: 547059 - DNA, 1407 bp, Homo sapiens
  misc_feature (320)..(320): n is a, c, g, or t
catcacttctcagctaagatcaagtgttaaaataaataaataaataaataaataccaagttatgagtgtcagagcaggggagccctccacgcagccacggagccagtctgagggaagaggtacataggatagaaaaatctctaggctccaacgcttctgcttcggtgtctttccatttcccagggtctatgtgttgccttctcttcattttccagcaaaattccttttgagatatgttggccttcactcggctgaactagggggtgaaggaaggttgtcctctgtgggccactattgctggggaaacagctaaaccctgnaggccaagtggaacttggaggtgccaagaaaacctagaaggtgcaatggggctgcgacggatagaggtgtcaaaccagaagggaggaacccgtcggaggtgggctgtgaccaccggaccttttcataagtggtggcagtggtagaattgagggggcaagtaggcttggagaatgtttttagccaggggctgttgagagatggcagaagggggtcttaatgtggggactgtggacagtggggcattcgtgggaaccagagggattttggacaagtccagatggaatgtgcagggcataggtagagggaaaagaaaatccctttctgggaaaaccatttcttgtttattgaaacaatgcaggacatcatcaaagtccgggtggacacattccattatctacaaattacaaaggtaggcacagcaaagaataatgaagattataagaaaaccaagcgccaggcacggtgactcaagcctgtaatcccagcactctgggaggctggggtgggtggatcactcaaggtcaggagttcgagaccagcctggccaacatggagaaaccccatctctactaaaaatacaaaaattagctaggcgtgggggcgggcgtctgtggtcccagctacttgggaggctgaggcaggagaatcatttgaacccaggaggtggaagttgcagtgagctcagatcgcaccattgcactccagcctgggtaacaagaatgaaactccatctcaaaaaaaaaaaaaaaaagaaaaaaaatttgtgggggggcgacaggggaccggaaaaaaggttaaaaaactctttggggggcgcggggcccaaaaagaaaaagaaacggggctaaggttgtccaagagaccggcagacacgggggggtcccacaaaaaaaagccggggaccgaggtctgacaaccaagggggcggagcacaagcgtacaagggccaggcgataaagccagcgggaaaaacgaacccagcgcagagacgagacagatgagaggactatgctaaaggagcacacacggcacagacagacaagaaagcagcagaggcgagaggggagaatagtgccgaaaacggca

SEQ ID NO: 547060 - DNA, 478 bp, Homo sapiens
actccctgttaatcggccgagggtcctgttggtcgcttaagcgggcctctgcgtgggcggcgggaatccgcggacatcgggtcgggtctagtgctcccgagtggcgcgctcctgaggcgggagcccttgtactgggtctcgctgatggaggctagccagatgcgtagtgccacactagactagtatccttacttgtacgcttaatcccatgcaaattggcgtagatgactgcctgtgtagcatgcagttggttgtgggtgcccatggtgagtgcccgtgtggttgggggctgtgtgatttgtgtggaaccagcagagagagcataccagcagagaagtggtttctgggcaagtatggccatcctgtgtgtgccaggtgagagtacagcagagactagtgtgaacagtgtgttgcctgggtgggcaccatgaagatgcaagggcgaagagcatctgcagttgaaagtgcaaatttgccg

SEQ ID NO: 547061 - DNA, 1716 bp, Homo sapiens
  misc_feature (629)..(629): n is a, c, g, or t
cttttggggtctttgctgatctgtgaccttacccccgaccctgtgctctctgaaacatgtgctgtgtccactcagggttaaatggattaagggcggtgcaagatgtgctttgttaaacagatgcttgaaggcagcatgcttgttaagagtcatcaccaatccctgatctcaagtaatcagggacacaaacactgcggaaggccgcagggtcctctgcctaggaaaaccagagacctttgttcacttgtttatctgctgaccttccctccactattgtcccatgaccctgccaagtccccctctgtgagaaacacccaagaattatcaataaaaaaataaaataaataaataaataaataaataccaagttatgagtgtcagagcaggggagccctccacgcagccacggagccagtctgagggaagaggtacataggatagaaaaatctctaggctccaacgcttctgcttcggtgtctttccatttcccagggtctatgtgttgccttctcttcattttccagcaaaattccttttgagatatgttggccttcactcggctgaactagggggtgaaggaaggttgtcctctgtgggccactattgctggggaaacagctaaaccctgnaggccaagtggaacttggaggtgccaagaaaacctagaaggtgcaatggggctgcgacggatagaggtgtcaaaccagaagggaggaacccgtcggaggtgggctgtgaccaccggaccttttcataagtggtggcagtggtagaattgagggggcaagtaggcttggagaatgtttttagccaggggctgttgagagatggcagaagggggtcttaatgtggggactgtggacagtggggcattcgtgggaaccagagggattttggacaagtccagatggaatgtgcagggcataggtagagggaaaagaaaatccctttctgggaaaaccatttcttgtttattgaaacaatgcaggacatcatcaaagtccgggtggacacattccattatctacaaattacaaaggtaggcacagcaaagaataatgaagattataagaaaaccaagcgccaggcacggtgactcaagcctgtaatcccagcactctgggaggctggggtgggtggatcactcaaggtcaggagttcgagaccagcctggccaacatggagaaaccccatctctactaaaaatacaaaaattagctaggcgtgggggcgggcgtctgtggtcccagctacttgggaggctgaggcaggagaatcatttgaacccaggaggtggaagttgcagtgagctcagatcgcaccattgcactccagcctgggtaacaagaatgaaactccatctcaaaaaaaaaaaaaaaaagaaaaaaaatttgtgggggggcgacaggggaccggaaaaaaggttaaaaaactctttggggggcgcggggcccaaaaagaaaaagaaacggggctaaggttgtccaagagaccggcagacacgggggggtcccacaaaaaaaagccggggaccgaggtctgacaaccaagggggcggagcacaagcgtacaagggccaggcgataaagccagcgggaaaaacgaacccagcgcagagacgagacagatgagaggactatgctaaaggagcacacacggcacagacagacaagaaagcagcagaggcgagaggggagaatagtgccgaaaacggca

SEQ ID NO: 547062 - DNA, 240 bp, Homo sapiens
ttttttgaaaaagggccaaaggggcccccctttttttttttccccctggggaaaagggggagggggggtttttaaaaccccttcccttttgggggcaaaaaaagggaagggatttttttaaaaggccggggggggctttaatttttttggggccccctttaattggaacttgcctttttacggggggggttttttttttttttttgggggaaaagaaaaaaaaaagcccttttttttcca

SEQ ID NO: 547063 - DNA, 1566 bp, Homo sapiens
  misc_feature (479)..(479): n is a, c, g, or t
aaagccatttctctagattcctatacctgtaatcttattaatacatttaaaatacatcagtgcgggccgggtgtggtggctcacacttataatcccaacactttggaaggccaaggcgggaggatcacttgaagccacaaatttaagaccagcctgggtaatatagcgagaccctgtctctacaaaaaaaataaataaataaataaataaataccaagttatgagtgtcagagcaggggagccctccacgcagccacggagccagtctgagggaagaggtacataggatagaaaaatctctaggctccaacgcttctgcttcggtgtctttccatttcccagggtctatgtgttgccttctcttcattttccagcaaaattccttttgagatatgttggccttcactcggctgaactagggggtgaaggaaggttgtcctctgtgggccactattgctggggaaacagctaaaccctgnaggccaagtggaacttggaggtgccaagaaaacctagaaggtgcaatggggctgcgacggatagaggtgtcaaaccagaagggaggaacccgtcggaggtgggctgtgaccaccggaccttttcataagtggtggcagtggtagaattgagggggcaagtaggcttggagaatgtttttagccaggggctgttgagagatggcagaagggggtcttaatgtggggactgtggacagtggggcattcgtgggaaccagagggattttggacaagtccagatggaatgtgcagggcataggtagagggaaaagaaaatccctttctgggaaaaccatttcttgtttattgaaacaatgcaggacatcatcaaagtccgggtggacacattccattatctacaaattacaaaggtaggcacagcaaagaataatgaagattataagaaaaccaagcgccaggcacggtgactcaagcctgtaatcccagcactctgggaggctggggtgggtggatcactcaaggtcaggagttcgagaccagcctggccaacatggagaaaccccatctctactaaaaatacaaaaattagctaggcgtgggggcgggcgtctgtggtcccagctacttgggaggctgaggcaggagaatcatttgaacccaggaggtggaagttgcagtgagctcagatcgcaccattgcactccagcctgggtaacaagaatgaaactccatctcaaaaaaaaaaaaaaaaagaaaaaaaatttgtgggggggcgacaggggaccggaaaaaaggttaaaaaactctttggggggcgcggggcccaaaaagaaaaagaaacggggctaaggttgtccaagagaccggcagacacgggggggtcccacaaaaaaaagccggggaccgaggtctgacaaccaagggggcggagcacaagcgtacaagggccaggcgataaagccagcgggaaaaacgaacccagcgcagagacgagacagatgagaggactatgctaaaggagcacacacggcacagacagacaagaaagcagcagaggcgagaggggagaatagtgccgaaaacggca

SEQ ID NO: 547064 - DNA, 952 bp, Homo sapiens
cgtccttcatcatacctacccaagtaggcttggagaatgtttttagccaggggctgttgagagatggcagaagggggtcttaatgtggggactgtggacagtggggcattcgtgggaaccagagggattttggacaagtccagatggaatgtgcagggcataggtagagggaaaagaaaatccctttctgggaaaaccatttcttgtttattgaaacaatgcaggacatcatcaaagtccgggtggacacattccattatctacaaattacaaaggtaggcacagcaaagaataatgaagattataagaaaaccaagcgccaggcacggtgactcaagcctgtaatcccagcactctgggaggctggggtgggtggatcactcaaggtcaggagttcgagaccagcctggccaacatggagaaaccccatctctactaaaaatacaaaaattagctaggcgtgggggcgggcgtctgtggtcccagctacttgggaggctgaggcaggagaatcatttgaacccaggaggtggaagttgcagtgagctcagatcgcaccattgcactccagcctgggtaacaagaatgaaactccatctcaaaaaaaaaaaaaaaaagaaaaaaaatttgtgggggggcgacaggggaccggaaaaaaggttaaaaaactctttggggggcgcggggcccaaaaagaaaaagaaacggggctaaggttgtccaagagaccggcagacacgggggggtcccacaaaaaaaagccggggaccgaggtctgacaaccaagggggcggagcacaagcgtacaagggccaggcgataaagccagcgggaaaaacgaacccagcgcagagacgagacagatgagaggactatgctaaaggagcacacacggcacagacagacaagaaagcagcagaggcgagaggggagaatagtgccgaaaacggca

SEQ ID NO: 547065 - DNA, 563 bp, Homo sapiens
  misc_feature (6)..(6): n is a, c, g, or t
  misc_feature (18)..(18): n is a, c, g, or t
  misc_feature (29)..(29): n is a, c, g, or t
  misc_feature (33)..(33): n is a, c, g, or t
  misc_feature (35)..(35): n is a, c, g, or t
  misc_feature (41)..(42): n is a, c, g, or t
  misc_feature (47)..(48): n is a, c, g, or t
  misc_feature (54)..(54): n is a, c, g, or t
  misc_feature (61)..(61): n is a, c, g, or t
  misc_feature (72)..(72): n is a, c, g, or t
  misc_feature (100)..(100): n is a, c, g, or t
  misc_feature (106)..(106): n is a, c, g, or t
  misc_feature (137)..(139): n is a, c, g, or t
  misc_feature (145)..(145): n is a, c, g, or t
  misc_feature (147)..(148): n is a, c, g, or t
  misc_feature (161)..(161): n is a, c, g, or t
  misc_feature (178)..(178): n is a, c, g, or t
  misc_feature (181)..(181): n is a, c, g, or t
  misc_feature (195)..(195): n is a, c, g, or t
  misc_feature (197)..(197): n is a, c, g, or t
  misc_feature (205)..(205): n is a, c, g, or t
  misc_feature (214)..(214): n is a, c, g, or t
  misc_feature (222)..(222): n is a, c, g, or t
  misc_feature (229)..(229): n is a, c, g, or t
  misc_feature (232)..(232): n is a, c, g, or t
  misc_feature (238)..(238): n is a, c, g, or t
  misc_feature (241)..(241): n is a, c, g, or t
  misc_feature (245)..(245): n is a, c, g, or t
  misc_feature (248)..(248): n is a, c, g, or t
  misc_feature (256)..(256): n is a, c, g, or t
  misc_feature (258)..(258): n is a, c, g, or t
  misc_feature (277)..(277): n is a, c, g, or t
  misc_feature (285)..(285): n is a, c, g, or t
  misc_feature (298)..(298): n is a, c, g, or t
  misc_feature (313)..(313): n is a, c, g, or t
  misc_feature (349)..(350): n is a, c, g, or t
  misc_feature (356)..(356): n is a, c, g, or t
  misc_feature (370)..(370): n is a, c, g, or t
  misc_feature (380)..(380): n is a, c, g, or t
  misc_feature (388)..(388): n is a, c, g, or t
  misc_feature (403)..(404): n is a, c, g, or t
  misc_feature (416)..(416): n is a, c, g, or t
  misc_feature (436)..(436): n is a, c, g, or t
  misc_feature (456)..(456): n is a, c, g, or t
  misc_feature (560)..(560): n is a, c, g, or t
cgaggngcgggaacagtncgggagagtcncgcncngcggcnntagcnncggagngtttggngagggggcagngcgagagggggaggcgcagggcgagggngaaggnagtcaaaaggacgaagaccagacggcaccannngagaangnncaagcacacagangcagcagaagaggggcnatnggaaaaaaaagggngnacgggagngataacacnaaacagancaaagtnccncaatgnacngacnctnaatatgantnggcagatttatccacagcnaaagaagngggaacaagatcntgaaactttcctgancattataaagggagcaggaggaaaggctttctgtgnngggggngagatcagagtgancgcggaagcngaaaaggnaaaacagaagatagnnccagtgtgtgtntgtcagagaagaatatatgntgaataatgcgtggggggtngtgccagaaaccgtagggtgcacgtagtcatggaagtacaatgggtgggggaggtggtctctcagtccatgggcaatttcgagtggctacagaaaagtgtcttnttg

SEQ ID NO: 547066 - DNA, 921 bp, Homo sapiens
  misc_feature (320)..(320): n is a, c, g, or t
catcacttctcagctaagatcaagtgttaaaataaataaataaataaataaataccaagttatgagtgtcagagcaggggagccctccacgcagccacggagccagtctgagggaagaggtacataggatagaaaaatctctaggctccaacgcttctgcttcggtgtctttccatttcccagggtctatgtgttgccttctcttcattttccagcaaaattccttttgagatatgttggccttcactcggctgaactagggggtgaaggaaggttgtcctctgtgggccactattgctggggaaacagctaaaccctgnaggccaagtggaacttggaggtgccaagaaaacctagaaggtgcaatggggctgcgacggatagaggtgtcaaaccagaagggaggaacccgtcggaggtgggctgtgaccaccggaccttttcataagtggtggcagtggtagaattgagggggggagaatcatttgaacccaggaggtggaagttgcagtgagctcagatcgcaccattgcactccagcctgggtaacaagaatgaaactccatctcaaaaaaaaaaaaaaaaagaaaaaaaatttgtgggggggcgacaggggaccggaaaaaaggttaaaaaactctttggggggcgcggggcccaaaaagaaaaagaaacggggctaaggttgtccaagagaccggcagacacgggggggtcccacaaaaaaaagccggggaccgaggtctgacaaccaagggggcggagcacaagcgtacaagggccaggcgataaagccagcgggaaaaacgaacccagcgcagagacgagacagatgagaggactatgctaaaggagcacacacggcacagacagacaagaaagcagcagaggcgagaggggagaatagtgccgaaaacggca

SEQ ID NO: 547067 - DNA, 406 bp, Homo sapiens
accaggagtgaggcacagtgagctatgattgtgtgccactgaactccagcatgggtgacagaacgagactcatgactcgggggaaaacagcaaaagcaactgaattctgagttctattctcgtggtacattattttactaaatataaaccatttctaagagtgataacttcagacatactcgaacaatttgaatattgagtattagaaactttgactaccatttcacacaccaaccagtcaacttgtgaacccagatgttgtcagggtttctccccacaaaaccaaacaatctccagaaaacaccatctgaatgtcctctaattcagttcaaaactgggacataatgtcacataccacaggctgagggctcagtcccctaagactgtctccacttcagatgccagt

SEQ ID NO: 547068 - DNA, 297 bp, Homo sapiens
  misc_feature (207)..(207): n is a, c, g, or t
  misc_feature (238)..(238): n is a, c, g, or t
ccattctccgctcgatctgccagctgaacaggtgcagacacagtctcactttgcatgatgcacgggacggatcgcgaattgctcagctctccagaggtgaaggtattgcgcagtttggatcatctactcaaaccacccatgaactcaccattccaaataacttaattggctgcataatcgggcgcaggcggcaatattaatagatcngcagatgtcgggcccagatcaaaattgcaanccagtggaagctcctctggtaggcaggttactaatcacgtggctctgctgccagttatt

SEQ ID NO: 547069 - DNA, 297 bp, Homo sapiens
acattcaaagagctgatgcccgtgagctagcgttgcggcctcgcggctgcagctcggagaatgctggcgcttaggctaacgcacgttggacagctaaccagactacacgcctcccgtgcagccggaggcgggactgccacgcaacacgggctacgagcgcatagcgcggcggccactgtcgccattctgtggacggctcaacaacactagtgagtgactgaccaggtaggccaggtgctgctcgttgtggataatactgattgtaaggcaccagctattccttgtgacgatcggtgg

SEQ ID NO: 547070 - DNA, 426 bp, Homo sapiens
atgtattgattttacttattttatggatttccctgtttaagaattctttgcctaaccctaggtcatgaaaaatttattttatattatcttctaaaagtttaataatttttacatttatgtctatgatacatttttagataattttagtacattgtaagagctttaggtcaaggttcttttgccaaaaatcaggtggccatacttgtatgggtccatttctggaatctctattctgttctgttaatcttgtgtatcaatctctccatcaataccatactgcttttattactgtacccatataggaattcttatcacgtagagtgattcctcccattttttcttcattttcaagattgtttggctcttctaggacctgtgccttttcatacaaattttaacacaagtttttctgtgcctacaaaaaaa

SEQ ID NO: 547071 - DNA, 516 bp, Homo sapiens
  misc_feature (8)..(8): n is a, c, g, or t
  misc_feature (75)..(75): n is a, c, g, or t
  misc_feature (108)..(108): n is a, c, g, or t
  misc_feature (149)..(149): n is a, c, g, or t
  misc_feature (153)..(153): n is a, c, g, or t
  misc_feature (189)..(189): n is a, c, g, or t
  misc_feature (317)..(317): n is a, c, g, or t
  misc_feature (336)..(336): n is a, c, g, or t
  misc_feature (366)..(367): n is a, c, g, or t
  misc_feature (411)..(411): n is a, c, g, or t
  misc_feature (427)..(427): n is a, c, g, or t
  misc_feature (430)..(430): n is a, c, g, or t
  misc_feature (495)..(495): n is a, c, g, or t
ttcagagnccatgtgcacctccaacaaaatcacactccctacaagttcagtgtgccccctagtggcacccgtggnacatcttgacaatgggaagggttaacggaagtngtgggggcttccaacccaatgggacataccaggaatggggntgtnggctgctgagttttcttggggaagaagagagagctntgccacagttcagcttgtgggccctgagacaagggccacagtgtgcggggaggattcctaagggggggaaggttggtgtcatgggcagtgactctgggggtgcgggccacggtgtggcggaaaatggngcgctgggtgggggcaagntgggggggtggggggtggggagacaccagnntgggggagggggggcatttccactcagagtgggtgcggggaacngccagcattttagggncangacccggtcagccagcttcaaccccttcacacgcaggatgagctcatggaggttgatctgccatnaagttgaaggcctcgctgaaa

SEQ ID NO: 547072 - DNA, 214 bp, Homo sapiens
ggcggataagattctccctggggaggccttcccttggcatgtgagaaagtcaaccagctactggcgacaatggcacgttaggtgcagtgacctgggccacaggacgcggaaatggactcccttgtccttgccttttcccttgtttgaaaagttggggacacattgggccttttctgatccctggccaaattacaattcctggaaagcctttcgt

SEQ ID NO: 547073 - DNA, 241 bp, Homo sapiens
tcagtgaccaaggagggtctggagctgcctgaggaatgaggaggagaagaagaagatggaagagagcaaggcaaagttcggaacctctgcaagctcatgaaagaaccttagatcagaaggttcacaacgtccaatcttcaatacactgtgtcttcacttgccgattgtgaccagcactacggcggacagcatactgagcgatctgaagccggcactcggacactcacagggctttgtggca

SEQ ID NO: 547074 - DNA, 225 bp, Homo sapiens
  misc_feature (208)..(208): n is a, c, g, or t
  misc_feature (210)..(211): n is a, c, g, or t
aatgtttgtgtgtgtggtgtgttttttcttgggacccagggcgggcttggcatttttagagacaaggtctcactatgttgcctggtctggtctccaactcctggcctcaggctatcctcctgcctcagcctcctgaagtgctgggattacaggcatgaggtaggaggattacctgaggccaggagtgtgagatcagcctggtcaaatntnnctagaccctgtgtc

SEQ ID NO: 547075 - DNA, 906 bp, Homo sapiens
cgtgacgcggggggcggacgcgtgggtcgatgagtataacgggaaatcagtttggcaccaagctgagtacatctatatacatatatatatacgcgcacacacttgtacagaagttatgttgtggccaaggatatgtaatatacccctaggaaatggttcttacctctgggattttagaaggttagaatattttttcagagagaacagtggtactcaaaagaatgaaaggtggtccctacatttactgtattcatcacttaaaatttttaatttttccgagaactacaagtaacatttgaaccatgctgctgtaagtaccttaaacaaaaactcagtgataaccagtatttagtctattaaaaatgctctttttgaagaaaaaagttaggaagtctctgattagccagagtatagtatgagtcttcactgagaaatatggtgacccatatactttgtgaaaacctgggaaaatgcaagtgtgggtatgaagtgtagtgtacagtatgcatagaaacaatgtaattgaagtgtctatcttatagctataaactgacttatttcagaaattgtacagagttgagggggaaagtcaatacaggtaatatatttgcaaatcattaaaggatatggaacatccaaataagttacatttagaaagcaatttataatcaagtagtcaagctatatgaagctgtgccatctggattcaactaagaagggcccagaaaaaccgcacatacagtacatgcatacccaaaacaactaaacacaacggaactcgtcaactcaaaaaacctaccccaccaaacacaataaatctaacaaaagggaccaacacataggtacagaataatggcagtatcacagacaataccacggaaaacaaaagaggaaaaaaaaaaagaa

SEQ ID NO: 547076 - DNA, 140 bp, Homo sapiens
atgtgtgtgtatatgtcgtgaacaccctgagacacccattctctaaggggactgtctcactctgtactcccctggcccctcactgtgtgctgtcccctggatctctagaggcagtgaactgtgaggatgttggattggtc

SEQ ID NO: 547077 - DNA, 376 bp, Homo sapiens
tatgtgtaggtcacagtcttattctagtaacttagatgatggctttttagggtagactattaatattaaccaaaagatgactacaagtgacagtgaccaatggcaagctttgttcttatgtcgtaacttcatcagctgtctcagggttcaatactgacggcttttcttatctcatatttccataagagagttactgcatttctaaagtgttctttctttcatcatcttcaattcatcatttctcagatgataccagaaagccagagctctttctagaccacgtcacacatcacatcttgatgagctgaaatgccttttcaatgccgcaattttactgcggcaggcttcatggcctgtgccctttcaacatcttcct

SEQ ID NO: 547078 - DNA, 1241 bp, Homo sapiens
  misc_feature (284)..(284): n is a, c, g, or t
  misc_feature (321)..(321): n is a, c, g, or t
  misc_feature (377)..(377): n is a, c, g, or t
  misc_feature (1241)..(1241): n is a, c, g, or t
tccaagggtatatacccgtttatttaaaaaagtttacagtttccattatacccaactattaagaaggttatagctcagaaggaggctgtgtgtggtctccgtgttggacagaacgtgtgcctactagaatcatcacaagtgcaaggagaagagggtggaagggaggagcacgagggccgaggaaaaaataagcgataaaagagcttcagaattctcagttataggggctgtgggcgagtctccactgttttaactcttttgtctcagagtatattcacgaccanatatatgtgttcacccaaaatataccaatctctgtgngtaacatctaatgtgggcccatttctcttctcccaaaggccccaacgaggccaaanggagtggagtgtgtaaggcgctattaaatctcaagagagcccctgggactctctatctccctctcgagaagtgcagtgtgcggacaaaaacctgtggcgccttgtgtacgagtggccgcggtttctccctctctcttttctttcaagaggggggcttctcctctcccgcaaactctcaattccccgatatcccctttacaacgagagaacactccgccgcgagaggggtgtgtttcccccagcggggggcgccccagagaggaaaagagcgcccacccaaaactcctggttggggatttttcccagaaaaaagtctcccccaaagacagcacaagatgtgggcgaagtttctccgtgtgttgggccgcccccacaaatctcgagaggagcaaatttagaacacggtgcacgttcctcttccatcttctccacaatccacacgctgccgcgtgtggagaaaaagctccccccccatgtgttttgggcggagaaaacagtgcttcgagatcttaaaaaaagaaaacctcccttggggccgataaacacccttttttttctctcacaccaacgtggggcgcgttttataataccctttttttaccccaataaaagaaggactaccacccctttaggaaaacacccacaagcgcgagcaacaggggcggcgccccaaactatgtttttcgccctcatattctataaagagacagtcttctaagacaaacccacctattaaggtttctccccccccagtaaaaagaacctctttggtggggtgcgtttcccccaagaggaaaaaatctttttttggaagcccccccaaaacagaagaaaggcgccatttaacgcgaggaggacatattn

SEQ ID NO: 547079 - DNA, 801 bp, Homo sapiens
  misc_feature (33)..(34): n is a, c, g, or t
acaacttacaggctaagtagcgaggccaggtgnntaatggagcagttcggcggtcccgcgggtctgtctcttgcttcaacagtgttgggacggaacagatccggggactctcttccagcctccgaccgccctccgatttcctctccgcttgcaacctccgggaccatcttctcggccatctcctgcttctgggacctgccagcaccgttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaatgtggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggcccttttgggatctttaaaccccagagttctgcacccaccgacacccccatctctgtgacttcctggagactcacttcctagatgaggaagtgaagcttatcaagaagatgggtgaccacctgacaaaccccaaaggctaggggccccgaagcttgccttttccaaaatacttcgaaagggtactctaacacggctaaagtcttttggcccaaaactctcaaaggcccctaaa

SEQ ID NO: 547080 - DNA, 901 bp, Homo sapiens
gcggaggctaggcgggcatctcgggcatagggactgctgtggaggacagcggggacgccgagctaagcagtttctctgagaaacccgcctggtaagtgtggaggaggcgggacactctgaagcccaagacgagaggtctgtagctccagccaaagaaaataaaccttagagagggagaaggaaaaaaaaatatccgatcgagctgttcctgagaacagcctgcagttggacatctacagagaggacaactaatgtgagtgaggcaagtgactgtatgtggactgtggagaaagtaagtcacgttgggcccgttgcaggacctggacgtgggttaggaacaggtgtcctttcagaggtgagagtgtcgagcaagggagacgtgaatgtggtctggagtgtgtccttggccttggctccacagggtgtgcttgcctctgcgtgcgccgtcagggagctcatccctgtggtgttctcgccagggtggggtacggggttgacactgaggagggtacacctgctggctggagcggcagagcagtggccttgattgtcttttgcacacgattttaaaaaccaaaaagcataaacatctggtccttcagcaatgctttctctgaagaaatactgtaacggaaggactttctccaagttaaccatcctgtgagcttgattgaggtacgggggtggcacgtggatacttacttgacctcagaggttaccccaagtccggggaagactcatcaggaggccacaggtctgcctataattagaccgcagttccagacacctgagggataacctggaagggcaatgggaatccaccccaagaattagacggaaaattcatgacggggtcccacacagagttagccagaaaggagaggcacacataggaaagccg

SEQ ID NO: 547081 - DNA, 869 bp, Homo sapiens
  misc_feature (33)..(34): n is a, c, g, or t
  misc_feature (426)..(426): n is a, c, g, or t
  misc_feature (439)..(439): n is a, c, g, or t
  misc_feature (447)..(447): n is a, c, g, or t
acaacttacaggctaagtagcgaggccaggtgnntaatggagcagttcggcggtcccgcgggtctgtctcttgcttcaacagtgttgggacggaacagatccggggactctcttccagcctccgaccgccctccgatttcctctccgcttgcaacctccgggaccatcttctcggccatctcctgcttctgggacctgccagcaccgttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaatgtggccgaggagaagcgcgctctnttccaggacatcnagaagccngctgagatgagtggggtaaaaccccagacgccatgaaagctgccatggccctggagaaaaagctgaaccaggccctttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgactttctgaagggccccttgcaaagtaatagggcttctgcctaagcctctccctccagcccataggcagcttttttaactatcctaacaagccttgggcccaatggaaataaagctttttgatgcaaaaaaa

SEQ ID NO: 547082 - DNA, 952 bp, Homo sapiens
  misc_feature (33)..(34): n is a, c, g, or t
  misc_feature (426)..(426): n is a, c, g, or t
  misc_feature (439)..(439): n is a, c, g, or t
  misc_feature (447)..(447): n is a, c, g, or t
acaacttacaggctaagtagcgaggccaggtgnntaatggagcagttcggcggtcccgcgggtctgtctcttgcttcaacagtgttgggacggaacagatccggggactctcttccagcctccgaccgccctccgatttcctctccgcttgcaacctccgggaccatcttctcggccatctcctgcttctgggacctgccagcaccgttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaatgtggccgaggagaagcgcgctctnttccaggacatcnagaagccngctgagatgagtggggtaaaaccccagacgccatgaaagctgccatggccctggagaaaaagctgaaccaggccctttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgactttctgaagggccccttgcaaagtaatagggcttctgcctaagcctctccctccagcccataggcagcttttttaactatcctaacaagccttgggcccaatggaaataaagctttttgatgcaaaaaaaagcagcttgagaggcacatccaaagcgctttaagtggtcacaagaagggcccagggtaactcaactctgggagggtcagctgg

SEQ ID NO: 547083 - DNA, 1024 bp, Homo sapiens
agcggagtcgtttcgcgtttccgtctggcgagcaggccatcaggtaagccaaggatgggtgcagtacaagtacactccaggagactatggatgaaagaagcagtgctgatgtcatgcgactttcttctgtagggtccgctgctggtgagttaccgccagtctctctgtcttcgtccacagggctctcccgggctcacatccacggtcctgaattaaagcgcggcacgaccgggggactatcaaggaccaaagtcaaggattaacgttaatatattatggacttacgtgtgacggcgtggttggacacgaggaacgcccagttttcctagagggtggcaacttatgggcagatgcctgtacgcgatcgattggatgttaaccaagtcgtaaaagtattgcatctgaagccgtatcgagatccagtatgcgagaggatgcgagcgtggactgccaactgtggggcgtcgtagcaggagtcactgaaattcttcactggggttcggtgagagattccacatacaagatattgagtgatggttaataccttcatttgacttccattaccgatatgatgctgattcaagaaggaatatcgctagacgaccccagtgggatcagcgggaaatcagtgccgacatagcacatgggagcattgcgtgggactggacattctggtcaggtccgaataggagcctgttgggcctttgggagaagggccagaagttttcatctatactaattgggtgggctcttctgcgcgtgggcgcgcttgggaagaaaggggggcaaagtactgtcttgcaagtgtaccaagcgtgtggcgcggattaaatattaagtaaaaggtcttgtgggaaaatgccattacattttacttaaggaaagtctagggaacagtccatgattctggcttaacggggtggttattaggactggtttaaaaattagtttggaagatgtttcttgtaatggctatggtgaaattaggagaagtgttacaggggcattatgttggaggaaagta

SEQ ID NO: 547084 - DNA, 1130 bp, Homo sapiens
gtgatccgcccgccttgggctcccaaagtgctgggattacaggtgtggtcacacctgtaataggccactgtgcccgggctcaatagttattttttctgcacctcctccttctcccaccctccaccctcaagcagggctcagtgtctgtggtgtccttctttgtgtccatgagttctcatcatttagctccctcttgtaagtgagaatatgcggtatatgagattctgtgcctgtgttagtatgctaaggagtaaaggtcccgcgggtctgtctcttgcttcaacagtgttgggacggaacagatccggggactctcttccagcctccgaccgccctccgatttcctctccgcttgcaaactccgggagcatcttctcggccatctcctgctgtctgggagctgacagcaccgttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaatgtggccgaggagaagcgcgagggctacgagcgtctcctgaagatgcaaaaccagcgtggcggccgcgctctcttccaggacatcaagaagccagctgaaagatgagtggggtaaaacccccagacgccatgaaaagcttgccattggccctggagaaaaaagctgaaccaggcccttgtggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgactttctgaagggccccttgcaaagtaatagggcttctgcctaagcctctccctccagcccataggcagcttttttaactatcctaacaagccttgggcccaatggaaataaagctttttgatgcaaaaaaa

SEQ ID NO: 547085 - DNA, 976 bp, Homo sapiens
  misc_feature (33)..(34): n is a, c, g, or t
  misc_feature (320)..(320): n is a, c, g, or t
acaacttacaggctaagtagcgaggccaggtgnntaatggagcagttcggcggtcccgcgggtctgtctcttgcttcaacagtgttgggacggaacagatccggggactctcttccagcctccgaccgccctccgatttcctctccgccttggcagaagccctccgggaaccgactcggttcgtcgcgtgcatccatcctgcgtttcatgggaaccttggcacagcatacgattctccaggtggattagacgtccattcgttggcgcaatccaagccatgaagcctcccagaagtgcgatcacgaagagttattctcganccgaacgtgtgtgaggcatggcgtcaatcggtgctggttcgatcagtacctgcaggcctcctacacctacctctctctgggcttctatttcgaccgcgatgatgtggctctggaaggcgtgagccacttcttccgcgaatgtggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggccctttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgactttctgaagggccccttgcaaagtaatagggcttctgcctaagcctctccctccagcccataggcagcttttttaactatcctaacaagccttgggcccaatggaaataaagctttttgatgcaaaaaaa

SEQ ID NO: 547086 - DNA, 92 bp, Homo sapiens
gtgagcttactgggtgccagctgccagaaagcacagatttgacccaagctatttatatttataagttatataaagtgtttcttactgtttgt

SEQ ID NO: 547087 - DNA, 990 bp, Homo sapiens
  misc_feature (33)..(34): n is a, c, g, or t
  misc_feature (802)..(802): n is a, c, g, or t
  misc_feature (860)..(860): n is a, c, g, or t
  misc_feature (954)..(954): n is a, c, g, or t
acaacttacaggctaagtagcgaggccaggtgnntaatggagcagttcggcggtcccgcgggtctgtctcttgcttcaacagtgttgggacggaacagatccggggactctcttccagcctccgaccgccctccgatttcctctccgcttgcaacctccgggaccatcttctcggccatctcctgcttctgggacctgccacgcttagcggtattctatgtggtaataacgacttcgcattcattgacgcaaagccgaacgccatggagctcccagattccgtggagagattatctccaccgcacggtggtcgtgcagacaagtcacaagagcgctggttgctagagtatgggatacctgcaggcctcctacacctacctctctctgggcttctatttcgaccgcgatgatgtggctctggaaggcgtgagccacttcttccgcgaatgtggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggccctttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttccgccagggtttttccnattccagaacctatgagcatctacgagccacagcgacgtctgaagggcctccttgctnaagctaatagagggatcctgccataagcttctccctccagccaaaaggcagctttcgttaactatcctaatttctctcggagccaatggcgatncttagatcacctgcaggatgcagctgcatgccctcg

SEQ ID NO: 547088 - DNA, 1051 bp, Homo sapiens
gtgatccgcccgccttgggctcccaaagtgctgggattacaggtgtggtcacacctgtaataggccactgtgcccgggctcaatagttattttttctgcacctcctccttctcccaccctccaccctcaagcagggctcagtgtctgtggtgtccttctttgtgtccatgagttctcatcatttagctccctcttgtaagtgagaatatgcggtatatgagattctgtgcctgtgttagtatgctaaggagtaaaggtcccgcgggtctgtctcttgcttcaacagtgttgggacggaacagatccggggactctcttccagcctccgaccgccctccgatttcctctccgcttgcaaactccgggagcatcttctcggccatctcctgctgtctgggagctgacagcaccgttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaatgtggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggccctttggatcttcatgccctgggttctgcccgcacggacccccatctctgtgacttcctggagactcacttcctagatgaggaagtgaagcttatcaagaagatgggtgaccacctgacaaactccaaaggctgggtggccggaggctgggtggggagtatctcttcgaagggtcatctcaagacgataaagctttgagccaggattttgagggccgtcttacagggttgctctcctcagcatagagagtacatccacactgggccggttttctgcc

SEQ ID NO: 547089 - DNA, 101 bp, Homo sapiens
acctgttgacacaaacagagcactactgaggccctagaagaaagcagctccagcttctactaaacaggctgacctggcgccagtcgatgtgccttcagcat

SEQ ID NO: 547090 - DNA, 114 bp, Homo sapiens
cacgagggcagataacaatttatgtttcgctgtcccccacaatggggagggatggactagatacttacttttaaaatatttgcacggaacgaactatggtccacacgtgtctgc

SEQ ID NO: 547091 - DNA, 605 bp, Homo sapiens
agagtgagcctttcgaaagatactcgcccagcccagctccgggcacccagcctgtggaggttggtcaggtgtcacccattcttcttgataagcttcacttcctcatctagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggccctttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgactttctgaagggccccttgcaaagtaatagggcttctgcctaagcctctccctccagcccataggcagcttttttaactatcctaacaagccttgggcccaatggaaataaagctttttgatgcaaaaaaa

SEQ ID NO: 547092 - DNA, 525 bp, Homo sapiens
ttcggagggtaccacgagggagggtgatagcgtatctgaggataaaaggcagggggtgtacgcggtctctgggaggacatcgagacgcgagcttaagatgagtggggtaagaacccgagacgccagtgccatgaaaagcttgccattggccctggagaaaaaagctgaaccaggcccttgtggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgactttctgaagggccccttgcaaagtaatagggcttctgcctaagcctctccctccagcccataggcagcttttttaactatcctaacaagccttgggcccaatggaaataaagctttttgatgcaaaaaaa

SEQ ID NO: 547093 - DNA, 921 bp, Homo sapiens
  misc_feature (33)..(34): n is a, c, g, or t
acaacttacaggctaagtagcgaggccaggtgnntaatggagcagttcggcggtcccgcgggtctgtctcttgcttcaacagtgttgggacggaacagatccggggactctcttccagcctccgaccgccctccgatttcctctccgcttgcaaactccgggagcatcttctcggccatctcctgctgtctgggagctgacagcaccgatttggtggttaggtcctgcttgtcaaacatcatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaatgtggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggccctttggatcttcatgccctgggttctgcccgcacggggaaggaccgcatctctggaattcctggagatgcattctagatgagagtgaagtttcagaagatggtgacactgaacaacttcaagtggtggcgagtggtgggatattatcgaagtcatccaggagataaagcttgagcggatctgaggctgaagtaagggtttggtagctcctcagcaagggtttaattaaagtggcatggaaagttggcaaaaaaaaacattgggggcgcaataaaatggggcaagaagagtttttgaagatagggcaaagcaagggaagtgttaagtaggggataatgagaagaaagatag

SEQ ID NO: 547094 - DNA, 103 bp, Homo sapiens
tctatacgaggataatggtatcatcaaggtccttcagagaacatccctgtgaattactcttgcttaagtgtaagcgatgctgtaacattattgaatgctctgc

SEQ ID NO: 547095 - DNA, 397 bp, Homo sapiens
  misc_feature (317)..(317): n is a, c, g, or t
  misc_feature (346)..(346): n is a, c, g, or t
  misc_feature (353)..(353): n is a, c, g, or t
  misc_feature (386)..(386): n is a, c, g, or t
tgatgctaagtgaaaaagtggtcactaaagactacaagcgtgtgccaccatgcctcgctaatttttgtattttttagtagagacaagagtttgccacattgcccaggctggtctcaaactcctgagcccaagccatctgcccacctcgtcctcccaaggtgctgggattacaggggtgagccactgcaccctgcctatttatttacttttcttagagatgggggtcttgctttgttgcccaggctggtctcaaactcctggcctcaaaagatccacccacctcggcctcccaaactgttgggattacaggcatgagncatcttcacctgggccagtaatgtatttnactccangaacaacttcatggaatttagggaactgttatnaattccccctt

SEQ ID NO: 547096 - DNA, 334 bp, Homo sapiens
  misc_feature (8)..(8): n is a, c, g, or t
  misc_feature (38)..(38): n is a, c, g, or t
  misc_feature (258)..(258): n is a, c, g, or t
  misc_feature (260)..(260): n is a, c, g, or t
  misc_feature (263)..(263): n is a, c, g, or t
cccccgancgcacaatgatcggcgccgacaacagcctnatgaaaaagtgctcagaagtcaataatgtttgatgtattaatacactaacctgtgtagccattggcaaagcatatgaatcatacctgagtcaaagtgttccgtataactacggagagttctaattgaacttttaatttatcattattttccttgatcgatcgtttttgtctagacatacgttttctcctatctagggattattatatcacttcataacancncancccccggtatctactagtcacataatgagggctgtttgaatagtctttttgaggggtcattatataattct

SEQ ID NO: 547097 - DNA, 101 bp, Homo sapiens
tgaggatccttcgactgcaggtggactgacccagcccttagagccaatccatatctgcagcaggtctcaatggtgaacagcctccagcgttgcgggtcgca

SEQ ID NO: 547098 - DNA, 218 bp, Homo sapiens
  misc_feature (72)..(73): n is a, c, g, or t
ggttgatttgctccccctagtgcagcaacccccacacccagcaccagggcccccagaactttccttccaggnntactccctgggaacaagtcaattgggctgatcactaaactcacatttcttggacctgaggagcctgtttctctcacggcctcacctcggctgagccgcagtagttcttcagtcgcaagctttatgttctcacccagctaaagctg

SEQ ID NO: 547099 - DNA, 657 bp, Homo sapiens
gagcggggcggggcgggctggagcggagcctgagcagtgactgggcgccatcttgtcgctgcagctggagtcggtgcctgaggttgcagccgagagtgtgcgccagcccgcggaccagcacgaagcctcgtttcccgccgatcgtcgtccgcgccatcgcaccagggtgtcagaccccgtgacatgagcgctctcgcgttgtcagcggtccacctgagcgccgtcagaatccggcgccggctccggtcctctgcagagcacggaccgcgggggacgagtgaacgggagcgagtacccgtggctggcccaaggacagaacatgcagagcgccgtgtcgctgctggctcgttccttggctcggtgcatcacgtgtgcaccgatgcccgtgtgcagtggcagcagcgtgcgtgtgcaacaccgtggggcagaatatatgagatggtcggccaagcggggtagccaagtccgagggtgacaaatttccacacaatcacgcgcgtgggacaagctgtggtggaacgggccatggggccgggcaacgattgcgggagcgacgtgaagaaaggcgaccgtaaaggcccgaaacatgtgtacacgaagaagggggaaccggaaggcagggatgccggttccgttcgatcaatgggggaaggggag

SEQ ID NO: 547100 - DNA, 402 bp, Homo sapiens
  misc_feature (59)..(59): n is a, c, g, or t
  misc_feature (71)..(71): n is a, c, g, or t
  misc_feature (98)..(98): n is a, c, g, or t
  misc_feature (114)..(115): n is a, c, g, or t
  misc_feature (120)..(120): n is a, c, g, or t
  misc_feature (122)..(122): n is a, c, g, or t
  misc_feature (144)..(144): n is a, c, g, or t
  misc_feature (148)..(148): n is a, c, g, or t
  misc_feature (154)..(154): n is a, c, g, or t
  misc_feature (161)..(161): n is a, c, g, or t
  misc_feature (181)..(181): n is a, c, g, or t
  misc_feature (226)..(226): n is a, c, g, or t
  misc_feature (255)..(255): n is a, c, g, or t
  misc_feature (307)..(307): n is a, c, g, or t
  misc_feature (335)..(335): n is a, c, g, or t
  misc_feature (363)..(363): n is a, c, g, or t
  misc_feature (375)..(375): n is a, c, g, or t
gggggggtagtttgaagtagaccttcacggggtcttagtttatccactgttgtgcagtnagggttccattnttgttgtttcgggctaacagtcccttnctttcacctttttttnntagtntnttgagggccagagatgcactgntttntttttnttttttnttcacagtttcctcagattnagcagggtgggaaacatttgctcaatagactcctgctttgtttcntgcttcttttgtttctacctgctgctctngctttgtactttctctgcggggctttgggacctcaatcttgttctgtgcttnttcagttcgttcttggcgggcggtcttnttcttggtgtttggtatctgtctcttcnggggtggggctncccccttgttggttgctttttggcctt

SEQ ID NO: 547101 - DNA, 943 bp, Homo sapiens
ggaaatacaacagatgatgaagaagaagaggaggtggaggaagaagaagatgatgatgaagattctggagctgaaatagaagatgacgatgaagagggtttcgatgatgaagatgagctttgacgatgaacatgatgatgatctctggatactgaggatatatgacattcggcagaccttcagcagcgagagcaggaagctcagcgcaaccaagaagctagctgcaacgaacggtctgcaggcggctctgttgatgctggagctcgggagtaacgctgatccagatagacctgccgagggctgggcacagctttatcggagcacatggcactacatgggtacgttggaaagtactccagatgagaactggattcagatgccataccctgacagcaacgccatgagcgcgtagcctgatcatcttgacctacagcctcggctctgtcgacccgacacacgctggcctcctagcaagcatcgcagcattgtccccaagacggtacacgtcacatatacacaggcaacgcattcctatggatacagatgtggacagcgagatatctcacaaaacacgacggcccagatcaatcgagtcgagcaagcatgcccacgccccggcaaccccgccacacacgaacccgagaagacatgcatacggcaaccaggaccggaacactgactcaaagagcatccgcccaccgggacccaggaagcagaccgcgcacagaaacaccacgcacacaacacgacacactgggtaaaggcccggacgaccacgccccccgaggggcccacccaccgcccttggcccacacaaagcccgaacaacggcgcgaacaacacaactgcgcccagcccggagagggacacacagcaggcgtagcacagaccccgccgccaaacgcaccagtagcagcaccccaaccggagaacgggaacccta

SEQ ID NO: 547102 - DNA, 203 bp, Homo sapiens
ctcgtgtattgtcaggttgtattgcgcgacagctcctggcggatcgcccggtaaccggctcgttgtggatcgcggcaatttccagatagttgttgcgatcgtcgtccagtacggtgaacaaccggaaatcgcgcatcactttgggcgacaggaactggctgataaagctctcgtccttgaagtcgcgcatggcgaagtgcaag

SEQ ID NO: 547103 - DNA, 126 bp, Homo sapiens
gcgcttaaaaaaaaagaagaggaaaagaggggtgggtagttcttcaatttcaaattctttcagtgcactgtaattaattgggaaagtataacgtggaggagtagcagtaattttattttatttttc

SEQ ID NO: 547104 - DNA, 430 bp, Homo sapiens
cgatttgggcgaaaggcataagctgcatgcggttggccgctgacagaatggccacgtcgccggtgccgccttgaccgcaacgacaggcggccacgatgcccacgtcgatgggatacatgccgatcagccgccccacgccaaagccggtgaccatcattgcggccacggtggcgacgatggtgaccacgttctccaccgtgaaggcgccggcgagcttgtcccagggcgtcatggcgacgccgatggcgaacagcagcggataggtcacggcggtgcggaagaacttgtagaccgagaaggcgcccgcctcgaggctgggggaaaaaaccctgccgagcttcaacaagaccgcgatgaacagcatggtcaccggtcccggccaggcccacagcttctgcgccaaggcgcccacgaggtagagcgtcacggc

SEQ ID NO: 547105 - DNA, 852 bp, Homo sapiens
ttgcaagaggaaggatggaagggacaccctgccccatttcatgcctgcattttgcccgtcctcctcccgcacaagtgccccagcgctgggacctaagggctcttttgcctcccatactcccattccagggacctagatctggggcctgaactcgtcctgccccatgatatcagggggccccagcttctcgtttgggcgtgtccctggcgtgccatcacatgcccatttccagtctggctctaggtatgtgatggtgggtatgagactttagggggcttggctcagcgtgggtgccagacttgtacggtgctgagaggcctgccaaggggcctgggcgccgtgcagtattcttctttcccttcttgacctgtgtcatcagggactggctcatttagtgccaagtgtcgcctcaggcccaggtttgagaagccgccgttcgtgacttcaatgagggcgtgaacttcagaggatcagcttcatgtcattcccatcagtgctcccagagcgtgatgaccagccaccaggaggtggacgggagaagcgcctcgctcccgttcccttccttctttccaggccctttgtcttgccaatgtccccgctggtggcctttcaggggcatcgactcttgcccaggactgtccacggggcctgtggcgggctgatacctgagttccggccgttctgcctccattgctgtgggcaccctagtgctccttcgagaggggcttcgggaggctgtgctggtcctctcgtgcccgtctagctcgctctctgaccggggggtctcaatgtcggcatcttcggatccgtgtgcggccctactgactggtcaaatgcgctgtgcgccgtcgg

SEQ ID NO: 547106 - DNA, 707 bp, Homo sapiens
  misc_feature (279)..(279): n is a, c, g, or t
  misc_feature (288)..(288): n is a, c, g, or t
  misc_feature (290)..(290): n is a, c, g, or t
  misc_feature (307)..(307): n is a, c, g, or t
  misc_feature (315)..(315): n is a, c, g, or t
  misc_feature (322)..(322): n is a, c, g, or t
  misc_feature (331)..(331): n is a, c, g, or t
  misc_feature (369)..(369): n is a, c, g, or t
  misc_feature (372)..(372): n is a, c, g, or t
  misc_feature (388)..(388): n is a, c, g, or t
  misc_feature (396)..(396): n is a, c, g, or t
  misc_feature (401)..(401): n is a, c, g, or t
  misc_feature (405)..(405): n is a, c, g, or t
  misc_feature (417)..(417): n is a, c, g, or t
  misc_feature (422)..(422): n is a, c, g, or t
  misc_feature (444)..(444): n is a, c, g, or t
  misc_feature (449)..(449): n is a, c, g, or t
  misc_feature (456)..(456): n is a, c, g, or t
  misc_feature (464)..(464): n is a, c, g, or t
  misc_feature (473)..(473): n is a, c, g, or t
  misc_feature (476)..(476): n is a, c, g, or t
  misc_feature (484)..(484): n is a, c, g, or t
  misc_feature (493)..(493): n is a, c, g, or t
  misc_feature (497)..(497): n is a, c, g, or t
  misc_feature (506)..(506): n is a, c, g, or t
  misc_feature (512)..(512): n is a, c, g, or t
  misc_feature (524)..(524): n is a, c, g, or t
  misc_feature (591)..(591): n is a, c, g, or t
  misc_feature (606)..(606): n is a, c, g, or t
  misc_feature (656)..(656): n is a, c, g, or t
  misc_feature (661)..(661): n is a, c, g, or t
  misc_feature (664)..(664): n is a, c, g, or t
  misc_feature (668)..(668): n is a, c, g, or t
attttgtttataaatgtcatcatcatagtcttttaatattttacataaaaaactgtatacacagcttatagaacttttatgtaaacatcataagctcaccattttgtcatttgtcagtttatttaaaaaataaaaaacaagacaacaatttagtagaagtaccactgggagggaggggaggggaaaaaaggatatacaggggcaggtgtattctctgtacagaggtgcagagaaaatttcacatagctttagagaatgccttgtggaaaaaaaaaaaanaggccccantncttgttactgccctttntcaaaacngtgtgcntgacctgcncaaataaaatcccaaaacagtgttgccacattcttcanggnaacaaagcaaaatttngtgggttnctttncccnctccttgttaanagtcnttttttaaaaacatcagaggtngatgnggttacngcgtacangtgtggtcngantgctactntcgtatgcnaatnacgagtgcnttaagngtcaaacaatgnaacaattgtccaaagaataaaaaaacaaattttagcctttaaataaatcaaataacatcagattctngggctgaacaatttncacttctaggacaggcacaaagttcgcttatggcaaaaacaaccccacancgcanccncccncccccctccggtagcgggtggagggttcgcagcgggctg

SEQ ID NO: 547107 - DNA, 1106 bp, Homo sapiens
agcggagtctttcgttcgggccctaggattcggtagccccgaacgtgtgggctctctccagtaccagactcatttcagtagccagcctttgggaagatcgtagtgaatacctcggtctcttagccacagggatagaatggcgggcctggatcggagccgctgctgcctgttgaagcttcttcggtatgctggctgattcaggtggtcctccccttgattcgagtctacaatagcgggttgggtgcaataaattgcgggattgctttgtgtagagtattttggggtcatttattttactttgctgaaggatccgaatttaatagacatacgactctaatttattcacaatgggaaacaaatatgcagaaacatatactcgcgtgtacccttcagattaaatatttaaattttggacatgcaagaaattaaattcgaaaataatcaattttgttggggattataaagcaactataaattacaattctatcaaacgagcgggcgaaggaaagacagctgggaatcgatccaagatatgcagcactagaatacgcagaggtgtaacaatggatatgctccgaatggtttgtgacaaagatataaaaacggaaaattgaatgcgatcccatgcttaaatgaatgaaatgacttacttgtatcgatgaacaatgccgacaggacaccaacgatgaggattccttatcaatgcatcgacgagatttctatcttaaatgagcaacttagaatggtgaacggaccagggggaaattaatggatgactatattctaattctaatcttgaggttaattaccaattcgcgcagcgattgaacggactggattggggagggtctccctggttttttaaaacaagccacaagccaagcaaactcaatggtctctggtaaattcggggcaaaatcctaaaatttggcttaactttggtggaggtattttggacttttgcagaaacatggaggggcacccttgtttccaggggggttttggagaccaggacttttgaattaggaggtgaatcgggtttacaaaggaatgatgttttgggaggggcaaagtttgtggggaagaaaagccctttaacgcgggga

SEQ ID NO: 547108 - DNA, 468 bp, Homo sapiens
  misc_feature (398)..(398): n is a, c, g, or t
  misc_feature (406)..(406): n is a, c, g, or t
  misc_feature (435)..(435): n is a, c, g, or t
ggagtcggtcaccagccttcagtaaacggccttccagcccgccaatccccactttgagatcggtgctgcatgagcccattaccggcggaacatcaataccacccgcgaccgccagataactgcgcatcccgtgctgcgggcgtttaagcgttaaacgctggcctgctttcatcggcaatcgccagccggtccagacggcattatcatccagccgcgcttcgcaaccggcacccgtcagagcaaaccacccatcagtttcgaactcaacagttaactgaccgagcgtgatctccagcgcgggggcattggcgtcattacccaccagtaggttagcaatgcgtaacgcgggcatatccagtgcgccgcagtggcttgatacccgactggcgaaaaccgtnacgaccgncatcctgcacagtggtattacatgcccgnacggataatcttcagcataattccctccttctg

SEQ ID NO: 547109 - DNA, 122 bp, Homo sapiens
taatgatgtgtaaaatatatatcataatattgtgtatgtatatatatcatatatatttgtatatgtgatatagtgtatatatagcatatgtatatatttgtataccctatatatatttgtat

SEQ ID NO: 547110 - DNA, 434 bp, Homo sapiens
  misc_feature (359)..(359): n is a, c, g, or t
  misc_feature (420)..(420): n is a, c, g, or t
atcagcataaaacctgggcatcaagtcctccagggtatggctggatttaagcaggtacatctggaagggtcgaaaaatcccttcagatcccagaccggatccctcactttcctcaaaaaattttggtattaccaggggaccttccactccaggttcttccttcgggtcacggtccaggaggacggtaggtggacttccaaaaatcccatggtctcgtcctttaacttcctcggtttggtccctttccagtggattcccaagggcttcaaaaagggcagtcaatccattcagagagagaggggggatttcctccaggtctccagcagacagatctctggctccagtaaagccaattcggntttcctggacctttaattttagttaaaacatacctaatggtgcggacctaaaggtgcggangggtcccgagctcg

SEQ ID NO: 547111 - DNA, 186 bp, Homo sapiens
cctaatcgcatcacctcttgctatactgatttagaaaggtgttcttcttctacttcttttttttctttaaataggtttagggtatttggtgatatttattttttttcctggtgggggcaaataagtgctcccaaaatgggcagccccaaggcctaatttaaatgtaagcctatcaatgtcaatgta

SEQ ID NO: 547112 - DNA, 672 bp, Homo sapiens
atacaccagcatgtacaccccgctgacattgtcagacatccccccagtatattacaaataatatcaaaaggtgtacacacattgtgacattagtagtagtataccgctagtatgttgtgaataattatatcagggtgtagacacctgttacattaggagtaacatccccctagaatattaccaatgatatcacagggtgtagcaccctttgcgactttagaaagtatcatccccctagaatattaacgagtaatatcacccccatctcccacaatggatattacgaaccatatcacaggggggtggacaccccccacaatatggcgagtaatatcaccctactctccccgcctagatactacgaaccacttcccctgtaaagacacacatagacttaaaataatgggatgaaaagatatatttcatgtcagtggaaaccaaaaaagagcaggagtagctatacttgtatcataccaaaatagatttgaagacaaaaactataaagacaaagaggcccaggcgcagtggctcacgcctgtaatcctagcactttgggaggccgaggtgggtggatcacctgaggtcaggagttcgatgccagcctggccaacatggtgaaacccaaatctattaaaaatatccaaatagccaggtgtggtggttcaggggatc

SEQ ID NO: 547113 - DNA, 1077 bp, Homo sapiens
agtagcctgctgatgctcccagctgaataaagcccttccttctacaatttggtgtctgaggggtttgtctgcggctcgtcctgctacatttcttggttccctgaccaggaaacgaggtaactgatggacagccgaggcagccccttaggcggcttaggcctcccctgtggagcatccctgaggcggactccggccagcccgagtgacgcgatccaaagagcactcccgggtaggaaattgccccggtggaatgcctcaccagagcagcgtgtagcagttccctgtggaggattaacacagtggctgaacaccgggaaggaactggcacttggagtccggacatctgaaacttgagaacatcaccaccctgaagccagagactaacactgcaggactcagcaggactatttaagaaacaactgaggcatcagaccaactttccccacaagtcctcggatctttcctgccatgctgatgccatatattccaacgtgatcaacctggctccccagaaggaggacgactttgctgtctacaccaacatgcccccttttcatcaccccaggaggacattgccagaccaagtggaatatgtctccattgtattccactgatgggaagctaatgagatgctcagagtgggggtcagacctggccccagctgaatcttggcataccctttgctttagatttatgtgtgtgtttaaaaaaaaaaaatacataggccaggcacggtggctcacacctgtatcccagcactttgggaggctgaggcaggcagatcaccaggtcaagagatcaagaccatcctggccaacatggtgaaaccccgtctctactaaagatacaaaaattagccaggtgtggtggtgcatgcctgtaatcccagctacttggaaggctgaggcaggagaatcacttgaacccagggggcggaagttgcagtgagccaagatcacaccgctgcactccagcctggcaacagagtgagactccatctctaaaaaaagtaaataaataaaaataaaacgtaaaacatattctgatggaaacaaacaacaaaaaacaaacgggggg

SEQ ID NO: 547114 - DNA, 215 bp, Homo sapiens
gtgagtcagatgagaccatttctttctgggagtcctggcggtttaataaggctgtcatgtaaacccacgagagaaagattgtctcgtgcacacatgtagtgtcccggatcactccaggatcacccgtcttccgagacctaatgaggcatgatggagagaccaccgattatgtcctctcacacagagatacttgatcctcctacatagaccagttg

SEQ ID NO: 547115 - DNA, 836 bp, Homo sapiens
ctgcttccttacttagaccccacacaaagggtggtgggagaaggcgggggtcagatctggaggaaatgcctatgaaaactgagatctagggcttgtgcagcaagaactcagcattctacttgctgtcctgtagggacagcccaatgccttgttttgtctttggaagtccctggtgcccagccatctgcctctaaccagggttctatctctaaaggatctttcctgccatgctgatgccatatattccaacgtgatcaacctggctccccagaaggaggacgactttgctgtctacaccaacatgcccccttttcatcaccccaggaggacattgccagaccaagtggaatatgtctccattgtattccactgatgggaagctaatgagatgctcagagtgggggtcagacctggccccagctgaatcttggcataccctttgctttagatttatgtgtgtgtttaaaaaaaaaaaatacataggccaggcacggtggctcacacctgtatcccagcactttgggaggctgaggcaggcagatcaccaggtcaagagatcaagaccatcctggccaacatggtgaaaccccgtctctactaaagatacaaaaattagccaggtgtggtggtgcatgcctgtaatcccagctacttggaaggctgaggcaggagaatcacttgaacccagggggcggaagttgcagtgagccaagatcacaccgctgcactccagcctggcaacagagtgagactccatctctaaaaaaagtaaataaataaaaataaaacgtaaaacatattctgatggaaacaaacaacaaaaaacaaacgggggg

SEQ ID NO: 547116 - DNA, 241 bp, Homo sapiens
gtatccctctccgtataggtgggctggttgaagatgaaatcccactgagtgagggcaagtccagcacccgtgggtgccagtccagaactggcccatctggagaccccctgcagaatcatatgggcttggatttggcatattctccacagacagggttcaaggctgatggtacataaagcctggtacttgactttcgatcaagatcagctgccttaagtactctacattaccacaaatgatc

SEQ ID NO: 547117 - DNA, 862 bp, Homo sapiens
  misc_feature (13)..(13): n is a, c, g, or t
ttataaattatanagcgtactcatttcccctgtgtcttcctgggaatttaacttagtctcagaggcccaatgggctgagtgtggtggattttgcatttcaaagttaagccctaaacccagcaaacaaccaagtaaagatggttattaacccaactcagactgactctgagtttatccatttttctaggactatttaagaaacaactgaggcatcagaccaactttccccacaagtcctcggatctttcctgccatgctgatgccatatattccaacgtgatcaacctggctccccagaaggaggacgactttgctgtctacaccaacatgcccccttttcatcaccccaggaggacattgccagaccaagtggaatatgtctccattgtattccactgatgggaagctaatgagatgctcagagtgggggtcagacctggccccagctgaatcttggcataccctttgctttagatttatgtgtgtgtttaaaaaaaaaaaatacataggccaggcacggtggctcacacctgtatcccagcactttgggaggctgaggcaggcagatcaccaggtcaagagatcaagaccatcctggccaacatggtgaaaccccgtctctactaaagatacaaaaattagccaggtgtggtggtgcatgcctgtaatcccagctacttggaaggctgaggcaggagaatcacttgaacccagggggcggaagttgcagtgagccaagatcacaccgctgcactccagcctggcaacagagtgagactccatctctaaaaaaagtaaataaataaaaataaaacgtaaaacatattctgatggaaacaaacaacaaaaaacaaacgggggg

SEQ ID NO: 547118 - DNA, 817 bp, Homo sapiens
attttccttaaaatttagacttgcacagtaaggacttcaactgaccttcctcagactgagaactgtttccagtatatacatcaagtcactgagagaacatcaccaccctgaagccagagactaacactgcaggactcagcaggactatttaagaaacaactgaggcatcagaccaactttccccacaagtcctcggatctttcctgccatgctgatgccatatattccaacgtgatcaacctggctccccagaaggaggacgactttgctgtctacaccaacatgcccccttttcatcaccccaggaggacattgccagaccaagtggaatatgtctccattgtattccactgatgggaagctaatgagatgctcagagtgggggtcagacctggccccagctgaatcttggcataccctttgctttagatttatgtgtgtgtttaaaaaaaaaaaatacataggccaggcacggtggctcacacctgtatcccagcactttgggaggctgaggcaggcagatcaccaggtcaagagatcaagaccatcctggccaacatggtgaaaccccgtctctactaaagatacaaaaattagccaggtgtggtggtgcatgcctgtaatcccagctacttggaaggctgaggcaggagaatcacttgaacccagggggcggaagttgcagtgagccaagatcacaccgctgcactccagcctggcaacagagtgagactccatctctaaaaaaagtaaataaataaaaataaaacgtaaaacatattctgatggaaacaaacaacaaaaaacaaacgggggg

SEQ ID NO: 547119 - DNA, 148 bp, Homo sapiens
  misc_feature (83)..(83): n is a, c, g, or t
gtctctctgatggtctctgaagcaaactgcgggcgatgaggcaaacaaagtgctgagacattctgttgaagacaaatgctacncaagaaaaaatggacagagccatgaggagctgatgaatctaattcagcgaatcagaaactttttt

SEQ ID NO: 547120 - DNA, 132 bp, Homo sapiens
agatcgaaccgagctggtacccgctcacacatgcaccgtattgtaattaaagcaaatcattgtttaaaaaggcagttgcaaaaaatgtttgtggtcttttataattctcattaaaagaatatctggcaaatt

SEQ ID NO: 547121 - DNA, 149 bp, Homo sapiens
tcataccaggctaagttactctcaagtaaatcggactacatgtttcacacacatcaggttattttcttagtttttattttcgtagagattgattttcgctataatagcccaggctgttctcaaactcctggcctcaagcaatcccccag

SEQ ID NO: 547122 - DNA, 1215 bp, Homo sapiens
  misc_feature (247)..(247): n is a, c, g, or t
  misc_feature (347)..(347): n is a, c, g, or t
  misc_feature (413)..(413): n is a, c, g, or t
gatcaagctaggggggtttgctatggtgacaggttcaggcacgcgctgggcatctgaggttgatcaccgtctcaaaatgggcaagtcacgacagatggccatcgatcctctcacgtaattactccagataacatatctgcccaactcacttgcagaggagtggtctcgcaagagtatcgattgcaacaatacactgagacgaggggacgctgcagtgggggagaacgatgggtcggcatgcggtggncttggacttcgtcacgagcctagtagggatgattttgccgtgactggaatgatatgggtgcattgcctatggacttcagtatagcattgcatgactgggnagcgagggtcagatgcgagtcatcgcgaggacggcactgctctattggtgagtaagcgaacatctnccacgtaaagtctgcgggaaagaagggtatggtactcctatatgaatgctctctctgtctcctctctatcttctgtgagtctttcgactatgggggcacgtagatgtgtgcgtgtccaaattgccccctcaccataggaaatgtgggaagcgcgagacatagacgccatcaaagtgtcctgtctcgtggggcacgcaaagaacacagtgtctgagacagtgggggtcacgtaaagtctcgttccttgggagaagggacctggtctgacgcgccaaagttgcaagtacacaccacttggcattctgggccacactgttggtcacggggcccaggccaagagggcttggcaccccagtctgtttgaatccaacatattggccgaaattttcaatactctagcgagggcgacacggttgcgcgggctacttggccaccataggaggctgtacccccccaattattaaccccaaggcggggaatcctctcttacttatggaaaaagtgtctaacccaggccctggttgggcagataggctcctggtgcgggcaggggacctttcccttttacaaaaggcttggcgtgggcaagggggggggcgggccccaactagtgttcgggttccccttcgagccaaaagtctccctgggccgcaagggatcctgtcatacaaaacccagggcgtgggggtccgaaggcaataaaccggtccccaacgcctgagcctcccccaatgcggactgtggccgtggggggaccccggggaaaaattccccccgaggaacgaggcattcggagcccaag

SEQ ID NO: 547123 - DNA, 376 bp, Homo sapiens
gagctctggtaccgttgcatgttggttgtccgaacttgcatccctgtgtcatgtctggtcatccacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgactttctgaagggccccttgcaaagtaatagggcttctgcctaagcctctccctccagcccataggcagcttttttaactatcctaacaagccttgggcccaatggaaataaagctttttgatgcaaaaaaa

SEQ ID NO: 547124 - DNA, 340 bp, Homo sapiens
cccgggaaaaggtttttaaggggggttttttcccccaaaggggcccttttgccattgtattccgggggggaaaaaaatttttttttcccggttttgaacccttttaaaaatcccaagggtactttggaaggtggggggaaaaccaaattattttgccccctaaaaccaaaaaaagtaaaattttttggggccccccccctggggggagacaaaaaaaaaattttttttaaattttgtaatttgctaccttattttgggttagtaaaaatgggcccggtgtttggttttttttccaccaggaaatttggggtggcccaaaaaacaaaggcaagggggccca

SEQ ID NO: 547125 - DNA, 547 bp, Homo sapiens
caccccaagctcgtaatgatgcagtagggggacacatagaccgcacatcacaccacacttgacaaggcgtggcgcgctagagcacaccatgggagtagagaacaggcctggagacgcaagagctcgcgtttgtagtgcatgccttgcgaatcgccacctcggcggtgtcatcgccctcggcgacgggcacacgcctccatcatcatcgctgacattaccgtggtatgacatcgaactttcctatgatcgacagtagatgtggaagcttccactcagatgagagactgcggtcgcacacacctggactcgaactcgtggcacatggctagagtaggcgccggacgtctgatctggacgaggattctggtggaaaggctcactctcaagcacgactaagagccttctgagcccagcgactttctgaagggccccttgcaaagtaatagggcttctgcctaagcctctccctccagcccataggcagcttttttaactatcctaacaagccttgggcccaatggaaataaagctttttgatgcaaaaaaa

SEQ ID NO: 547126 - DNA, 455 bp, Homo sapiens
aaaattcttttaaatctgaggtggtcccaggagtttttgaccagcagtgatacggaatgaaatgtgtgcaacactgtggatttacaggtaggaacacagaggaggtggtaatttgccccatgtttcaatgttgtgtctgaattccaagagcatggagcttgcaaacagcctgttgcgggacctagatagaaggaactacgaattccgcaacacgattgctgtcgccccaccgaaaatggacctgacctggagcaattataggctttgagtaatggagcaaggacctgtgaacttgatatacccgcttggtccacagcactcgttacctactcacagaaatgagcccactgaacgagagactgatggcttacgaccgtttaagatgcaagactgaaaacatcttttagaccagtgtttaagacctccatagtttgttcgttttagttcttaagaag

SEQ ID NO: 547127 - DNA, 298 bp, Homo sapiens
ggaaccccctcccggcttggggaggccccggggctgggaaagcctgtgccttcctgggccgaagccaaagccccctttgtctttccttggccctgttgccgaccagaaaatgcccagcctgtggggggtgggccttccctccttcgctccttttttaaattagggattttaaaggggacttttcagggacttgtgtactggttatgggggggccaaaggcattagggttggggtggggaggtcccgttttccataaaaaggaaccccaaataataaaaggccccccatttgtttttta

SEQ ID NO: 547128 - DNA, 654 bp, Homo sapiens
  misc_feature (33)..(34): n is a, c, g, or t
acaacttacaggctaagtagcgaggccaggtgnntaatggagcagttcggcggtcccgcgggtctgtctcttgcttcaacagtgttgggacggaacagatccggggactctcttccagcctccgaccgccctccgatttcctctccgctgtgcaaaccttccggggacccatcttcttcggcccatcttcccgtggcatttcctgggggaaccccttggcccaaaggtccaaacccccggggttacattaactgacctaccagggggagtttcgaggggacgagtcttacacttaacacgcggcccccttatgtccccccaccagaatttctatttcgccgtttttgtgggggcccccacctaatagtaaagtgccccccccaaaaaagaaaaggtcccacccataaatatagtttggcgacaaaaacacggggggcccccccaggttattttttccccagcaccatatgctacctctagtaataagacgcgggcacacaaaaatcccttcttatgtttacccccacgggggggctctttccccccaaaaggggggtcaaaaacccacagcggttttttcatctacacaagcagtttatgaatgatcaccccagcaccgccgtagaaatatacctccacttacccccgtggggg

SEQ ID NO: 547129 - DNA, 275 bp, Homo sapiens
gggggacacttacggctaggtacgaggctgggtggttgcacacttggaggccaaggctgggatcacctgaggtcagaggttcaagaccagcctggccagtatggtgaagccatgtctctactaaaaatacaaggattggccggacattgtggtgcacgtctgtcatcccagcaaggcaggcgaatcgcttgaacccaggaagcggaggttgcagtgagccgggatcatgccattgcactccagcctggtcaacagagcgagactccgcctcattg

SEQ ID NO: 547130 - DNA, 754 bp, Homo sapiens
gggtaactgcagtaatgtcccgtgtggccctggagtccacagcggattttcgaagctggggctggcatcaggccgctggacaccacgctccgagttctgtcagactccgacttcctagtctgagacaggcgcgaggtcggcggggcagcgaggccgtggctcccaccatggccgcgaattattccagtaccactacccggagagaacatgtcacaagttaaaacctagcttccacagcacaggcgttcctggcaacggcatgagcgacacctctgggtgtgggatgtctgtggggctcaatggccattccatgcatctccttctacgctaattttcaccaatgagggccgcgcattgaagacggcaacctcattggctgaggggctctcgcttgtgcgcctcgtctcccgatcaggcactccagcagtagtgagcatccagtgagaaactgaatgggaaggctcggatgcacatcatttgggcggccattcacggacactccaacgtctctttgtctgatccaaactcatggggtccagtcttccggactgttggaatacctggcggtaggcacgctcgggacgtatgtgaccacagtggtggtacgaaatacgtggaggtagtccaggggattcaacaccggaggattggtgcccagtgtgacaccaagcgaccccgaggttatcccctagcatgtacttgagatgccctgtcaaatcctcttctacaccaacccaaaatcagcactggaaaa

SEQ ID NO: 547131 - DNA, 522 bp, Homo sapiens
tgagtaaatagtaccacgatgtgactatttcacataaagctgtccccaaaatggttattaaaccacatatttgtttgatgcactttcctacatctgtattatatttcacaataacaaagcttaggaaggaagcaaagcacgggcagcagcagggcagggagcaaggagcaggcaaggcaaagcagggagggaagcaacaggaagaaaagcaaggcaggttatccatctaatcacacctattctcattcccaggccacttttctcaggtacaacacagcatgtgaatctcagcctccatggcagcccatgcaaaaatacagcattcaggtcatcacacacataaactaaaccaactcaaatctcacattcaccaacactttgcattaactgcaaatggcaaagcaaaaatcacagagtgctctcaagagcagcaataacaatcaggaactgtcatttaaattgcaaaggcactataagaaggagtctgacggctatgaaaacatagagctgatgcccaaagat

SEQ ID NO: 547132 - DNA, 209 bp, Homo sapiens
ctggacagaagagctgtgggtatgcccataggtgtgagagaaaagtggtcagaccttcttgcggcttgagattagcagtcaagtttctctgctttcactggtcgctcgctctctcctgtcaatgcattgatgatcactccctggagttgagaggcacactgtctagagtgtgacccggagtaactcgagttgccacaatatattcaaga

SEQ ID NO: 547133 - DNA, 233 bp, Homo sapiens
tcccccctccccctttaaacaaaatttaaaaatgggttcaagggtttaaaagcctttattttccaatttaattgccaaagggggcctttaatttagttttaagcttagggggggagcaaagcccggaaactttaatttcggtactttttgcaaccccgaaacctgtaaaaccctggccagtaacaagggttggccttttcagttgacctgtaaataccaaatgctttttccca

SEQ ID NO: 547134 - DNA, 937 bp, Homo sapiens
  misc_feature (584)..(584): n is a, c, g, or t
agcgggggcggagcgtgcggctgtggtgtgtgagagatccgaatgccagcgtgatgcgcgaggtggagagctgagctcctgtcggatcggacaggggtggacccttgaagaccttcagccgggccgtatgcgaccattgatgggccctgatgtggtgactgggtctcttgctgcggtgactgctgaaccgttcggagtcggctcatgtagctgaacagatagaactattgatgatgcatgagtacatgtagaagatggatctgggtataaagtagagaaggatcaagggtagcgggatgatgaatgtatgtatgggagagaggaacgagagctattgacgttgggatggattaaatgcattgacaagagtaagaggaaccttgatgagagtaagtgcggaagaaagtaagccattccagaagccacgagagtgttaaggagcagatgatgaaacactaatcgatgcaattgcattggtattacaagagtgacagtcaggattcttccctgtagaagaaattggattgtcggatatgcattcttgagtgcatgttagtataagagatacaggcgtcacataatcnacgtagcacttgtatgggaacacatggcttctttatcctgggagacatgcgaggagaaagtaaaaccgagttcacacaatatattaagttgttgcatgtaagggcagcaaaggaaagcgttgcatgctgattgttccactaggaacaagctgggttggtaaaggggaattgggaactcaagaacgacagagagtgctgggatagaaagaaacccttttgggtgacccagtaatgcctaatagatactaggggacgaaatgcggaagttttgtattaaatcaaaaattgacttggaagtctcgagggatagattgtgcctttgaactttgtgaattcgagttgggcaagtatgg

SEQ ID NO: 547135 - DNA, 594 bp, Homo sapiens
cctacgtgaccttcagatgttatccccataggggctgtgttgagtggttcttacttccatctgagaatgcccacatcatagaggctacatgtgaacgcacctgtcagcataccttgcagtgaaagacagttaataacaccaattccattttgccctgttgagacaggcggactcagacttacagcctttaagaagtgaaagggggccaatagatatgtccccaaatatcgagtacacctctgcggcctaaactgagaaaagagagtgctgtctgtagcaccatccatagaaaaactggcctcttgtttgcacagcaaggaagcagtgaattaactaagcaagggagactgctttccagaagtctttctataagtagaaataaaaccaaacaagtacacttatccaggaagaaaaacaaaattcaagctgaacctagccgctgtctcaaggatccttcaatttttcaggttgcaaggcaactaagactgatagcagctaagccagatcagttgattaagtgtccccgtcggaaccagccagtcattgtgttaaaccaccctgatgtggactcgcctgaagtgtcaacggggtacc

SEQ ID NO: 547136 - DNA, 132 bp, Homo sapiens
atactccacggtagttgagctttgctaccagataaaccaagcccacccctcatgttgagaaactgttcaccagtcctacccacaccatgccacacagctccatgcccaccagccgcagccggctaccacgcc

SEQ ID NO: 547137 - DNA, 158 bp, Homo sapiens
cagcccggagtaattcaggtcggtttttatttacttcaaattcctccctgtacgaaaggacaaaagaaataaggcctactttacaaagggccttcccccgtaaatgatattatttcaacttagtattatacccccccccccccaagaacagggtttta

SEQ ID NO: 547138 - DNA, 259 bp, Homo sapiens
tcccccccccccccctccggtgggggggggaaaagaggaccccccccacccccccccccacccaattgtgtttatatgtggaaaatttttcaaggggccccccagctttttttagcccccgggccctcccaaagggcaaatatccccctttttttttttggaaacccgtccttggagaactaaaacttttaaccccctccttcaagtgtgtttcccgtaattgtttcccttaaaacccattaatgttcccaagggttta

SEQ ID NO: 547139 - DNA, 242 bp, Homo sapiens
  misc_feature (26)..(26): n is a, c, g, or t
ggtgttctcgagtgggaaaacccagnacaggtgatgaacttgcaaaagtttcctgcaaacagtcttgcatcgtcacccaggctacagtgcagtggtgagatcctggctcactgcaacctctgcctcccaggttcaagcaattctcctgcctcggccacccaagtagctggaactacgaggcatgcaccaccatgcccagctaatttttgattttccagtagaaatggagtctcaacatgctg

SEQ ID NO: 547140 - DNA, 406 bp, Homo sapiens
  misc_feature (78)..(78): n is a, c, g, or t
  misc_feature (191)..(191): n is a, c, g, or t
  misc_feature (198)..(198): n is a, c, g, or t
  misc_feature (221)..(221): n is a, c, g, or t
  misc_feature (270)..(270): n is a, c, g, or t
  misc_feature (301)..(301): n is a, c, g, or t
  misc_feature (337)..(337): n is a, c, g, or t
  misc_feature (385)..(385): n is a, c, g, or t
gctgttactttgaagcatggaaattcttgtttgggggatcttggggctacagtagtgggtaaacaaatgcccaccggncaagaggccattaacaaatcgtccttgcctgaggggccccagcttgctcgggcgtggcacagtggggaatccaagggtcacagtatggggagaaggtgcaccctgccactgtnacttctngctagaccaagtggttctgccangtgacctgttcagcagcagaacaaccagggccatggggaccggggaagnttcacttggagatggcccccagacaatgaanatttgtgtccaataggtcaataattcttggagactnttggacttgatatattaggaccacttttttcttcctcatcccatttgngccatgtgagggcctttccct

SEQ ID NO: 547141 - DNA, 113 bp, Homo sapiens
cgaaagataccgtctcagtagtgatggaattgaggggggagagtggtgcggaagtgtgatcctcacatcgggctccatgcaccgaggcactgagaaagctcattgaatacaaa

SEQ ID NO: 547142 - DNA, 223 bp, Homo sapiens
cagtgagacgagatcgcaccattgcactccagcctgggtgacagagtgagactctgtctcaaaaaaaaaaaaaaaaaatcgtacctctaaacattgggaaaggggctgtaaatcccaagagtgaagggatggaggggttccactttttgccaccctttaccctgctggggggcttcctttttgctcccctggactttgcaaaaagaccaggctggccggaagc

SEQ ID NO: 547143 - DNA, 407 bp, Homo sapiens
agcacagccgcgtcttgtgctgtggacaccgccaccgcctgtgtatccgccgcctctggacacggtgtatgagtaagccacaatctttaatgagtaaacatattcctcaattctgtggtgtgcttgtgcacacatttatggaggttctgaagggcagtggagattactggcaggcacagcacgaactctatgcagacaagtgaactgtagaaactgagtactggttcacacaagaagcccccatatgagagggtatgctggacacacgaatgttgaattgaaattcacagagcattttacacagagatctgacctggatggtgtcctcaatgcacattttttctgtgggcctcagaattaccggattgaagttgctgcgctcttggtaggagggtcatatcactttc

SEQ ID NO: 547144 - DNA, 1476 bp, Homo sapiens
ggagagagagagcggaccccagagagccctgagcagccccactcgcgccgccgtgctagttaccatcacaccccgtggagggagccgcagcgtgccgcaggccgggcccgagtcaccatcaccgaaaccatgagcagcgaggccgagacccagcagacgaccggcgacacacgtcccgcgcggcgacgcaactacagcgccgaacagaataccaagcgtccggcacctaccggagcagccggcagcgggggcagcggccggccctgggccgggcctcacaatcgcgagcgcgcacggccaagcaggggcaacagaccacaggtgcatccgcacacggacagccgaccccagaggaacaccagagaaacacactgccctgccccaacagccacacgagcaacacgcgcacaaacgcgcccacccaatcccacaccacgcggcacacggagaccacccatagcgcaaagagacgccagctgcacgataccaaccccaaacacccagcaccacaccacgcacaggcaagtcgcaccacccaacgagaaaacgggacccgtagcagccagagcgacgaaaaagaacacatagaaagcgaggaccataggtaaggacagcacaacacccacgcaacagcgccagccagcaggaaccgaaaacacagtagagagaagacccccccccaggaagacaaccagcaagaacagaacagacgaacacaaaggcacaaggccactggaaaaccacgaccaccaaaacaagagccccaacacaaaaaaacaaaccaacaacgcacaccacaaaaacgcaacctaatacaccgaccggataaaacccgaacacaatacacaaaaacgggagaaccacacagaacaggcaaacaaagccaaacgaacacacacacctccagcaggaacacaaccaacgaagtggaaagaaaaccgacaataagcagaggccaagaaccacacgatagaagccagagaacaacaacacgagccccacaaacaacaccaccgcccgcagaccaacgcacagcccaagagagacaacccccacaccaggccaaacacgcagccacagcaacaaacaaagaaagagacaacgacggagcaacacaccgagaagcacacaagcaaaccatgcagcgcaaaacaaaccgaaaccaaccagaaaaccaacgcggacacaaaagagcaacagaaccacaccagggcagagacaacgaccagaagcagaccaacgcgacaacccgacaacatagcaccagaaaacacagacggacaggacaaccagccgcgaagcaaaccgacaaagacaccacaccagcagaggccacgcacaccaccaccgcgaatagcgaacacaacgagacccagcgcagacaagagaagaaacagcaacaacagtcccccaccaacaacccacccacaccccaagagacgcagaacaagacaacagcacgagcccaccacacag

SEQ ID NO: 547145 - DNA, 505 bp, Homo sapiens
gccttgctttctgcctacccaagatacatgttctctcactgcattactgtgctcagacttgtgtgggagcagcagagatgtatcgacaagaggcccttgaagctacataaacagtcactctagtaacgctctgttgcactagtatagtccctggagtcagattgctatcacaaaaatggaaaacatgctgacatataaattaaatgactattatggaaatataaaaatattataaaaaagtagcataggggccgggtgcagtggttaacgcctgtaatcccagcacttagggaggttgaggcaggcagatcacctgaggttgagagttcaagaccagcctacccaaaaatggtgaaactccatctctactgaaaatacagaaaattagccgggcgtggtggcacacacctgtaaacccagctgctctggagctgaggcaggagaatcgcttgaaacctgagaggtggaggttgcagggagccgagattgtgccactgaaatcaac

SEQ ID NO: 547146 - DNA, 451 bp, Homo sapiens
ataatgatagccagggtctttgtgctccaggccaaggcgcagatgctggctgcttgctcctcatatgagacttcctggactgcctctcacagcctgatgcagcaccatgtaccctagagagaggactagtccacagtgttcccctggggcccatgcaggcccctgcctgagcctgtggtcctaggagctgggtagaaggtagagatgctgctgtcagaggtccaggctaaggacaagtggggcaggtagggcaggtaccactggccatggatggaaaggcaggcaagttccaagaccttagcaggtcaaggactgctcaggctgccttgggagcagacccgctccccagacagtcacctggcaaaggcagaatctcctcatgacgtctcagaagcttgtccgacaccagaaggcaagctccgcctatttaacatgaggccataggatcagc

SEQ ID NO: 547147 - DNA, 328 bp, Homo sapiens
  misc_feature (22)..(22): n is a, c, g, or t
  misc_feature (44)..(44): n is a, c, g, or t
  misc_feature (50)..(50): n is a, c, g, or t
  misc_feature (87)..(87): n is a, c, g, or t
  misc_feature (152)..(152): n is a, c, g, or t
  misc_feature (163)..(163): n is a, c, g, or t
  misc_feature (310)..(310): n is a, c, g, or t
tcctcagaagcccatcccgaanaccctctgtttttttctaaacngggctngaatgctgtggtgggcccctagaggtgaggtagagantgtgacacatcaggtagtgtgccacacacacacacacacacacacacacaaacacacatacacanataaactgttnaagttatctcatttatatgaacatcaatctggagaacaggcatggggatggatattaattgtatgagattatggtgtaaggaacatagagttgtatcaggctgaatttactgattaggaccatcaaggtagtgactttgtgtttaanatggcagcttggcgagtt

SEQ ID NO: 547148 - DNA, 246 bp, Homo sapiens
agggggttttttttttttaaaaaaacccccccggggggttggtttttttcccagggcctgggtttccttggggcccggggccccccccccgccttttttcccccgggggggattttttttttgggggttttttttgggaaaaagcccggggttttccggggggggttttttttgccctttttcccaaaaaagggggggggttttttggggttttttagggggcctcccccccccccccccccctta

SEQ ID NO: 547149 - DNA, 267 bp, Homo sapiens
catgactcactatagactcagcagacacacacaacgttggcatacagggacaggcgtggtggctcacaccggtaatcctaacactttgggaggcctgaggcgggatgaatcgcttgaacccgggaggcagaggttgcagtgagcagagatcacgccactacactccagcctgggcgacacagtgagatttggtctccaaacaggaaaaccttgcaacacaacctttggggcttacaggggctcatgataaactggggtagcgaaact

SEQ ID NO: 547150 - DNA, 149 bp, Homo sapiens
aaaacaggtgtacagggaaatggaacagtcaggaaatcttttaagatggcatcctcgaaatatagaagaggaagacagccattgctgttttcatcttattatttttgcttttcgcatggctggtagtttacatttacagtatcacgaac

SEQ ID NO: 547151 - DNA, 917 bp, Homo sapiens
tggagacagagttccgctctgtgtggcccaggtgggggtgcaagggcgcaatctcgattcaccaaaacctcggcctccacgggttcaaggcaattctccgggtctctacttaaaattacaaaatttaggccggggtggtggggggcgcacctttctctggtattctcaagtcttctcagggagggctggagacaggagattcggtttggaccccggggaggcacgatgtgttggcagttgacgctggagatcatggccattggaatttcccgggcctagtgtgacagaggggaaactccatctccagggaaaaaaaaaaataaaccccatttttgggggttccacatttagacttacactaatttgggagctctattgggggcctttacctctagaagaaggtttaaagcacgcgtgtgcgcggggacccccctttttagccaaaagacgaacatgccgtgtgtgtaacaacacaggtttattcgggctcgggaaaggagataacaggtcaataaacttcaaggtggaatcataggggctcattatatagcgagacggtccgtctggcacccctctgatggtatccaaacttttgggtgcggttatggacacatcgttaaacattctgagattcctttactttgggaaagagcgcttcaaccctttcttcaagggccaatatttgtcctttcgaaacaatttattctgggggtcggggggagcgtgaaacattccagaggggacgtgggggaagacccccacaattgggacagggattgtgtccccaaaattatttatgtgtgggtcggtgttcgcaaaatcggaccaactttcatgtggtcacacatgtgggtgtggtatgtgagcaaaaccgttggtgttgtgtgtgtgttgtctaagatatcgtaaaaaaatgc

SEQ ID NO: 547152 - DNA, 361 bp, Homo sapiens
  misc_feature (1)..(1): n is a, c, g, or t
ngtgggatacagcttccacatgtgttatataactcatcaacactatctctgattggcctctcctgttgtagcacagcctcttgcaactcacatcctgtaggacacaacacatacaggtctgggtcagcgtgaagacagcctacagcatcagaggctactctttctactctctattgagtggcagctgctttggctggacgagcgcgatagccacctccattgatgggcggtggggcaggcctcaggctggaagcctcttctctcttcttgtcaaggggtcgatgaccacgggcactgaagaaaccctcctcattgtcgttgacaccttggaagtgtgtgaaagctacgagaaatctcgtgc

SEQ ID NO: 547153 - DNA, 481 bp, Homo sapiens
gacgcgcacagcacgccagcgtgggggacagagcagaacccgagccccgcccccccccaagcaaaagacaaggacccagaacataatgctacgtagagcaggacaacagggcagaggtcaggaacgctagcgcccatctctagtcctatcagatagagatttcaccatactataaatacaaaacatcggaaggagcagtcgctagtcggggcagagcagcttcccaccttcacacagccacctccacaggcacagagccccagggctcatttttcctgcagtctccattggatataacacttacacccactcagctccctagctggcctcctctcagctgtgatcgcctcttccctgaagagctctctgaatttgagtaatgacatggctgtaccattcatttagtttaaacacattttttatttgggtgaaaaattgcaaacaacctataattcaaaaataacggtaggcaatcaagctg

SEQ ID NO: 547154 - DNA, 942 bp, Homo sapiens
cactgctgttgatgcctccatgctttccattcctagccctgatcccaacccagaggtccacatatgcctaggagagcgggagaagggtgtcaggaggtgcggtagcatggttgtcgcagcgcccgagcagaagcctggaaaataggctccatagcggaaggaacacagtgtgcctcaactcattccagggagaatagatggctctgactcagatcataggagtatgtggacctgacgcaggtgatgtgagccaggtggcctgccccatccaggtcaatctccatggacctggggcgttggagctggcgaaaagtgagtcagaagaggcagagcaggtcgcgggtgggaacaggggttcccagtttgcaggccatggccagtttccccagtagcacctcagacagcagcaggaacagggtgtgggctccctcttgtaaacattggtggctacaggctctcatgatctctgatgcctggggcctcagtcggagtcttccttggtagcctcttcctcttcaagtcctcctcttcttcttcctcttgggtgaggcccccggtcagagccgggcgggacggggtggcgggtcggaggcgcctccccggggtacggtggcggtcccggcggtgagggcgcgctgtccgggatcgtcgagggacggggggaggcttgggccagggcggggcggcctgggacgcaggcggggcccgtgcatgccattgtcccggaggctatggcaggccgtaccatcgtgccgcagccgtctgaggccggggggtctgccctggtacggttgtctgaagccaataccacggtagctctggtggcgcccccaggtagcagcggggaggcccctcacgggggttgcaggcggttttggccccctttctcccggttcagcacggctccgcgggggggagcaccgccatttctcgggggcccca

SEQ ID NO: 547155 - DNA, 417 bp, Homo sapiens
ggctttgaaagcaagagtgaaatgttctctggtcacaaggaatactggagtcgtgttcagggccagggggggaaatctgttccccgaggtccggtatgccttgatatcctgaatgccacagggtagcaccacaggtggtaagattatagtaggaattataatggtcatagaagtactggatggctcgagagtggaacactgcactaacactgcaataaatagaatgtgcccctttcacagaggtttccatgatgtacgttacttatggctcttaaggctgagcaggtacagaaatcctcaggacctacagaatggtgtatctcgtgtagctgaggtcatcgtccgaactttcatggaatcctgtagcctctgggattttcacctcaaggtcattgctatgcatccaggcgctcaacg

SEQ ID NO: 547156 - DNA, 562 bp, Homo sapiens
cttccccttgaagaaaaaaggtgtgtaccccaaaagcaaagtccctgggccctgggaaaagccttatcccgggcagggtttggccccatagtgggtggacaaacactggcccagttttgctggtttgctgggagcacacaaacattggcacaaacttgttggttttttggaaaagggcaagaccccaaaccaaagcaaaaaacacttccagtttttaaccaggctccttccagtcccaagtgggcagaatcagaacaaaagtagtccccatcaatgtcacatgaacaaacaagctgcccccaggggaccatttggggaggggaaattttttttttttttcccccttaaaaaaaaacacatttgccccgaacactttccccctgttattttttcctcatatcccaacactaaaaatttttgtgacattagccaggggggggttatggttgtgtgaaccatgtatgaaaatccagtgggcccccaccaaggagacaaacaaacttgggtttttttccccccacttttccccatggtctttgtgaaaaaaaaagtcccctttgga

SEQ ID NO: 547157 - DNA, 534 bp, Homo sapiens
  misc_feature (534)..(534): n is a, c, g, or t
cctttgaagaagaaaaacccttttttagggaaaagtcccccttgcccttaaagtttcctctgcatggggtttaaagaagttaagaaaagtccttttcccgggaaggaaggaggaaaatttgttcctttcaaaaacccggcctttgaagggaggtttttttgttgttgttttctataaaaattgagggaaagggttttgcaaaaaaattttttgctttgggccaaattttttaagcaaaaaaaaaaagcccagttttgcttgcatcccttgaaaagggttttttttgaagatcaaacccccccatcccgatgtataagttttaggcaaaaccccattttaaaatttccctgaataacccctgaaaggaatttttccaatcccgataaccaaagtgggcgggaaataaaagggaaaatttgggattttcccaaaaaaaaagttaaactcttcttttctttttattaaaaagcccagctttgggtttttctttgttcccaagttttttttttaaaaaaaaatggttccccttttccn

SEQ ID NO: 547158 - DNA, 778 bp, Homo sapiens
tcttgctctgtcaaccaggctagagtgcagtggcatgatcttggatcactgcaacatctgcctcccgggttcgggtgattctcctgcctcagcctcccgagtggctgggactacagtcatgtgccaccatgcctggctgattttgtatttttagtggtgacgtggtttcacaccatgttgaccaggctggtctcggagctcctgacctcaagtgatccgcccaccttggccttccagggtgctgggattacaggtgtgagccaccgtggccagccttaggggataatttaggtttttgtgtttctgttttaaatttaaatttttatttttttgaggcagtatcactctgtctctcaggctggagtgcagtggcgcgatcaactcactgcagccttgaattcctgggcacaagtgatcctcccaattcagcttctcaagtagctgggactacaggtgtgcaccaccaatgcctggctgaattttttttttaagagatggactcttgctgtgctgtccaggctcgtgtcaactcctggcctcaaatgatcctctctcctaggccttccaaagtgctgggattacagacgttagccactgtacccagcctagttcaacgtttaagcattaagaatggactctttggaggaatagggatcttttacgggatctctacagtcagtgactcttaatgtattgtttgggaccagtagtagcttagcttcacccaggagtctttcggactgctcatctggcaggggcgggctcaggccggtatccg

SEQ ID NO: 547159 - DNA, 1289 bp, Homo sapiens
tgaagaacttccctaatgccatcgatgcacaccctgcagtgggctcgggatgagttttgaatggcctcttcacgcagccagcagaaaatgtcaaacagtacctcacagaccccaagatttgtggagctgaacactgcgtgctggcagagcactcagaccctatggaggtgctggaggctgtgcagccgcagacctggtgctgcagacgaccacagacctgggactgactgcgtgacctgggacacatgacaacacacatggaacacccagtacatcgaaccaccatccggacaagcatgcatgacacacagtatcccatccatgaccagctcaacaaagcatcaaggagcgccatgtatcatggtcatggagcaccaaaacgcatgatccacacaccgcgtcaccatttgcatgtcaacaatcacccatgcactctggcactaatgatgaatggcatgactgcgcaaccatgataatgccccagcacacttacggtgcatgacaagtgcatcctcacgggaacacgagcctgcatgtggaccaccacttccctggctaggtctgttgacacagcttagcacgaacattcaagaccacacaaggtcatgggcgctccacgactccagtgcttatcatgagacagagagacttgagcggacgcgcccaccagtcgcacgtcatggtatgccgtgacacacgagacgatctaaaacgggacgccatcacaagaccaagtacgtggcccaggacgcatgcagcaagatcgtcccaatgcaaattacagagaactgtcacccactaggaccctaggaaacacggactgaactgcaccgcaccacctctcattaatgagacatctccccatcgcatgccgatgtcatccgacccctcccgcaggacgagaagcacactactcaacgaaacattactgccagcacccgggcacccctgctgcaagccgacatttacgcgccacacacccggtcccacacccaatgccctgtagcacccaagacggcggctagcccgcacacgagagtcactagagcgtgaccaggtctccaccaccacctcaccacatcactcactcaagacatggctacccccacttcacacaatatcatgacccactcacacaactcacacccatacaactaacctcatatccatctcgtccatacccactgcacacatcataccatacagaaaccacataatggacacaaacaaacaacaacatcatacatcataacacgcttcccattcctacacaaagcagcacacatcta

SEQ ID NO: 547160 - DNA, 156 bp, Homo sapiens
  misc_feature (139)..(140): n is a, c, g, or t
atgtcagccattgagctgcgggctgctctcacccctgtccagatcttccccctctttctctgcagtaggttcttcctttctactttcagcccaaatgggtttggacctaccgtggggaacggaaacttaatttacaccnnctccagttgggcaggc

SEQ ID NO: 547161 - DNA, 411 bp, Homo sapiens
  misc_feature (5)..(5): n is a, c, g, or t
  misc_feature (43)..(43): n is a, c, g, or t
  misc_feature (99)..(99): n is a, c, g, or t
  misc_feature (216)..(216): n is a, c, g, or t
  misc_feature (221)..(221): n is a, c, g, or t
  misc_feature (247)..(247): n is a, c, g, or t
  misc_feature (261)..(261): n is a, c, g, or t
  misc_feature (268)..(268): n is a, c, g, or t
  misc_feature (277)..(277): n is a, c, g, or t
  misc_feature (285)..(285): n is a, c, g, or t
  misc_feature (300)..(300): n is a, c, g, or t
  misc_feature (322)..(323): n is a, c, g, or t
  misc_feature (328)..(328): n is a, c, g, or t
  misc_feature (331)..(332): n is a, c, g, or t
  misc_feature (341)..(341): n is a, c, g, or t
  misc_feature (345)..(345): n is a, c, g, or t
  misc_feature (393)..(393): n is a, c, g, or t
tattngattcggggggggtgtgggttttttggggtgggaatgngggcagctgcttcaggacacagatttgggtccccacagtgacatgatgattgtgantggaccggaagcgggttagtgaagcaccattttctcctaagtcttattccaagctaagcaggcttaaggttacagtggaaagtgagagcacacagaggagcggacatgcagcaaggngaagnagggaaagaagagaggggtgggtganccagggagtggctnagttaangaaaagcgngcgggtgnactccacgtagtcgnacgcggtggggagctcgcggcnnttgangtnnacgtagggnttcntgtgggagacgcagtagtcggcttgttcccgggtcaggttctggtagngctcctccttggtcaggt

SEQ ID NO: 547162 - DNA, 227 bp, Homo sapiens
gtgtctagaggtcccacatgattgtcaccgctcactaaatatcaaaaataagcccggaatgatggcgcatgcctgaaatcccagctacttgggggctgaggcacgagaatcacttaaacccgagaggcagaggctgcagtgagccgacatcacaggactgcaatccagcctgggcgacagtgcgagactgtctcaaaataaatagataaataagaaagaaagggcca

SEQ ID NO: 547163 - DNA, 208 bp, Homo sapiens
agtatattaacagctttacctgataatgtacaacattcatgaggccgagaattattcacatgcgatgacagctcgctctgataacgcacatattaggctttctgtgacaggtactatccaacgtcgaacaaatgtttaactgtcggtcgctgttgattgtcagtgtgccacggtgggtgggcacatatctggccttggtgcatgttgc

SEQ ID NO: 547164 - DNA, 1072 bp, Homo sapiens
  misc_feature (217)..(217): n is a, c, g, or t
  misc_feature (563)..(564): n is a, c, g, or t
  misc_feature (597)..(597): n is a, c, g, or t
agcggacatagtggagacgtccggccttcggatcgggagtgttctgttgttgcccctccactgaatacagagaattcaaactatagggtgactgttgagcaagaggcacacgaagattcttctattcactggacacgtgtatcccacgtggccaccagacgcttgaacacacgggcaggcaacgccaccacagacctagggccacacactgctccantggcctctctttgtggcgtgaagagcaaggtcagcgcaccctggcatactgcttacgacaggccgcctacataagaaacgaacatggcactcgatcgtgcgggaagtaaggtactacacgtgaatgcgagctcagttctggatgacatcgccacatgagagttaccatcacgcatgtgaagcatgacatatggatcttatgtgatcgttgcgagttaacggaagcacagtgacagacaacggggcgagaccttcatagtagactgtcattctgcagagaaaaggcctagcgtaacttgaagtcaactacattggagcctagcatgcgcattacttgtaattagcannataacgagagagatcgtcgtcgatgaacttctntgctagtcgttgtagccgattgccgttctaatgtatgatccctcgataacacctagaagattccatgcatcacttgaatggacgtgtacgaggacatatttttcgttgggcgcaggtcgcttgagttctagaacacgtacatgaaactcggcgttagttggcttaaaactgagatatcgttacaggtcctttcggaatttttgaattagtaaacctgccaagttcacgtacaactggggtactcagctgatttacgccctttttttagagactctgtattacgaacttccggttgagataacttgtttccagaactttttcaccaaaacgatggctgcaggtgcccattcgttaaaagctttactgggagcactctggcttcgacttattatacgacttgagatataacgtgggtagtgtgaaatactatttaaaatactggcggaaaattgcgctcccctgtgctttagaacca

SEQ ID NO: 547165 - DNA, 540 bp, Homo sapiens
  misc_feature (39)..(39): n is a, c, g, or t
aatcggatgcgctggtaacgccccaaagagttgagtagntggcgtcggagtcgcccgccgatccctgccactgataggtcagtggcccgagtgcgcgcgcctgctccacggtgccgctggcagcaccggttccatcggcgctgtgcgcgcgcacgctgtagctcgacgcggcggcgggcgtcacgctcgcaccgaccaccgacagaggcaccgtcgtgttgtgtacgcctttgccggcgaacgcctgcccagggtggacgactcccaccggcgccgtgccgtcgaggtagctagtcaccaaaccgacgccaatccacgccccaccattgacctgcacctcgtaacggtcgatggccgccgcgctgcgaaatccgatggcgcccatcgagggcggactccgcagtgcgccgcgcaccgcgacgacggaaaatgtctgtcccgagccggcggatactgtcggagcgctccaggtcaactgcacgccaccggtcaacgccatggcattcaaggacgttggagcgcgcggtggacccgcggccg

SEQ ID NO: 547166 - DNA, 157 bp, Homo sapiens
tattcccaatggggttttttaaaaggggtttaaattttaaaaaaagggacaggcaaaaggtcattttaaaatttgaaggaaaaaatttgaagtccccaaaaagggtttggggttttttggttttgttagtaaaacccagttttggggggatgcccta

SEQ ID NO: 547167 - DNA, 215 bp, Homo sapiens
agttaaatcgtgaccatctgagaagcagaatctcctagcgcgacagatccttccaagtaagtgcgaagaagaggcatgaccacatggatgatatggatgatgaagatgatgatgaccatgtggagcagccaggagtacattgactcgaacgactctgatgatgtaggatgacactgatgattctcagcagtcctgatgagttgcaccattctgat

SEQ ID NO: 547168 - DNA, 141 bp, Homo sapiens
aacctcaaagcctcttttccaccctaagaggtataattcagtcaaacttccccttccctgacacacctcgattttccatcttgctaaattgataagtttacaaccagtactaatgatataaaaactaacactaaacaccca

SEQ ID NO: 547169 - DNA, 630 bp, Homo sapiens
ggctactctgtctcttttctccacagcattttccactttaacggcatatttcttctttactcgtttagtattcttctcaatttcctgtctgtagtacctagcaatgtaaaatcctgtacatacgagtgtaactatttggcgagtgaatggtctatgcaatttagggcttgttggaaccctcaataacatcacctctttcccaacaaggctatctcttccacctaaactttagattttcccttacagtccaattaccatatatgtgtatcttctcattaccctgtatgtagatcctcagctcaatggtgtattcgaggatccaggctctgtccccttcccctttgccatcctcagtaattagctgcattcatatgcttgtcttttcaatgacccaaggagattgccatagttccaggagtcacttaaagacaaaataacattttgctaaagagagcgagatttcctcccataatctactttacatcagggaagtaaaccattccctctgggaggactctcagcagtcttccctttactgtgtcaaatgccccattttttaactgcaagggaggctgggaaagcaagccgctggtgtgagcagcctctgcaatgggatgcagaaagtgtggt

SEQ ID NO: 547170 - DNA, 118 bp, Homo sapiens
ctcctgctccacgatgcgggactccagctgctccacggactccggctcgcgattctgcgcggtggcgctcatcatctagcctcttcatcaggctgtacttgtgcagggcccgctaaaa

SEQ ID NO: 547171 - DNA, 673 bp, Homo sapiens
ctagagtactattttactgtgcttttagggccaggagaggggtactctccgacctaacagtaaagagactgtctcataagatgctcttgcttcacaacaattcctgactaattctaataacgacgatgtgcattatatcaggagcctatattaggaaagagtttattagattcacatcaggcatcatctggactgtatggaactaaaagtatggtgccgaaattgttaagcgaagattacgcagggcttggacatcaagactgaggttttaatacctggataattttctcgcacatgtccaagagatgccacatacggggggattccttgggctgacaggatattgcgacttcttttctgtgttgaaggatacgatgctcgctttcacggcttctactagagggacccgtgatatgctcgcggcgtaagctcctacccagtttagaaaagagccaccagatgataggcgtacggatcaacttagaagcccctgaggcaaccctgccgtgggcccctcagaactttacaccgccccgttaatgaactcgtcaagctttgccttgttgaggcagccttgcaactcttttcttcctagacatgcccggtaaagcgcgtcattacaaaacaaattttctagcttttatattcagggcaacggtggtaatttttatgt

SEQ ID NO: 547172 - DNA, 328 bp, Homo sapiens
  misc_feature (8)..(8): n is a, c, g, or t
tgtgggtnaattgaaatgcctactcccccatattgatcaagtttaagaaagttggctgggcatggtggttccatgccctgtaatccccagtacttctggaggcccaagatgaaaggactgcttgaacctaggagtttgagactagtctgggcaacatggcaaaaccctccctctagtttaaaaaaaaacaaattagccagacatggtgtcatgcacctgtagtcccagctacattggaggctggggcaggagaattacttgatcccaggaagtagaggctgcagtgagctgtgatcacaaccactgcgctccagactgggtgacagag

SEQ ID NO: 547173 - DNA, 86 bp, Homo sapiens
  misc_feature (33)..(33): n is a, c, g, or t
  misc_feature (74)..(74): n is a, c, g, or t
tgcagagctctgagcactcgcttcggtcggggngtctccctcctgttgctttcctaaccctgccctccggggtntaataaagtctt

SEQ ID NO: 547174 - DNA, 1009 bp, Homo sapiens
cgcgcttcggccggcgccttttcccaggactcgccaacccctcgcacccccgcgctcccaggtccccgcgtcccggcgccgccggccctggagctgcccggaagtctcggttccgccgccgggctcgccagggaagccctggggccgccgggacctcggcccgttcctccgtgacccgagaagcctgcacgcacgggctgtcacctccgagatgctgctagctgccgctcgccggtcaccgccaccctcgggtcctccttctccgtgtagagtccatgagacccatcagcacccacctatgatggaacccgcgaatgtatcgacacatgaccgtgcctaaaggatctctgatctccatgatacatacacaacgctcgtcccaaatggtaccacccacgcaacgccaggatggaaagcagccatcaacgcaagcgcgcacctgcgaatccacatacactcagtacacccaaacacccctcctactcactaccatgaaacagaaaccactacaacactaacaacacgaattacaactcaccatctgcttgcgaccaccgcaactgcacacctacacgagcccccacaaacgccaacaaacaagacaactaggccgccatgccacacaaaatccaccccacacacccatatccgcactacacaaacaccctagacccccgacacccaagtacgccttcccacgcgcaaccacccatctaaccaccacacccaacaactccagacaaccctcaccagataccccaacaatacaaggacttatagaagaccacccgccccccactcacccactacgcacagcaaaacgccgcaacaaaccaacgtcaccacgcacgaccccactcaaacaacccacacaaagacacaccagcgagtggagaagaccaatcgataacacgaccaaccagacgaccatatacagacacatacaaaacacgaccagccaccacagcagcaaaacacttgccgacgggtccccgctaccaagccagca

SEQ ID NO: 547175 - DNA, 179 bp, Homo sapiens
  misc_feature (46)..(46): n is a, c, g, or t
  misc_feature (79)..(79): n is a, c, g, or t
gagaacctcatccacgtaggtgccacagacaatgtggtgatttgtnacagcaatggagtagacgctgccaccagacgtntgcaggacgtgggatgcagtcaagggttcggatgtcccagatcttgattgtttggtaggagccgctgtacaggtagctctggggcagccaccagggcccg

SEQ ID NO: 547176 - DNA, 1212 bp, Homo sapiens
gtttgtacaagtcagcaagctctatgtgagtctcaggaagtgaattaaatttggaccttagtgttttactcttgtatttattttattttctttttgaatgttacttaatgactctctcctgactcaggagaaaaaccccttgttggaaggacagctgtggtgactcaggcaatttcctcggggttcccaaagcaatgactttggaaccacagtattctcgaaccagctctagtttccacaataatatcttcacatatactacgcaatgtacacatatccagctatcacaggtatacacaacgcctcctaaattcatcataatacccactctctgcgctcaaagcgtcatctggctctacaaaattcaataatgtcctctaaaacttatatcctcgcggctacaatcaaccttccctccttccacacctctcttacacatcaaccacacgtgctccacccgatatcacacctttgcggcatcattataaaacggcgctttttcaatattaagccccaaaagcacacagcaaaatcattcaccagcgcccatatacaccaaccacacacaatctcacccgtggctgtgcgcatgatcaacatcaactcgcttcaccactctcagctcccccaatcaccaatcgcacctcatccagccacaaccattacttacagatactatagcaccaatctccaccacccaccactcaccacaacaatcaccacaacaccctcagcggtgaacagcacaaggacgacatacaacacacacgtgcccatgcgcgaatacacacaccggtgccacacaccggcgccatcccacgagcagccacatcacacccggccacggccacacggggaactagccaccacagcttcgactcaacacacgacgacacaccagaaacgcgaaatctaccaaccgacaccaccgcccaacaaccgcgagtctaaccccccgacacacaacactcacacccacaagcggacacaccgacatcagcgatcacacagtgggaacaatcagcaaagccaacatcccacaccagcagcaggcgaaagcataccacgcattcgaggggcaacgatcacaattcaaagaagcacaatgcacagggccagcaacacccaatggtacaccgcgcaccacacagacacagcagcacaacaggtcaccccacgagcaagtcaaccgtgcgcccgcacacatcacga

SEQ ID NO: 547177 - DNA, 148 bp, Homo sapiens
tttagaggatcccgggtcccatgcatgttgtggaagatggctggattcaggtagatggatggatgttgagttgggccttggggaggttggaggaggtggggaggaatggggtgggttggaggttggatgaggggagagaggggtatcc

SEQ ID NO: 547178 - DNA, 415 bp, Homo sapiens
  misc_feature (27)..(27): n is a, c, g, or t
  misc_feature (109)..(109): n is a, c, g, or t
  misc_feature (112)..(112): n is a, c, g, or t
  misc_feature (231)..(231): n is a, c, g, or t
  misc_feature (268)..(268): n is a, c, g, or t
  misc_feature (301)..(301): n is a, c, g, or t
  misc_feature (310)..(310): n is a, c, g, or t
  misc_feature (361)..(361): n is a, c, g, or t
  misc_feature (398)..(398): n is a, c, g, or t
ggcaggcaagagtgctggagggcggcnaggcgaccggagcggtaggagcagcaatttatccgtgtgcagccccaaactggaaagaagatgctaattaaagtgaagacgngancggaaaggagattgagattgacattgaacctacagacaaggtggagcgatcaaggagcgtgtggaggaggagggaatccccccacaacagcagaggcttcatctacagtggcaagcagntgaatgatgagaagacagcagctgattaccagatttnggtggttcagtcttcactggtgttggctctganagaagagtngtcttaggcatgatggacctccatttgactcttacctgtcgctcatgagcntctatatctctcatctctgggacaccatagccatggncccttccctggatgcct

SEQ ID NO: 547179 - DNA, 151 bp, Homo sapiens
ggatttcagtatcccgagtctgccatgtatccagatagaccatgtacacgaggtagtactcagccgctatatccaaggttgacaaagaaaaagaaggagacggttctcgcaactgttacaaaatcagttggtggtgacatgaacggcggta

SEQ ID NO: 547180 - DNA, 189 bp, Homo sapiens
  misc_feature (27)..(27): n is a, c, g, or t
ggcaggcaagagtgctggagggcggcnaggcgaccggagcggtaggagcagcaatttatccgtgtgcagccccaaactggaaagaagatgctaattaaaggtgagggaaccaaagcggggaggttttttccagtcagtactccctttcttaggcctggcattcctggacagcctacttcttggctaggc

SEQ ID NO: 547181 - DNA, 103 bp, Homo sapiens
cgtcagagtactctcgagcctgtctttcccactcaccttcttcagaccacaaactcattctcagcagctgtgcggcggttaatttcatctccgctacctacag

SEQ ID NO: 547182 - DNA, 123 bp, Homo sapiens
  misc_feature (14)..(14): n is a, c, g, or t
gggggggggggggnccccccccccccccccccacccccccccccgggtttttttttgggggccccccgggggtggggcccccttaaaaagatttctttttttttggggcccccccccggggga

SEQ ID NO: 547183 - DNA, 109 bp, Homo sapiens
tgtactttttatgcttttttgactttttaatgggaattttatcagtaggatctgtttgtacaaatacgcatttactttttctggagccctttttcaagtctggcttata

SEQ ID NO: 547184 - DNA, 1605 bp, Homo sapiens
  misc_feature (382)..(382): n is a, c, g, or t
gtcgcaacagacactgccagcatgcaacgagctgccgggtggccgaagaagctctcacgcgctgccaacgaagtgtcgttcgctcccgacgctgagacgcaactgctactcagggctggccgggtgttgcgagcctgctggacggaagcgcggatgtagtcacgacaggcgtacgaccagccaaagtatgacaggggtagccccatcctctgtgctcaacgtacccagtgactctctgcggcctcgaagtcttatgagtacgcaacttaagtgtcgcagagtatccaatggccgtcgctgggacgaagcagctggagttctcccctcgctcaatgaggtcgcgcatggacgagtggcgtgatatctcactaggacgtctcgncccagcaatgctcgtagctttgccctcgctcaagtcacacctgaatggagcgattggtggtgctcgcgctcgctgggaagccgctggcttggctcctacgaccaagcggggctaaagccgaggcaaggggcccatcgcttcgcctcgtcgttctccaccgcaacacgcaatctgaccacggctcacagagagtcgatgccagagggctcgacatggaacgcgagaagcccaaggcaaaggaatggtctcattaggtgtgcaaaggactagggtcgatgccacgtgtgacctcgcaaccgtggaggtttgacctcccttagagctggcccgagggaggcccatcggagcgcgttgctcccgtggaagttgaacatcggcgagcaaccgtcgttgagggccacgaggaggcagtgttccggaggggattaaaagcaccagcctgaaaacggcgtgggacgggcgtgacgtggaagtccgcttgtatgcccgcgtgcattggaggcgaaggggggacttggaagttaatcccccaggttacacactgttgtcccctagtatccactcccgaggagcctccaacgaatatattgggcgcccccaagggtccccccaaacggggtgctacaatttacccgaagtcccaatgaaagtgcgcccaacagtgtaaacacgccggaacttttcaatgaaggcttgccgtgcaaacaagcttggggaggccccttgagagaaccgccctttacccaggtcccacttcttggacaaacacaaagaccccttcaattaaggagtagtccccgcattgcgtaaccttccggacaaccagggttttgtccccccacagatgacacccttccttgatcgagagaccaaggttccccatccggagagggaggaggccttggtagggcaaggcgacttgggttggcgcgccaatacgggggtggaacacgactggcccccttagagagccttttggcgactttgcaagttggatgggcagtccaggaggggccacaagagatgtaggagcaggttccccctgtggctagccaggttagacacaatctcctggcggctactaaacattcacggcgaccttttcaagcacttcagccagcggcactatggtggccccagagaccggggattcgggaaggcgtacattagaagagtcctccagagtgggagccagagaaaggcttcgttccctatgagaggca

SEQ ID NO: 547185 - DNA, 363 bp, Homo sapiens
gtcaggagtttgagactatcctggccaacatggtgaaaccctgtctctactaaaaatacaaaaattagccagatgtggtggtgggtacctgtaatcccagctactcgggaggctgagacaggagaatcacttgaacctgggaggcggaggttgcagtgagctgagatcacgtcattgcactccagcctgggtgactacagtgagactccctctcaaaaaaaaaaaaaaaatttttgagtttgttaaaattgttctaggggaaaggggcattcaaatttcaaaaaaatttgagggggatgttaatacctcccttttgtggaacacttttgtcccacccggggggactacagggaaactcctttt

SEQ ID NO: 547186 - DNA, 362 bp, Homo sapiens
  misc_feature (20)..(20): n is a, c, g, or t
  misc_feature (26)..(26): n is a, c, g, or t
  misc_feature (29)..(29): n is a, c, g, or t
  misc_feature (46)..(46): n is a, c, g, or t
tttttaggttccaaacatgnattggnagnatttcctgcctcttggnaaacaggagaggaatggcagcagaaaccgcagctctgcgggtctactttcagtgacacagatcctgaattccagcaaaagagctattgccaaccagtttgaagaccgcccccccgcctctccccaaggggaactgaatcacgtgaaaagcagtttcttcatctcaccatcctgtattcttcaaccagtgatcccccacctcggtcactccaactcccttaaaatacctagacctaaacggctcagacaggcagatttgaggtctccccctgtctccttattcggcagccttatgattaaacttccttctctgctgc

SEQ ID NO: 547187 - DNA, 758 bp, Homo sapiens
cctaacggctaggtacgaggctgggtggtgaatctccttattggttgcgtgcaagaacgctgagctggatgacgcctgtcagctacaagcaggttattcacgaaaaccattaatacgctgaatgatactggctcaatggaagcggctctgctttctgactgagctgcacgttaacggccgtacacaactactggaaagtgcgtcgaggctgtcgcagacggccaaatagagacgctcctacaggtttcgatcagctgaacaacgaacgaaggagcgcaaccggcgtcgctccgcctgccgtaagcatggctggtccaaccgtgccgacccgaccgttgcaactggaccagtcggctgagccgcgcgatccagcacggtctggcgattgccgccgggcattaagagcagcaagaagatctcggacaactatgccgccggaatagtctgtaacgccggcttaccgtcgcttcacaagcgcgccagctggctgacaggctacagccaagaatgtcatcacccgcgttatcggcgaacagcagatcagcgagctggggatgcattcctatctggcggtcggtcacggttcgcaaaaacgaatcgctgatgtcggtgatagacgtacgaaggccaacgcgtcgcgaagatgcaccgcccaaatcgctgctggtgcgctcaagcgttcaccttcgactccggcgaatctcgatccagcctccacaacgctgcgtctcaatgacgccgatatgtcccgccgcccc

SEQ ID NO: 547188 - DNA, 346 bp, Homo sapiens
ggggggggggggggccccccttttccccccaaaggcccaaggggggaattaaaattttcccccaacccccccccccccccttttttacgggggggggggaggggttcccaacattttttttcccttggccccttttgttttggggggaaaaaggggggttttaaacccccgccccgggcaccccccccaagggaagggggaattttttggggcccccctgggttttttttttgggggggggcggttttaggtttttgtttttttaacccggccttttttttggggccccccccccccccaatttttcccccgatttttggcccccccttaaaaggttttttgggga

SEQ ID NO: 547189 - DNA, 568 bp, Homo sapiens
cgaggggggagaataacgtcggtgtcgggtcagctgtgctctgcagtagtctgcctgcagcgtgctgattggagcggtggggacgaggctggtggtgtgtggcagtatgtgggtgatgcagtgtgctggcacaagagcagtggcttgggggagccggcagcagcagtaacagcagcagcagccgccgcagccgcctgccagtaaactgcggaccgtaccccaggggactacccagcctggccggtcctggaaagccgcagctcgggtcccgccgcagtcggcggtgggggatgggcaggcagtggctggtcccgccgtgccgagggttaacccccgcacggtcccaggtcctgagctggaccatgagccctcctccagaaaccacctgcgatcgccactgggccaggtagtgacacaaccagagagcgaatatgagcaaacaaaagaacaacacagaaaagaaaaagcgagaagagaacaacaacgaaagacgagaacagacagcaaagaaacaagagacaagaagaaaaaaaaaacaagaaaccgagaaacgaaagaaaacacgcaa

SEQ ID NO: 547190 - DNA, 899 bp, Homo sapiens
  misc_feature (567)..(567): n is a, c, g, or t
tcgccgggacggaggggtgaagaggagcggaggcagggggatgtggagaacacgggtaggggccgggggcgcgatggggggtggacaccgccggtaggatccgcggcgccgttgtggtggagaccgcgcgggggccagacaacagaggagggtgtgaggacgaacggcgcggtgggggcccaagcaaagggggggtgcgtggagaggaggtcggcgcgaggaggaatgaggggggcgccacaaggggggggcgaggagcacaccgcggcggaatggtcgccgcgcgcttctagacttgcgtggagaggggcgcggaggcgccgacgcgaggacgagacgctgggtgggggaagcccgcggggagggagaggtgtggcgtcggcgcgcgggggccgagcagagaggggggaggagaggccgcgctggggcgcacggagagaagaggggagggagggaatgagaagtgcggtgcgccgcgcgacggcgggcaggtgccttgggggacgccaacgtgcggcgtctgacggggtgagagagagcagcacacgccggggccgacaggcgctnggagagaaagagagacaacggggcgggagacgcgcgcaggcgtggcaaggcgctgcggcagaggagtgtctttgtatggttgtcagggtgcttctgtctttgaggagagcacgaggttgtcggtctagtcttggccatcgggtgaggcgaggcacgaggtgcggccattgtatcgctgggctacggcgcacgcttggcccgtgccccggaggagatggcgggcgttcccacaggcgaggctgcagggcgttccacgaggcgcccagctggtgtgcccccgggccaccccccaccgccgggcgcgcgggcgcaagccccctcccccaaataaa

SEQ ID NO: 547191 - DNA, 406 bp, Homo sapiens
  misc_feature (58)..(58): n is a, c, g, or t
  misc_feature (70)..(71): n is a, c, g, or t
  misc_feature (81)..(81): n is a, c, g, or t
  misc_feature (137)..(137): n is a, c, g, or t
  misc_feature (147)..(148): n is a, c, g, or t
  misc_feature (168)..(168): n is a, c, g, or t
  misc_feature (175)..(175): n is a, c, g, or t
  misc_feature (178)..(178): n is a, c, g, or t
  misc_feature (217)..(217): n is a, c, g, or t
  misc_feature (220)..(221): n is a, c, g, or t
  misc_feature (225)..(225): n is a, c, g, or t
  misc_feature (243)..(243): n is a, c, g, or t
  misc_feature (265)..(265): n is a, c, g, or t
  misc_feature (271)..(271): n is a, c, g, or t
  misc_feature (276)..(277): n is a, c, g, or t
  misc_feature (287)..(287): n is a, c, g, or t
  misc_feature (298)..(298): n is a, c, g, or t
  misc_feature (300)..(300): n is a, c, g, or t
  misc_feature (306)..(306): n is a, c, g, or t
  misc_feature (343)..(343): n is a, c, g, or t
  misc_feature (359)..(359): n is a, c, g, or t
cccccccagcaccacttctacccaagagccccttgccagggagcccttggctgaagcntggacggctgtnnctgaggtganccgcgagggctctaggagaaacggtggtccaggtctctctggggggtgaggagagnatgagtaggnnttgcccaataccaaggggtnccggagnagnttgaagaaggcatagtagttgctgaagaggatgagggcnagnnaganggtctggtgccacttttnagaggacattagggagtaaagntgaaanaaaannaaaaaaaaanaaaaaaaaaanangatgtngaggataagaagggtttgctgaaaaagaaatggaagnggaagtgggagaagtnagaggggatagccacgttgtagtggcctaaggctttgtagaggttct

SEQ ID NO: 547192 - DNA, 1512 bp, Homo sapiens
taaaaaagttaaacaaagacaaaaataaaaagtgaatccacaaatttaaccagaagccatacttctgcacatttccagtttgggctttcatttaccatggactatccaaatactcgggctactaccacagtggattacaacccagaaagagtgtactttaatgtggttaggtgctcgtgataaagaagaggagttaaaaagtggtgtatttaaaaccacagcgagatggagacgtgagagtgcttttcatataggtacgcgtgagggtgttaccataattcatattgtcaaaataacatagcgtccaagtcacccagagcccacgtgaactccactacaaaggccaaacaacacaaaaacatcaacagagcacacgtgcacagcacacttaaatcacaacaccgtggtaggcccaaaaacaaaactaagacaatgggtacccctcgtgaggcctcaaatagacagggctagtataaaatctccacgcgggggcccgaaaacacacacccgggggtgggcccaaaacggtaaaacctacactgaaaacatgagtggacactccagcgaacacaaagccgccaagaaaacagccaccgctatagaagaaacaccaagctgttacccccggtatactacccaaacaacaccagactattcagtgcgcacaacgaattggcaccattacaacacaacccgcacccccatccaacacccgtggggacaaccccgaaggggacaactaagtagtacaagcgccaaactaacaaccaaccgggcaccaggcggcctaaacaagaacgggcacaccaaactggcacaaacacactcccccgttaaaaacaagcagagacacgccgtgagtgggctaccgtagagcggttgactccccaggatgaccatcacaaaatccgagaacccaaacttacccacacgagaaacggaaatcaacaggggagtacatagagacaacggccataacaaaaacaagtgtggtggcacacacaagtacgccatagacgcagccaaagcgacccaacgatagcaaccaccataactatacaccataataacccagacgataacaggagtgacaaagcaacaaatgtgccagcgaccgcacgtactactaacgtgggaccaagaacaacgcggtctagtcgccgaacacccagcgcgcaaccaccaacagagcagcgtggttaacgagacaacatagacgggcacagaactgtggcgcaccagacgcaccgcaggtaacagccaacacataccaacggcaggatgaaaacaccacacgagcgtgccccaacacaatggggaacaaacacagcaaccgacggcacagtggaagtacaacaacgtcgcgaagtgcgcacagcagaagcaacctagtaaccagacgagacagaagagtcggcccgatcagaacaagttggcagaacccaccatgggtggttgatcgacacatcggcagtaactgtagtgagacgcagagcgaccagaaggagatag

SEQ ID NO: 547193 - DNA, 139 bp, Homo sapiens
atattggagccttattgtgaagaattggtctctgtggtgtgatactccttcccaggatgtatcatttctcctcccctagtgtccttaagtgctcctccacaggaaacatctatttgggctttgatgtttaataaagtag

SEQ ID NO: 547194 - DNA, 297 bp, Homo sapiens
gctccaattgcactcgctttttacgcagagagactaacttggcattcttgtccagacgatgaagctcaataattgttcacattgttctcttatacatctctccatatacatacaaaaattgggtctcagatcttgactccgtcgtgtgacaaaatactcacatcgcaccgcaaatcaactttgatatgcttgtctgaaccctagcgttggcagagttcgtctgggggtttttcgcatccctagccactggttacttcgaacaaataaataaaagctttctgtagttgcaaaaaaaac

SEQ ID NO: 547195 - DNA, 807 bp, Homo sapiens
  misc_feature (643)..(644): n is a, c, g, or t
  misc_feature (705)..(705): n is a, c, g, or t
  misc_feature (713)..(713): n is a, c, g, or t
  misc_feature (752)..(752): n is a, c, g, or t
  misc_feature (759)..(759): n is a, c, g, or t
  misc_feature (773)..(773): n is a, c, g, or t
  misc_feature (776)..(776): n is a, c, g, or t
gtaaccatgtacacaatggaaaatatttctgtgacttggccgacctgttctttgcaggaacagagaccaccagcacaactctgagatatgggctcctgattctcatgaaatacccagaaattgaagagaaacttcatgaagaaattgacagggttattgggccaagccgtgcccctgcagtccgagacaggatgaatatgccctacatggacgctgtagtgcatgagattcagagattcatcaacctcgtcccttccaacctgccccacgaagcaacccgagacaccgtgttccgaggatatgtcatccccaagggtacagttgtaattccaactctggactcccttttatttgacaactatgagtttccagatccagagacatttaaacctgagcattttctgaatgaaaatgggaagttcaagtacagtgactatttcaaggcgttttctgcaggaaagcgcgtgtgtgttggagaaggcctggcccgcatggaactgtttctgctttgtctgctattctgcagcattttaatctgaagtctctggttgaccctaaggatatcgacctcagccctgttacaattggcttggcagtatcccacgcgaatttaaactctgtgtcattcctcgttcatgagacnngtgccatcattatcccttacaaactgactgtttaaaaaaactgccaagcgggctgtgaganggctcagngggtaagagcacccgatgctctccgagtcggagtcaatnccagcancacatgggggtcanacnatctgtatcgagaatcgacttgctctgaagt

SEQ ID NO: 547196 - DNA, 311 bp, Homo sapiens
gtcgacgtcgtttcgaccaaaggcggcgtaggcaaaactaccatcgaggccaacctcggcgctttttgtgcggatgcaggcctgcgcgtgctcatgatcgacctagatcctgcacagccttcgctctcctcgtattaccaattggtcgatgaagctcaaggaggcatctacgacctgctggcattcaatatcaccgaatcagccaagatcatatccagcaccacgataccaaacctgtcgcttgtcatttccaacgacatcaacaaccaactgaacagcctgatcctgcaagcacctgacggacggttgcg

SEQ ID NO: 547197 - DNA, 652 bp, Homo sapiens
gattggagaagagggtaagagtgatcttattgaattgcattttgtctaccaatttagtgcccacattttccccagacatatgtgaggccctcatgttcctggcacagaggatgagtcacgtttttcggtcttgtgcctttgtctgtgcctttagagaggaccagtcctttgtgaaataaaccaaactgctctggtaatgttcgaaagtctgtaatgccaaatgtatttgactgtcaaattcaatcaggaagggaacgatgatacagaagaaagatctcgtgtttcaagttaattgtttaaagcatgttgtgtttcgtggaatagccatcgttagacaacgatataaatcctttacctagtatcatgcttccgcataccttttcctttcattctgcgttacgtacaatacttaccttgaaagttagcgagtgaacactcccagtcaccatgcatagtggaaagcttcaagaaataagaataataataaaaaagttaaatattataagtgataacttgtgcgtgcacactgggctcagtcctgtaatccagcactttgggaggccaaggcgggcggatcactcgaggtcagagttcagatcagcatggcaagatggtgaaaccctgtctctactaaaactagaaaaattagtgg

SEQ ID NO: 547198 - DNA, 210 bp, Homo sapiens
  misc_feature (69)..(69): n is a, c, g, or t
  misc_feature (82)..(83): n is a, c, g, or t
  misc_feature (85)..(85): n is a, c, g, or t
  misc_feature (88)..(89): n is a, c, g, or t
  misc_feature (97)..(97): n is a, c, g, or t
  misc_feature (112)..(113): n is a, c, g, or t
  misc_feature (141)..(141): n is a, c, g, or t
  misc_feature (145)..(146): n is a, c, g, or t
gcacagcctcccttccttctttctccctccgcctcccgagcaccagcgcgctctgagctgcccccaggngtccctcccccgnncnagnnagcccatntggagggaggaagtnngggaagaggagaggaaggggagccggancganntacccagacagagccgggtgcacatgggtcttgtaggtgtgaccacgcagatcaacacggctgt

SEQ ID NO: 547199 - DNA, 401 bp, Homo sapiens
  misc_feature (93)..(93): n is a, c, g, or t
  misc_feature (262)..(262): n is a, c, g, or t
agtagttaaagactaagtgaattgataccatggaaagtactatgggcccaggaacaaactaatactgtctattattattactaatctgtttcnaggtgaccagtgtgtgaaaatgtatttttcactgacataactcttctatgacattttaagttatgtagtgcatgttcataccagtatattaccactggggcatggtggctcacatctgtaatcccagcactttgggagggcaaggtgggcaaattgcaaaaattagccnaggcatgctgacatgcctctagtcccagcttttatggaagcagaggtgggagaatcacttgagcccatgaggttgaggctgcggtgagccgagatcgtgccactgcaatccagcctggacaacaatgagaccctgtctc

SEQ ID NO: 547200 - DNA, 261 bp, Homo sapiens
actctgaacactgggaaggtcatgggatttggattatctaggccatcttaggggctttagctcttatgtgcagaagagatgggagccatggagggctttgagcaaaggagtgggagagctggcatacatttcaaaaggattgctgtggctgctcggtacaaaatcggtaagtgacagtagcagtactaataactgtttttttttttttaattgttgttgttgttttgaggtagggtcttactctgtcacccaggcttagag

SEQ ID NO: 547201 - DNA, 376 bp, Homo sapiens
tgaggtccgggacgcgggcggatgggcagctgggtgctgttggccacgaggattcctctcattcggtggaaggttccattcggtagataattcgggatgggcccggtcattccccggggcgacacctcgtcgatcagcctagtcgagggatgtcaagtgcgttgcggcgcggtcgtaatgagtcgccagtatggtgagtttgtgggctctacaacgtcggcacagcacagcgcaccgttaggccgtgcgagtcatcccaagcttcggttggttctcgacgtcgttgttgctgcggccggggttgccttgctggtgtggggaattatggtgatggcctcgcccacagtctcttgtcgaggttcgcagacattcttga

SEQ ID NO: 547202 - DNA, 1534 bp, Homo sapiens
  misc_feature (328)..(328): n is a, c, g, or t
  misc_feature (651)..(651): n is a, c, g, or t
cggacgcgtgggtcgacccacgcgtgcgaccacgcgtccgaatttgaatcaacacaatcgacccgacaggcctaattattagcatcatcgcctctactatatttgttaacccaaatcaacaacgacgctatgtagctgtgtccccaagtcttttcctccgaccccctaagaaccgcccctcctagatagtgaactgacctggactcgctaccgcctcagaatcatgggcgagccgagcggccatcgttagtccaagatgacatccaccgtattcagcgaaaagaagatactcatacgcttgcgtcgtagtaccttaactctcctcttnctagaaattcatcgccttagagttagtacacaatttcgagcagacgcaacgacgtaaacttaaatcgagtatttatatgattctatgctatgcgcatatacgcagcatctttataccacctaagcctgtgaggcgtgatgcatcaaccccgaaatgcaggggctacactcgaggcgcagaaagaccgcacttgatacaacggcgaggggcgaccataaccgtgtgcccgtgatattcctaaacgaaacgcctaatttgagggccgtcccccctgtcgcacacctgaacggtccgaatcggccacgtggacattgtttgagganctgttcgaactaaacaaacccctgttaggggccgttcgacgtaaaacaccagtgtcctaactataagcgtccagcttctgtcgaacctgacgcgcagagaaaagcttgaatcgagaaagcgtcccttgtgaggcccaaacaatacattgtaattaatggaaccttaaggacttgtgaaccatcgagaattaagactgtaggtcatcacggctacacaagcattagcccttcctggttaacggggatcttcaccaatttttaatagaggcttccacccttaagaagccccaaggggtccggaacggcgcccccaatcggcgggggggttccgaatcagatacacgttgggcacggcaagtcacatcctttgaaaagaccctaagggcggggtcatgggctattaacttacggcctcgaaacaccttccattccttcaagcccccttggacaaagagagcattagtggcttacccccttttcatggtagctattccccttatgagagggattacattataacaaaggctccatgtctgggccttacggatcaactgggcctatagaagtccggctacaatggaacaaacattgaaacagcaggaccaataatgcctgcggagaacaggagcaatctgaatgtcaagaacgccgtatagttaccggggaggcacattcgaataataggcacggggaaattcccagtaaatagtggcatacacgcagataagaagcgccagcagggtagtaaccccagcaggacaactcccaccagacgggggactaagcgcacccaaccagcaacatgaagacagcgatggacacggcaataacacaaacaaggagcatcaacgcggcagaccctaccccacgccaacacaacgag

SEQ ID NO: 547203 - DNA, 504 bp, Homo sapiens
attgcttatacacaaaacgatggctcatttatacatgatatgctttgaaatgaagcacgtgacttagtatgcacagaacagttcagataatatctaccatcctagcctgaatccttctacaggtgcagactaaatgatgtcattatgcatcccgaactacacggaggttatattcatttccaacacaggcgacctctgcaatgtaaaaatagagatgcgttttaactaaatggaaagaatggtttgctttggatgaaatgtaccatccgacacgctcttgagcttattaaaatcactgtggttagagctctctctttacaaggatgatggctgacataaaatatttggaaggattaaaccatccgttacatgaacggtcacttgttagatactaaattcggtttggattgaaaggaaaggtcgatttttgtatttattgtacgcaccaaccatctccgtcctacccatgcctgcatctgaaaaagggctgactccaagatgaag

SEQ ID NO: 547204 - DNA, 293 bp, Homo sapiens
tcttctccgaaggcacatttacatttttcctacaaggaaatactgtgggctcactgggagaatattggatatttgggggctaggccacctatccatgaagaaggtccgcgaagatctgtataaatgggtttggtcagaaccgatggtaccccaggaagaacacttccagtcatgggcccggacgggaacgtaggacaaagcggttaccagaaaaaaacgcatctctcctttgggacgtaccatccccggtctacatgagctcggcgttgccgtacttgggcgctgtgcgggac

SEQ ID NO: 547205 - DNA, 326 bp, Homo sapiens
tgatcgagctcggccctcttgatgcaagtgtccagagttgttcattccttccgccgggttcgtggtctcgctggcttcaggagtgaagctgcagactttcgcggtgcatgttacagctcataaaggcaacacagacccaaagggtgagcagcagcaaggtttatcggtgaagagtgaaagaacaaagcttccacagtatggaaggggactccaacatggttgctggtggtggcttgggtgggctggttttattcccttattttgggcccaaccaaattggtggtggttggtcccttttacagaaaactgattggtcccatttaaaa

SEQ ID NO: 547206 - DNA, 124 bp, Homo sapiens
  misc_feature (26)..(26): n is a, c, g, or t
tctcatcttctgatcccatatcatcntgctgcacgttgagcacaagtggtggtttactacttgagtctgctttccgtgggcaaggggggtgtcccctatcagcgtgtgttctattggttgatga

SEQ ID NO: 547207 - DNA, 127 bp, Homo sapiens
taagagcaacttacttctacaagactttcatacagccaccaggaccttaacacgattctaccaggaacactgatcccacatacgtgacgcacatagttgtgtatgtgaacaataatagactccgatc

SEQ ID NO: 547208 - DNA, 230 bp, Homo sapiens
attaacaccatgctgcttggaagaggtaggagccaagggaacacagcagtgccatactggaatgtgctggggaggcccgggcaccctgtatagtctggcaggctggtgtcactgtcgccaggcaggcagcgccgggttcaggcactgtctgctgcgtggtctggtgcagtctgcgtctggttctgttggggttgggccaaggttgtggccggggctggggcggaggcatc

SEQ ID NO: 547209 - DNA, 156 bp, Homo sapiens
tggtcttggtgggatggagttaataaaaaaaactaatcttcgagctctgaattcctttcttctacttgtccagctctattactgagacttcccggagcttttggctttcctaaaagcgtgtccaaatttccctgaaagcctaagttcagagccagg

SEQ ID NO: 547210 - DNA, 737 bp, Homo sapiens
ttgcgagtcttatacctcatgtggcactgtacgtgtggataagtccttgtcagcatgtcccttctgtatgatacccagaaagtacataccaatgcgtgtggaagtatcacccaattgtatttgagaagttcacaaaatatgatcccgaatcaatgtctgagtgctgaggtatcttactactgaggatacatcagaatatattgtactgcgaagtatgtctgactattgcactggggaacattggtagggcaattagacaaggagaactgagatgttgacttcaagttttctggtgctatctcgtgcttaacatcaagatagtctgtgtcggacatgggtggcaggatactgccatttaacatatgttttgtagcaacgctagactgtggcgttgaaagtttgagacagatacagaaggagtgtcaactcatcatttaaagtgttcgcggtaattgtgactgcctcaggtctgccttttttctctggcagcataaatgcagtaatcctctcccaattgagcagcacacattttcaattctcatgtcgagtgatttgaaacatgttttgggggactgtgaaaacctacacgtttgtgtcatgagaatgtaagtcttttttctacttgtaaaatatagtaggttcactgagtaactaaaatttagcaacctgtgtggataatggatggagtgcgaatattgtacttactgccctaagttgattgacgctttggaacggga

SEQ ID NO: 547211 - DNA, 181 bp, Homo sapiens
gctatcaggccaggatgacctactccccattgttcttggaaatctccagtgctgctgggcagctgggcagagcactgggaagtgaagtccatgagtgcccgattcctcttagagaaaatccctagccttcagatcttggtgttttgacttcttactatagatgtttttaaagttcccaatt

SEQ ID NO: 547212 - DNA, 119 bp, Homo sapiens
taagacaactcactggccagttgtaatttacaagcaaaagcctgctgagtggattacagctgggccaagtacagtacgaggcaataacaaattagtgtgggtgattctggaattggaaa

SEQ ID NO: 547213 - DNA, 162 bp, Homo sapiens
atgggtcagatggacaggatgtaacatctgacaaccttctgggggacgaagtcttccaggggcgtctcggaagtaggagtcactcatgtagaaatatactagactgttcctatacttcccacaaggggcaaggagcacggtcagccccctcgattggtgagt

SEQ ID NO: 547214 - DNA, 398 bp, Homo sapiens
gacatgtgatgagctcacatgagggaatcgatggcacacttccaaggaatacggagacagggccagacatgccatggcgactcggtgcaccgggggccggctgtgcccaagagagccaggcattcagcttggattccaagttccttactgagagccccactgcttgatggcaagctctaggcttgcttgggatcggtgactttgctcatgaagaagatgttctgggtgtctgtaggggacactgatcatcaggaagggcctgttgcaacgcacaagggtccttgtctccactaatgcagaaaggagggtgatttggagtgcggtggcagctgctgcttctgtgccctcctcaaaatacatgaagcacagccttatggatcacctggaagactagtaag

SEQ ID NO: 547215 - DNA, 849 bp, Homo sapiens
ggcacaatgccgccaatctctttgcttaaacataacaagaatcacctttgctccagttcccaacaagttcctcatctccatctgagaccacatcagcctggaccttagtattcatatcactatcagcatttttatcaaatattaaacaaatttctaggaggttccaaactttcccacattttcctatattcttctgagccctccaaactgttccaacctctgcctgttacccagttccaaagttgcttccacatttttgggtatgttttcagcaacaccccactcccagtaccaatttactgtattagtttgttttcatgctgctgataaagacatacctgtgactgggaagaaaaagaggtttaatgggacttgtagctccacatggctgggaggcctcagaatcatggcctgaggcaaaagttatgtggtagcggcaagagaaaatgaacaggtgcaaaagcggaaaccctcgataaaaccatgagatctcgtgagacatattcactaccatgagaacaatatgggggaaactgcccccatgattcaaaatatttcccattgggtccctcccacaacacgtgagaattatgggagtacaattcaagatgagatttcggtggggacacagagccaaagcgtatcagaccccgtctctacaaaaacaaaaacaaaataacaaaaaagtagctacgtgtttgggcctggctttcacttatttaccaaggatcacgacctgaacgtgacaactggcaggccagggttcctgaccttggatgcacatgggcaccttgcccactagaacatctgtgccaagcagtgatcccatcaatcatacggaaaattaca

SEQ ID NO: 547216 - DNA, 350 bp, Homo sapiens
  misc_feature (2)..(2): n is a, c, g, or t
  misc_feature (219)..(219): n is a, c, g, or t
  misc_feature (232)..(232): n is a, c, g, or t
  misc_feature (268)..(268): n is a, c, g, or t
  misc_feature (298)..(298): n is a, c, g, or t
  misc_feature (307)..(307): n is a, c, g, or t
  misc_feature (320)..(320): n is a, c, g, or t
  misc_feature (328)..(328): n is a, c, g, or t
cnactttcttaccccagatagcctccgggcgctgcctgtagtccatgctgacagctgtaccagttagcccgccaaagactgctgacaagctggagacggttctggtttcaactacgggtaatattgatatcggaagtattctagacagatcctcggttgggttttctagctacatgtttgtattgcacagatccccacctgacatcctatagtgttgtnttcctgtgtgttncggggcttctgggcagctgggcctgcccggggaagnccttgcaggtgggaggccatacagagaccnactgtgtgncactgagcgtccnactgctgntgggcaactggaggactgcagg

SEQ ID NO: 547217 - DNA, 214 bp, Homo sapiens
gacactatcttctgacataacggtgtccactaacagcctcatacagacaccatggcgcatctgactcctgaagagaagactgctgtgatgccctgaggggcaaagagaacgaggatgccattggtggtgaggcccttggcagattactggtggtctacccttggacccagaaggtctcatgagtactatgaggatctgtcctctcctgatgctg

SEQ ID NO: 547218 - DNA, 399 bp, Homo sapiens
atgtatgcatttgccacaatggaatgccaaaccaatgatagatggttctaaggtaggtcaacacataagatcctgatgacctttgcagatggagggactgatgaaaaaagagggaggcggtgagtggtgggaaagtccttcattagaatcatatgaattaaaaacagatgcctgtgaatctccttattgaaatgtttggtttagaaatctgacctagaaaatcggtggctccttctgccaggaaacgtcttgagttcccgcccatgcttgacagcctctcattggagttttgatgacttgaagtacaaggaaaccagacaggaaaggtggaacctgggcagaaaaactctttctggcttcctaaaaatgtgaaaaattaaatgggagctatctttacat

SEQ ID NO: 547219 - DNA, 428 bp, Homo sapiens
ggggtacactgacttgagaccagttgaataaaagtgcacaccttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcggcttgggccaaggggatttaaaattggggaaggttaaggaagggggcgaaaatgggggtaaattgggaaaatcggccaaaagggggggggattaaaaataaaggggcgggggttaaaaaagttgggaatgggaaaaacctgggggtacccaaattaaagggcttggaaaaaaatccccttttggcaagtgggggaaaaaccaaaagggcccgaacgaatggcctttccaaagggtggcaaacccgaaagggatgggtggaggcgtttttgg

SEQ ID NO: 547220 - DNA, 349 bp, Homo sapiens
cttttttgggtttttttggtaaaaaaaaattttttttagggaaaaaaaaaaagggaaacccccggccccttttttccaaaaaaagccctttgggggaaaaaatttcccccaaaaaccccgttttaaaaaaaaacccggggagggaaaaaatttcccaaggtttttggaaattttgggggaaaaaattatccccgggttgcgcaaaaccccggggttttttcccaaaagggaaaaaaaaaccttttttttttaagggggggagaaaaggccccggtattttttcctcccccgcttttttttaaaaaaagaccccccgggtttggttaaaaaaaaaaattttggtgcccca

SEQ ID NO: 547221 - DNA, 551 bp, Homo sapiens
tggcgacgggaatggagacgctgcagggcgcggaccccccaaagaacacgtgacccaccaccccgtctctgaccatgaggccaccctgaggtgctgggcccttgggcttctacccgtgcggagatcacactgaccgggcagggggatggggaggaccaaactcaggacaccgagcttgtggagaccaggccagcaggagatggaaccttccagaagtgggcagctggtggtggtgccttcgggaagccggtctcccagcccaccatccccatcgggggcatcgtggctggcctggctgtcctggctgtcctagctgtcctaggagctagtgggggctgtggtgatgtgtaggaggaagagctcaggtggaaagggagggagctgctctcagattccgaggcgccagggggtacctttccctgagagcccgtctccagatgtggagaggggggtctcagagcctcgagaggatgttgggctgcagacctggggccggacgggcgcctgctcggggggtataaccagttcgcctaggagggcaaggattacat

SEQ ID NO: 547222 - DNA, 126 bp, Homo sapiens
actctagacggatccccagcgggaccaatcacttagagcattaaaatcttcagactcaacaagcatcttggcagtcagaaaacacacatttggaaaatgagaatcagaaggcggggaacaatcact

SEQ ID NO: 547223 - DNA, 735 bp, Homo sapiens
cggctggtacgggccggctgatgactcggccgaggcgctgctgctctggggagtgccatccgaggagctgacgcagtgcgcaggatgctcagcttgctactgctctggagtgtctcatcagatatgcccatacgaggcagtcttgggatctggaatgttggagctcagctgcatggataggcagctgcgcgtgttcgttcccaaccagtgagctggagaaggtgctccccacagaccatcctgtataagtactatgagcgaagaagccgaggaggaggttgcggcagcctacgcctgacgagcttgtcaggtgcccgtcctgtagctttccggctctgtcggacagtgatgtgaagaggttcagctgtcctaatcctcagctgccgaaaggaaacctgtaggaagtgtcggggactctgggaacacgtaacataatggcctctagcctgtgaagagctggctgaaacaagacgacactcaagtaccgtacctctattgaagaacaacatgactgctgtcccgcattatgaagagatgccagcaagtgtgggactggcctcagtcaagatctgacggctgtagaccgcgatgtccttgccgctgtggtggcctagatgtgctacctctgtcgagtttctattatgggatatgaccatttctgccaacatccccgtcaccaggagcccttgccaggagtgttcaagatgctctctctggaccgatcccactgaagag

SEQ ID NO: 547224 - DNA, 183 bp, Homo sapiens
gaaattagatacatcctaatccaaaagaaagcatattttttataaaagtgagaagattttagaacagatatttcttccaagtctgacgagaaaaaattaaaatacagataaacattgcattttacagaatgtcacagattcagagatagtgatgtcatctgtcctacacatacacacttggag

SEQ ID NO: 547225 - DNA, 167 bp, Homo sapiens
ttcagtactgtatgacagttcatcctgatttccacacagttgttgctgcctattgtggtgccgcctccggttaggggctctcagccatctcttacctctgacctcgctggtcttggcattgcgcccgcagatgctgtctcccttatccaatgagggaggcccagaat

SEQ ID NO: 547226 - DNA, 298 bp, Homo sapiens
tatttcttgtggttggatgaatgataagggttagcatatatgaggtgtttgcagctataccatattgtttctgttattttattatattttgatatattacatatgcagtaattgtactattataggtgagctttatgagtgagtgtcctggtgacggctcctcctggggagcccaggaccagctttcctggcaccttgaggtcccctcacccctgtcccattctcctgcattaccccattctactctgtcttcatattgtatactatagatatttaactcttaaaaagacaaaaaaaa

SEQ ID NO: 547227 - DNA, 220 bp, Homo sapiens
atgggtctttcacctcccaagaagtgtttatcaccccataaggtattgttctaacattaagacaacatatgttatatagtcatcttagtgaccacatcattgaattcaactctgagtgaaagatctgtgtcttaaatcttctacgtaggactggctctcaggaagctatgttcactcgcctggcatgaagacttctccacaattcacacagtctgttgac

SEQ ID NO: 547228 - DNA, 200 bp, Homo sapiens
ttaattgaccaaacacgaacatgatacgagtgaaggtgatcattataaatgactatacttgaaattcatctgaagtagggaagctcgagaacagacaaagaacgctaatttcaaaaatagaaaataataaaaagaaccacctacatccgctgactttctacatcatgccggcagtgctctatactctcctgtcctaggct

SEQ ID NO: 547229 - DNA, 408 bp, Homo sapiens
  misc_feature (7)..(7): n is a, c, g, or t
ggatcgnttcctgttttagctctgatgtatgcacgtcgactctttagatcacccacccatgtgccgttcccaaactctgaatttggagccggcatctgtttatgcctctcctaaggtggctgttcgtttccgggggaatttttcctcctttcctttccagccatttaaatcctgcgtgtctttgaaggtccagccagaaagttttcttcccctatgaaatcatcctgaagtaatcaattccatttttaaggcctaaagcctattggttcctgacctatgctcaaccttgccctttttccaggtaaatgattggctgttggctttaggcaaaacctgggtttggcgataaatcattcagatttaacttttttttatttttcttttttttgaggcatggacccgcccatt

SEQ ID NO: 547230 - DNA, 281 bp, Homo sapiens
taactactgtacactacgaccgcataggtgttcagaaaaatactaagtggcatacaaatccagttagaatctgattttcaaggttatacaactatggtaattttcatttatatccatttagtctacatttcctctatattttgataaatacaaatcttcccatgctttttttaaataagaaaatattataagtctagtcattggtaccataaatattttatacaatttgcaaaccacaaattcatcaaattgtcgattattctacagaggcacacaaagcc

SEQ ID NO: 547231 - DNA, 578 bp, Homo sapiens
ggatctggtccgtcgctttacaagtctgtgactgtgactgacctggtggattgggtgcatgcgcttcacgtggatcatggacaacacactgggaaggtggtcctctcgtggctccatgcgtaacaacaggccgagaaggaggtgaagagagatcccattaactcctccaaatgtggacggggcaacagaaatgggcgtgatccaagccatgactcctaggagcttctctccaaaagtcacagcgacggcgttggatgccaatcgaggtcctgtgggggacattgcagtgacataagcgacattggcaaagagatacacaaatgtgaccagtgggatggagatgaagatggctctgggaaggttcttgtagggagtcaacaagctcctcagtcacgtaattcaggaaagttccagcctccataggcaaaggagccctgaaggaaatccagtgcgatgaggccgatgtcaggttcgctggaaattctcaaatgcatactttggctccagccgagaagtactctcctttgcatatctgtacaatccccatgatgataatcagggccaagggcaggagcttc

SEQ ID NO: 547232 - DNA, 309 bp, Homo sapiens
gctcattcacacagtcttgcagactaagtctatttgtctctgtatcctctacaactatacacgtgtcgagcacatggcaggtgctcagtaaaaaagttctaaatgggctgggtgtggtggctcatgcctgtaattccagcactttgggagtctgaggtgggtggatcaggaggtcaagaggttgagaccatcctggctaacacagtgagacaccttctccactaaaaatacaaaatattagccgggtgtggtggtgggcgcctgcagtcccagccacttgggaggctgaggcaggagaatggcagggag

SEQ ID NO: 547233 - DNA, 281 bp, Homo sapiens
ctcgccatatgtcctcgttcctaaacattttccttatcttcacctcagtagtgcgatcatcatctaccccgtgggctcaggccaaaaatcgcgtctgtctcattcccacatcccacttctaatccttgctctaatccagttctacctctgaaatataccctaagccaatgatgtcccactgtactcactcctacaggcctagccttttccctggttgaaagctgtctcctcctgggactacagcaacagcagattgccaggattcgagctccatcaggaaa

SEQ ID NO: 547234 - DNA, 238 bp, Homo sapiens
  misc_feature (76)..(76): n is a, c, g, or t
gtccccaaaataaatttgagattgattgatgttgttgcatgtatcagcacttcaatcttttgtatgaatacacccncagttagttagccattcacccataaaagacatttgaggtgggcacggtggcttatgcctgtgatcccagcactttgggaggccaaggcgagcagattaagaagtcaggagatcgagaccattctggccaacggggtgaaacccccgtctctactaaaaatac

SEQ ID NO: 547235 - DNA, 285 bp, Homo sapiens
agatgaaaattcaggaccgtggatcagaagcttcaaggtgtgtggctctacttaataataggcacgatcagtaggctaagaacgacgagtgtttccattgagacatgatctaagaatagccttctatagaggcaaatcatgtactgtagaaactagctagccagccaccaagatgttaccattaaaggattccttgtaactagcaactaaccatgtttaaaaggtcttagccagaattacaaaaaacaaagcatttagaagtaataacttatggaatacaaagca

SEQ ID NO: 547236 - DNA, 133 bp, Homo sapiens
agctccgggtacactgggaaagagggggaaagcctagcctgccagccagacagacagactagacgaaagcccccgctacggagcaacggtggccacatctttttaaaatgaacacaaaataacaaagacatag

SEQ ID NO: 547237 - DNA, 726 bp, Homo sapiens
gctctcttcaccctgcgccgtcatgtctaagtcagagtctcctaaagagcccgaacagctgaggaagctcttcattggacgggttggagctttgaaatcaacgtgactgagagcctgaggagccattttgagcacattggggaacgctcacggagacatgtgtggtaatgcagagatccacaacgaccaagcgcgtccaggggcttcgggctttggtcacatcatgccactggggaggaggtggcatgcagttgatgcaatgcaaggtcatgactaaggttggatggaagagttgtggaacccaaaggagagctgtctctcaggagaaagaatcttaaaagagaaactcgaggtttgcccccaagatttaaaacttggttgaaaaaataggactatttgttgttgggtggggcgactttaatatgatgaatgacatggtgagagaacattcaccttaagagcattatcttggaacagtatgtgacacaacatttgaagtgattggaatcagtgactgagcgaggcagtggcacagaaagaggggcctctgccttttgtgaacctattgaccgagcatgattccggggggtcagattgtcgttcagaaatacgcatgactgtgaatgggcacgaagtgggaagtcagaaagggccttgtcaaaggaagaggatgggtagtgctgcaccagccaaagaggacgaatggtcctggaacttgcggtggga

SEQ ID NO: 547238 - DNA, 609 bp, Homo sapiens
  misc_feature (213)..(213): n is a, c, g, or t
gttcttttagcagtttcataattgaggtcttagatttaagtctttaatccatttttacttgattttgtatatggcaaaagatacgggtctgtttcattcttctgcatacaggtatctagtttttccagcaccatttttgaagagactgtccttttcccaatgtatgttcttggcacctttgttgaaaatgagctcactgtaatatatggattngtttctgagttctctattgtgtttcattggtctatgtgtgttttttttttttttaaatgcccagtaccaggatgtttgggtaacaataggcttggcgcgtaattgaagtcccttaatgtgactccttccaggttggtggtggctaaggtccttatagcgtaggacttgcagctaacagttacatatacatgatggaaaaggggaccacgctctagtaggagcccgagggaggagaggtgccaggggacaaattctcaaggacacaagtgggaaaccacaacgccccagagggtcaacacaatacagtggccacagagccccccgggatacggtgcgcaaacagaggggggtggcccccatgacccgaacaaaatgaggggatttaaaaggcagaag

SEQ ID NO: 547239 - DNA, 776 bp, Homo sapiens
agcggagtggcgggaggtggaggcgataacgacttgtgttgtgagaggcgcaagctgcgatttctgctgaacttggaggcatttctacgacttttctctcagctgaggcttttccatccgacccatgatgctcttcaagttcggtgctccgcacagccccagacttggcgtcctgagaaatggatggtcgttcacacataccactcttcaaatcccattcatgacatggattatcagtgcagatggtaactgactgaacacacattcttatggagaaacaggacgtcccagatatccatccattttggatgtaccttctcttctgctcccaatatggaacatgtactagcaagattgccaaatgaacgaaggcttagttcgattgtataagcacagaatcacaaagttgtcagaaagaagtgcttcaaagaatggatggatcactggaatgccgatcttatgagcctggccttgggttcctggtgaacttaaacattgattacagcagcaggatgatcaaacagccaaatttagggacgtaaaagctggtgagctgattggaacatgcaaaggtcatcaatgcagactcaagtcagtagcctattctacgtttgacgaaagctgtatctgtacgggtggaagagatggccaaataatgcgtctgggatagcaggtgcaacaaacacacatgggtcccataggcaagtgcacatcaaatcagcgagagctcacaaacacatcagacaaaaaaacaccattagaaaacccagcacgaa

SEQ ID NO: 547240 - DNA, 159 bp, Homo sapiens
ttcgacgggcttgcggttgatgtgagatatgagcggcttcacctgccacactgcacggagtgcacagcgtcttctccagggcggcggaagtagctggcccagctcgcgggtgcccttcttaggctcgtgccctgaccctggctcatgaggccctggagg

SEQ ID NO: 547241 - DNA, 92 bp, Homo sapiens
ttcccttttccccccccccggggggggggggggtggggttttttttttgggaccgccccatttacttttttttttggggcgggggcccccca

SEQ ID NO: 547242 - DNA, 472 bp, Homo sapiens
ccgccgccatgtccgcgcatctgcagtggatggtcgtccggaactgctccagtttcttgatcaagaggaataagcagacgtacagcacggagccaaataatctgaaagcccgaaactccttccatgcaacgggctaattcaccgcaagaccgtcggagtggagccggccgtcgatggcaaaggggtcgtggtagttatgaaacgcagatccggtcagcgaaaacctgccacttcttatgtgaggaccaccatcaacaagaatgctcgggctaccctcagcagcatcagacacatgatccgaaagaacaagtaccgccctgatctgcgtatggcggccatccgcagggccagtgccatccttcgaagccagaagcctgtggtggtgaagaggaaacggacccgccccaccaagagctcctgagccccacacgcccgaagcaataaagagtccactgacttccaaaaaaaaaaa

SEQ ID NO: 547243 - DNA, 1819 bp, Homo sapiens
  misc_feature (1184)..(1184): n is a, c, g, or t
tttgttttttttttttggtctcaaaaatctgtaaaactttattcgtgttccattctttgcgccattataccataaatctggagaaagcaaaaatgtttcgtgttaacaatagataagagggccctctttacccatgaagatcaagaacctctctaaactgagcaagggggaatgatagaaaccgcctctcccccgaaatcccgcatgtagctgacccttgttcgattctgtagacaatagccttcagctctgatgtggacccggagtgacccctgttcttatgggccaaattgccataaaggagagggacctaacgaaaattcagataccctagagcttcgcaagccgagatacgttggctagaagatattcagccgagttaaaacggcgagcattacatattacgtcaaagtggaactccaattaatatcttagacactcaaaagcggcactacagagtttaccctctaaggggacattcaacccagtcgtcgatatctcttatttccttagaaggtctcgatgtattctagaaccaactagagggtgtttctagcggcacctcccgaaattggttgtgagaaattcgggggtacaacttcccccggaaaatgtggtgttgctcggaaccccgctcgatcttatttccacgaagcgggtttttccggggtctgaggttagtccaacagggcataattcaaaagaagcctcctcagtgagctgggtggcaaactcgtgggaacggattccacacgaaaaccgcgcggagagcactaaacattcccccaggagggtgtggggggatggctaccctaacttccgaacgcttaacgcagaaactattccccttagcccctgaggtgttaggccaaacacctggggacccggacagcgcaaggtaataacatacaggggcgggcccctaatctttgctagcaaaaaagggcgtctacattttccctcccgcggattaaagatgtggcaattaactctcaggttcgtcacaaacttagtgaacgttattttgtatacccccccaaaatggtgtcacaatcttgccacaagttgaaaacgcaggggcggtctcgtgttttctacataacggacaatcatcacaatctgggacacgacggacaatctcaccccagcgtccaaccactcactcaccgctaaatccaaacacncaccgggtgtgggcgcggaccgccatatagataagaatgttcatcgccagccgtggagaggaggcccacacacactttaatgagttgcttacatccgcaggtatttatgttggttcatcgcaccagggtgccccccctttaatgtgtgatagcatccgcacttaaaataaagaatgcgagacgaggtgcagccgacgtcatactaacagatcgtcgtcgagcgcagagacacaacatcagtttcggaggataatctgctgtcagaagcaatccactcctgtgcggtcgtgagcaatcacttgagtagcacccccctctaatcaacaatatagcgacacatgcgggaagcactatcacacacacacggcgattgagtcggatacaccctcacgcctgctcctcgtgcgaacaggtctctgcagtattaacacacccctgtcatgcagaaacagataatcgtagctaaagaccaacatcgataggtgaagtatcattatctactgactcacgtagatcaattactaaggatatctagctatacttcgccccctcctaacaacgtaacatgcgatctctataccgacgtcgcacgagactcctaatacagactgaagaacggcaacgaggaagcagca

SEQ ID NO: 547244 - DNA, 175 bp, Homo sapiens
gatcaggcgaagatatgtgggaatagttcgtcatacaaccgatgactatttcgcaaacttcagccccatatactgggatgagagtgcctcctttctcatccaggcaaaccacacacatgatgagcctacgagcttgcaggttcaggggctgacgggcacgtggctgtgcttgggc

SEQ ID NO: 547245 - DNA, 598 bp, Homo sapiens
ggtatgttccctgtgtggcatatcatacactcgcagctctggagattatgtgagggccctatatgtggatggcctgtggtcagaatttatttatgaacaggccttttgaaagtgtcccacaatcaaagtacccaactgcaccatggaagtggggaaggagggcaccccaaaggacagcgccttattctctttcacccatgcacggtcttgggtgaaggacgctgatttcctgtggatgcgtggatcccatatgatccagcccttctttgtgatgaagcaatgttgtgaatcttcactcttcccttactctggactttctttgtggaatccctactggtcttcttagaaccaggttatgcccgaggcttttatccagactctttttgcgatttgtgcctgagaagaggggggcttcagtggccccagattcataccagcataaccagcatgatcctcctggtctctcacatgccttgctccacacttggtttctatactcaggggtcgaagctcagagcgttttataggccacgagtgggactttgctctctatatgggtaatctattctccatttttcaccccgggctttcctgggct

SEQ ID NO: 547246 - DNA, 500 bp, Homo sapiens
  misc_feature (92)..(92): n is a, c, g, or t
ggaacatcatgtcttctgcaggaaagaaagtaacagtattataggagaatgggggtggataagagcaaattataatgatataataatcgaantgttgtagtaactcttgattactttattattggtaacacgccctaactatcctgtgtgagaatgggaatttcaagtcccatcttgtaaattgtatatgttgtctatgcaggggtctcggcgccaagcaaagcatgcagaacaaaaatgccatgtcgattgtaattactcctgggtattcagaataatactagtgatggggagccagatccgcagtggtggagagttctaatgtcgactgtgtgggcagggccaaagagagtgagttgctgtgtataagtgttgaagcataatcattgtcgtgttgagagtaaacattcgctgatgtcagatggtcttcgtcaaggcgtgtgtcctcttaacttgaaggaacttcagacttggtggaccatcgaggactacaatcgcca

SEQ ID NO: 547247 - DNA, 83 bp, Homo sapiens
aggttccccggtgtcccgacggcggctcaagtcagagtggctgggtttagctcagataggtgtgggaagagcctgcctgtggg

SEQ ID NO: 547248 - DNA, 104 bp, Homo sapiens
ccggggtgaagatggcggccttctccgagatgggtgttatgcctcgagatttccacaagctcgttggaagagataggattggctccttcccaccttgatatcca

SEQ ID NO: 547249 - DNA, 311 bp, Homo sapiens
accttgctcagaggagcgacttttttttcgcgcgtaggcgttttcacgtacaaacattttttcccacctaaattccagactgcgcgttcgccaacttctgaagcgtgtcgcctagattgttgtgtattggcttttttcccttccgcttcaagctcagtgggttgtcgcgcagccaagtaatccagtcgtcctctttgagaagcagaactgcaatgaccgccacgacagtaagaaccgcgccgatcagacccagtacagcagctaccgccagcaacgaggcgtttcctattgcaaaaacggcaacgccagtt

SEQ ID NO: 547250 - DNA, 188 bp, Homo sapiens
cagggatgtcttctcagcagaagctcatcattgtggaaggctgccaaagacagggtgctatcgtggctgtgacgggtgacggctgttaatcactctccagctttgaagaaagcagacttggggttgctatggggattgctggctcagatgtgtccaagccagctgctgacatgattcttctggatgac

SEQ ID NO: 547251 - DNA, 330 bp, Homo sapiens
ccacattttaatctccagacccaacctctttcctgaatgccacatctgtcatacaatttaactaatttcctatgaagcaccttcatttggatgtgtcattggcatctccttgacatgtgtaccaatcaatacacagtattcctcttattcatgggttcattttccttgggtttaggtacctgcgattatctgcagtctacggtatgaatagtgtaatgcactcttgcttcatactgctacaccccacttaggacatgaatcattcctttgtgcaacgtatcgatgctgtgaacatcctttcccttagtcactttgtagccatattggttt

SEQ ID NO: 547252 - DNA, 1326 bp, Homo sapiens
gatggtgttgctggcagcgtgggggtgtgcgaggtgcgtgggggtggcggggtgtggcggtggtgcagaggtgtggggtgtggcgctctcgggtgggccggtggtgtgtgcggccgtaggtggggtgagggcggcggggggggtgccgcgcagttggccggtggcagtgaagtcgcgttggcgggacggggatggtggccgcgcgttgttgtgggggagccgtgttgctgtccgccgggagtagtccgacatcaggtgttggttcgagcgggtgaaggggagaggggggggggagtgcattgggagagggggagcgaagcgcgaggggaacaggggggagaaaggtgcggggagagcgcgaagcggggagggtagaggaggggggaccgggaggggaaggcaagcgtgcccaagggggggggtgtaagtgctgggagccgagcccgggacccaggtgggagagacggggatggagggggcgcaggggagtgagggagaggctggaagaggggagggaggtggggaggtgaagggggttgggagaaagaggcccgcgggtgagcgcgggggagaggccccgctgcaagtgaggaggcccgaggtagccggggggaggtgtgcactgtagggaccctagtcttgaggggtttcccccggctctcgggggaccgacaagggggcacgaccttgaagaatgagggccacatgggttatatgttatacccacgggtccaccgcacggtgttaaagaggctttgtgtcggccctttgtgtagagtgaccactggcacagagaagctcactcgcacaaccacacagcggggagaaggctctgttagacgcttgcgcgacacgcacatagagggctacgaaaaggtgatttgtgaaaatagatcgtgagcacttttctaatgtgcacgtgtctctgggagatgtgtttttttgtgagagaaagtgtaattctgtcacagccacaatatctgttggctgtgaagagctggcgttggtgggagagtggtgtgggtgaaatagcttgtggtggtgtgtttatatgtgaaaataatatgtttctgtaaaccgaaaaatagttgcaaacggaacactgttgcctctgtagtgacacctgaatactctaataaaatatgaatcacttcaagcgctaaaagttctagtaaataagactgtaacttgtgaataagaggacaaccctacaaatatttcacatgcagtaacaaattatgcggtctgttaagaaaaaatgagtaatttagtgttttggacttgaaacctacaacagtgttctgtagataaaaaaggaaaaaaaaa

SEQ ID NO: 547253 - DNA, 339 bp, Homo sapiens
gatccctggcgatgtgcgtgcatgtaaaagagcagtttttttctctacccactgacaaaaaaaaaaaggtaaattggatggtatataatttacttctgggccacgcttaggggcatatgcttgaatccaagtacttggcaaaatcgaggcaggaaatccgttgggccaaggattccgagcccagccggggcaaaatagtaggaccctgtcacaaaaattttaaaaggattccaggtaatcctggagattctgccaagaacagaggcaccaggaaaaaaggataattaattaacccatacaaatggaatattttccattggtaatcaaggtttcatccac

SEQ ID NO: 547254 - DNA, 648 bp, Homo sapiens
ggcgtgggcctgggccgccgtcgtacctgatggtaggaggcagtagttccccgcttcccttccgcgggagggagagttagctagccatccaagaaaacaccatgaaagataacgatatcaagagactactgtatacccatcttttatgcatattttcaattatcctaagtgtcttcattccatcactcttcttggagaacttctcaatattggaaacacacttgacatggttgtgcatctgttctgggtttggtaactgctgtcactctagtactatattagtagtgaacaaatactctctaaagagtctatcacaaaggtaactgatttgaaatgctgtattattcttatgtctgttctcctttcatgtaatttgtctgtatggagcacatgatagagtgggtggaaaatttattgcagttattgtctacttttatatgtgcctgttatttgtaggacaactcaagcatggtaagagtgtcagagaatggggtactcattggagaatgttcagatcatacattctgcttgtggagcaggttgagcaatctatccatggatgggaaagacaaggagaagagatgcaggtatttggggagggtgggtacaagaaggtaaaacttgatttcttgttccataagaaaaggt

SEQ ID NO: 547255 - DNA, 150 bp, Homo sapiens
  misc_feature (29)..(31): n is a, c, g, or t
tctcctataacctttggattttcccacannntaaacttctaatagcctactgttgactggaggtgcttacccaataacataaacagcccaatttaacacatattgttggcatgttgatgtgtattatgtgctgtaattaataatattggt

SEQ ID NO: 547256 - DNA, 523 bp, Homo sapiens
aaacccccccaaccgggccttttttgggtttttggccttttgggggccttttggtcacaagttttttccgggggtatcccccgattttggggaaaaccgttttcccccccttgggtggggggaaaccccttccccccccccaacgccccggggcaaggagttagtgaggggggaaggggaaaagggccccataaccaaacccccttttcccgggggttgggggatttattaaagaaggggggccggcaggttttccccctggaaaaggggcagggggggccccccaattaatgtggggtgggtccctctttaggcccccccgggttttccctttttggtttcgggttgttttttgtggggaaatgtgagggggtaacaattttccccagggaacaggtttggccctgattaccccaaggtaaaaaataaccccccctaaaagggaaaaaaaaggggggtcccccccggggggggccgctttaaaaaaaaggggtccccccgggggcgggaatttgggccggga

SEQ ID NO: 547257 - DNA, 199 bp, Homo sapiens
tgtctccgacatagttgtcgcaagaatctatttaggtaaaacataagaggggctggtcacaggggctcatgcctataatcccagcacttgcgcaggccgagccgggtgaatcatggggtcaggagatcaagaccgtcctggctaacatggtgaaaccctgtctcgactaaaaaatacaaaaaattagccgggcgtggtg

SEQ ID NO: 547258 - DNA, 176 bp, Homo sapiens
atacatgagccggtacccattgaatatttaatgttcatttgcatcttatatgaaagatcattattcatctcacatctaacaatttgtcctgtatgaagttaggatttatgtacttgtatttctacgaactcatgctataatctggtcaagagtcattgagaacaccggtgagacaa

SEQ ID NO: 547259 - DNA, 100 bp, Homo sapiens
tagaatgtttagtgagacctagggtgttgtgagtgtaaattagtgcgatgagtagggagattagtatagagaggtagagttttttttcgtgatagtggtt

SEQ ID NO: 547260 - DNA, 1018 bp, Homo sapiens
ttgaatgtgcctggccagtttgcagtgggtcacacctgttaatcccaacactttgggaggctaagatgggagaactgatggaagccaggagtttcgagaacagccttggctcaacattggtcgataactcccattcttcttacttaaaaattacaaaaatttcgccaggcattgttggcacacaccttgttaattaccagctacttcatgtgtggcttgaggcataagaattgcttgagccttggaggccgggttgcagtggcttacgccttgtaatcccaacactttgggagttctgagacgggttggaaattcctgaggtcaggagtttcaggaccagcctgtccaacatggtgaaaccccgtctctactaaaaattacaaaaattagctgggcgtggtagcacgttgcctgtaatcccagcttgcctgggaagctgaggcaggagaatcgcttgaacctgggaggcggaggttgcagtaagccgagattgtgccattgcactccagcctgggcaacaagagcaaaactccatctcaaaaaaaagaaaaaagtgccgagtggcacgtggctcacgcctgtaatcccagcacttggggaggccaaggcaggtaattcgcaaggtcaggagttcgagaccagcctgtccacatggtgaaacccgatttctctaaggacacaaaaattcagttgggcctggtggcgcgtacctggtatcccagttactcaagagctgaggaggagcactccttgaaccaggagcaaagtttgacgtgagacaaaatacccccatgactcccagcacctgtggcaacatacgggaaatccgtcacacaaacacacaaatccgagctcgttcccaacacattcatttttacgagacaccgtagatggcagcaccactatctgacagagggtcacacaaacacatatgtgttaggagttagaacacgagtgaccatatacatacaggagataggaataaactagtagaaacacagtagcggacacgataccc

SEQ ID NO: 547261 - DNA, 173 bp, Homo sapiens
gcactgacttcaccttcgcgctcggtctggggactctctacacgtcgacctgcctgcgtgcctgctagggatcgccgcgtcggttcacgccggttcgctgcggggtggttcttccttttcccgcccaagactcttgacccctacccactcccactgaccggggactcctctac

SEQ ID NO: 547262 - DNA, 960 bp, Homo sapiens
catggtggctcacacctgtaatcccagcactttgggaggctgaggtgggcagatcacgaggtaaggagatcgagaccatcctggctaacatagtgaaatcccgtctctactaaaaatataaaaaattagctcggtgtggtggcacacagctgtaatcccagctacttgggagggtgaggcaggataatcgcatgaagccaggaggtggagtttgcagtgagccaagatcgtgccactgcactccagcctgggctacaaagccagacttcgtctcaaaaaaaaaaaaaaaggaaaggaaatggaattttgggaatttttctctcgtggacttccccttttaatctcggtatcaccaggtttaattctacaggttttcccatttctcccttttgggcgttctccacacgaggggaattgggaaccaaggggaaagaaggttaccggggaaggtaacagagacgtggcgctaagattatcggaagggtgcaccttttcaaaggtctctggaggagaattaaaaccttggaagattcgggaacaaaacaaacacaaaagaaaaaaaacaacacttgtggtgggggcggcgaggggccctggaaaaagctcttctgaaagaccacaactcgcgcggtgggcagcggggagacccccaatagtgggatagcgcggacaccggtgggcaccaacacgggtgtgcccacagggagaagaaacgcgggggcaacgagagcaaaaggggggcggggggatgttcccacccaacaaataatagaaaaaagcggccgccggggggggggagcaccacaagagcgatggggtgtgtgagagaaaacatctcccaccgaggggggagggaggatcagaagggacaagcaacaacagggggggggaccaacaaaccgcacgaggggggggctccccagaggagaagaggccgcaagaaattacaaaatataagcg

SEQ ID NO: 547263 - DNA, 410 bp, Homo sapiens
tatccgggtacgtgcatccttccgggttagtgcatccttccgggttagtgcatccatgatggtgtacatatttctattatatatgttaagaagtttactggtgggtgcggatggctcacgcctgtaatctcagtactttaggaggctgaggcggatgagatcacacaagtcaggagttcgagaccagcctgaccaacatggagaaactccgtctctactaaaaatacaaaattagccaggcatggtgggcgcctgtaatcccagctactgggaggctgaggcaggagagttgcttgaacacaggatgcggaggtagcagtgagccgagatcgtgccactgcattccagcctgggtgacagagcaagaccctgttccaaaaaaacaaaaaagaggctggatgcacaaaccc

SEQ ID NO: 547264 - DNA, 222 bp, Homo sapiens
tgctcctcctccgaacccactcctagacttcaacatctccctggccatggtcatgagagaggtccatcagacaagcgcatcagcaaacggaccccgcctatagattgtagcatgaaacatgatctctttgcatcctcttagcgccctgtctgccacccagtgactggcagggccgagccagcagttccaccccacctttttccattctccccgattactccc

SEQ ID NO: 547265 - DNA, 516 bp, Homo sapiens
aagaaattgttttttttggactggggaattttcttctgcttcactttaaaagtgggccagggcaattatcatggctgcaagtaacttcaaaaggatggggaagtgcgatcttggcatgtgtcagaagaaatgaaaacatttggtgaagagcattaatgactgtctttacaggaaaaaagcaatcaaatagacatgatttcttgtttcagtttcatcatttcctactgtgttacctaaactttctgagccccagtttcttattactaaaataaaataatgataaagatgaaaaaaaaaaaaaaaaaaaaaaaaattgttggaaaggactttgacccacaacgtaacccttaagaggggccaataaaaagggctcgggtcgggggggtcgcaaagggggaccaccctggtgggggaacggggcattacccagggcacccagtgtgcaatcacccggaagccaagaattaccacaccaaggatacaccttgaagacacacctcaaacattttgaaggtc

SEQ ID NO: 547266 - DNA, 1061 bp, Homo sapiens
gttttgtctgcaggcggttccgcctttgcaacccaggtaaatacctgccgcgagaaataataccgcccgcgatcatgctggcgataataagcgcgacttcttttcatcttcattataacctggagtgactggctgacgttgaatactcctggtaataaagataaggtatgcccatgcgtgggacgaaacaagttaaacagccacctttgtcgcgcggattttgaatgttcagccatcgatttatcgtcgtgcggcggtgatgcgtaaagctgcagtggtcactctccaggccaggttcaacggtgagacaagttcgttaatcgctgaatgggaatggatgagtgttgttagcgtttgccagattcggagtaccgctttgtaccatcgccagatgtttcgcgtaattaactcatgatgggtcggtggccttcggttatcaattgggtctctcacgtgactggaatggctacggttaagtccttgggggccagattaacacggcattaatacagccgggctaaagagcgacggaccttggatacagatttgcgggaccatgtggccatggtttgtcgctgttaatttcgaccttggtactctcattctccctgggaaagctttataaagaggtcgagtatcctccgtaacattaacttttcctgaacgttttggccttgcgaacacgggcccgaaccataggctgagcgtgggagagtccctccaacggagaggcatttaatcactaaaaagtacagagtcgaaacttgggggcggttgaccgcgggacatccggccaagaaacctggcagggcgatccattcgcaaaccttgacgcagtcattgaacgaacgctaatattttcgcgttggttgcaatgcgcagggctacaccagagaatggcgacggaatcaccaaatacgcacacatcttgcgggtgtgaaccgcatggaacgcggggcatgtaatttcccaggcattccaaggtaacgagcataggtccggggcttggccacaaagtcaaaaggaacacgcttcgtgggatcctagagcaccgttcccag

SEQ ID NO: 547267 - DNA, 2633 bp, Homo sapiens
agcggggtggcttccaaggcgactccgtagtggatgcagcgccggacgccacagccgaaaaacagaatcttggaactggtttagtacaatccaggtcgagttccttgttttttatccgagtggccggcaggccatgtgctgtcttgtttttaacacatcagctcttgccggaagccgctaagagataaaataggaagtcccacccttcccttagagaaggaaaacggagagccgaaggagtcaatctaaattcgatgagcgcgtcgggctccaaggcaggcgctgtcagcccgggagggctgtctgggatttctagagggtcccagaacgggttcttcccaggccgatcccgcctgcttcctgccccgtctctccacccgcctcccgccctctgtaagggaccccgagggcggcgccggaaacacggagaaggcccagaacggcgcgggacccgagaggcctacgttggcaaacgcagcccgctgcccctttgctcgcttcccccgggcctggagtggctcctgtcgcttctggcgctccgatttcgagaaatgactttcagctgtgcaaggcgagaatgctactttagataatgagaaaaaatctctcgaatggctcccaaaatgaggtccttgtttaagaggccacaggaagccgccagccgaacgctgataccaaagaggaggccaagaagcggactgtggcttggtgacctgtttggtattgccaaattttcagcttttattaaagctgaaacaccttggctgtttaaaacgttcgacaaggacttttttatgaacgttaacggcacagcatacgggttttttggaaaaaaaaaaaagggcaggacttcagcccgtccgcccccttgtgcaggtccattcatgaacctcgagttagaggcctttcttctgaaactcagaatctagtagggaagacctgtgtagacgaataaaaataaatacatcacagcttgttaagtgctgtgacaaagaggcagtgaaatcctgcttgaggtcatctgccttgctaaagaggtttgactatgttgtaggcacagggttagggtaagactctgtaatgggaagttatgtgatcagatttctgtttaggaggatcactggccaggcggggtggcttacgcctgtaatcccaatactttgggaggccgagtcgggggatggcttgaggctaggattttgagaccagcctggggaaaccgcgtctctataaaaaatttgaaattagccaggcatggtggtgcgaggctgtaattccagctacttggaggctgaggcgggagaatagcttgaacccagtggcggaggctgcagtgagccgagattgcgccactgcactccagcctgggcgacagagcgagattccatctcaaaaaaatcattccaacgagtggataaagaaaatgtgatatatatgcactatggaatactaagccataagaaggaatgaaataatggcatttgcagcaacctagatggagttggagaccattattctaagtgaagtaactcaagaatggaaaaccaaatattgtatgttctcactcgtaagtgggagctaagctgcgaagatgcaaaggcataagaatgatatagtggactttgaggactcaagggttgaaggatgagactacacattgggtacagtgtgcactgcttgggtgatgagtgcaccaaaatctcagaactcaccactgaagaacttccccatgtaaccaaaaaccacctgttccacagaaactatcgaaataacacttttaaaactttactatttctgaataaaatttacatgcatttctcagaaaaaaaaatatttggaattgaggtatctaatagagaactgagttaaattattgccacttaaaaacacaaagtgatatagccactttgtgaattaatcagtcagcagtggctaggttatgcttagtggtttataaccaaatcttagtttataacaacaaatgtgtattgttaattcccactacaagtttataacgacattgctggatgctacactccatgtctctttgtgggacccaggctcatgggacttctgttatctgcattagagagagagaagacaacaaaatatgcactggttcttgaagctttggcccagaagtaaaatatgtcttttacctgttcacattgcattgggccagggcaattatcatggctgcaagtaacttcaaaaggatggggaagtgcgatcttggcatgtgtcagaagaaatgaaaacatttggtgaagagcattaatgactgtctttacaggaaaaaagcaatcaaatagacatgatttcttgtttcagtttcatcatttcctactgtgttacctaaactttctgagccccagtttcttattactaaaataaaataatgataaagatgatattcacttcaaggactttgtgttaactagggtaaaaaaattgaaaactgtagtaagttatgcaaattagaaatgtataatattactgctttgaaagtgatggtgaaatgtagaataattggaaggataacacaaagcacttataccaggaggcttttagctgcagataatagaaatgaacctccactactttaatcaataaaaaagtgtatcagctcaaaa

SEQ ID NO: 547268 - DNA, 558 bp, Homo sapiens
taacgcccaaactcatctatccacttaaaactgaatataggtcaaaactgttttctcaagtactcatacccacttcacaactgcacatttttagtcagaaccaacatggagaaaccacaagagtactcaagtcaaatgctgttcaatgagagagggcttgaacatgtatctggttgcacagcaactgtccacctactgatatttagaggataccactacgccatattacagacctgtcttttgcccatctgtctatccaacactgcagtcctgtttttaccccatatatctatccaacactttacagaaatactgaatatttcagcagggaactggatgttcttcttgcatagctcattttccaatgctccacccaactgaacccaacccccatgagaatctactgaatatttccatgagggaggggggaggaatggaatggctgggaatatagctgaaactgctataaagaaacgtgtgggagtctctatgtgcgtgtgtgcggatatgggtgtgtggctgttggttcttgtctccctgtgtgtagtgatgtgtgta

SEQ ID NO: 547269 - DNA, 117 bp, Homo sapiens
  misc_feature (36)..(36): n is a, c, g, or t
taccatggcattattgttcacaaccatactagtatncttcttcctgagagcaacagctcctgtctcttggaggtggtgggaactgcttttcctttggtacctacttcaacccccata

SEQ ID NO: 547270 - DNA, 1324 bp, Homo sapiens
agcggggtggcttccaaggcgactccgtagtggatgcagcgccggacgccacagccgaaaaacagaatcttggaactggtttagtacaatccagccaacgagtggataaagaaaatgtgatatatatgcactatggaatactaagccataagaaggaatgaaataatggcatttgcagcaacctagatggagttggagaccattattctaagtgaagtaactcaagaatggaaaaccaaatattgtatgttctcactcgtaagtgggagctaagctgcgaagatgcaaaggcataagaatgatatagtggactttgaggactcaagggttgaaggatgagactacacattgggtacagtgtgcactgcttgggtgatgagtgcaccaaaatctcagaactcaccactgaagaacttccccatgtaaccaaaaaccacctgttccacagaaactatcgaaataacacttttaaaactttactatttctgaataaaatttacatgcatttctcagaaaaaaaaatatttggaattgaggtatctaatagagaactgagttaaattattgccacttaaaaacacaaagtgatatagccactttgtgaattaatcagtcagcagtggctaggttatgcttagtggtttataaccaaatcttagtttataacaacaaatgtgtattgttaattcccactacaagtttataacgacattgctggatgctacactccatgtctctttgtgggacccaggctcatgggacttctgttatctgcattagagagagagaagacaacaaaatatgcactggttcttgaagctttggcccagaagtaaaatatgtcttttacctgttcacattgcattgggccagggcaattatcatggctgcaagtaacttcaaaaggatggggaagtgcgatcttggcatgtgtcagaagaaatgaaaacatttggtgaagagcattaatgactgtctttacaggaaaaaagcaatcaaatagacatgatttcttgtttcagtttcatcatttcctactgtgttacctaaactttctgagccccagtttcttattactaaaataaaataatgataaagatgatattcacttcaaggactttgtgttaactagggtaaaaaaattgaaaactgtagtaagttatgcaaattagaaatgtataatattactgctttgaaagtgatggtgaaatgtagaataattggaaggataacacaaagcacttataccaggaggcttttagctgcagataatagaaatgaacctccactactttaatcaataaaaaagtgtatcagctcaaaa

SEQ ID NO: 547271 - DNA, 144 bp, Homo sapiens
agggcggtagtcgaattagcctttatatcgaccgcttcgttaaccgcgatatgtttggttataccgttccgaccgcgatgttccagtcgattaatgccttcgcagttatgctgtgcggtgtgttcctggcgtgggtggtaaaag

SEQ ID NO: 547272 - DNA, 265 bp, Homo sapiens
cccccccccccctttgggggggggcgccaccccgcgcttttttgggtaaatttttttttttggggggggggcccccttggcccccccccccttgggggggggtttccaaatttggtttttttttttttgttttttaaggggcccccagggggggggggggggggttttttttttttttttttttttttttcccccctccccccccaaaaagggggtttttttggttttggttttccccttaaaaattttttgggttttgggggta

SEQ ID NO: 547273 - DNA, 386 bp, Homo sapiens
attctaagtttaaatcttagactagtaactaaacaggattaacggagacaagtcttgaagaagcacgttcaattcagtttggacgttaagcataatcgttaccagcagtaataccagcctcttggctattgcgtgaaacagctagagccccgatctaagtccgtacggagtcggaaacggaaccctaagaacataactccgcaccttactattgggatagtcctaatatagggcttatagtgcggggtaccctttagcgctcacttgatagttctccaaagttatagttcacgcgagcttaattgcctaaggtagtagcaatacgttcccactaaatggtccatagtcgcaccttaatataggaacttttatattgtgtcgtgtcc

SEQ ID NO: 547274 - DNA, 182 bp, Homo sapiens
gatttcttcatatgtggggaactgccaactcacactctccccagcaatacaaataaataagtaggctgggcacagtggcccatgcctgtaagcactttgggaggccagggcagtaagattgcttgaggccaggagttgaagaccagtgtgggcaacatagcaatacctcctctctaccaaaa

SEQ ID NO: 547275 - DNA, 663 bp, Homo sapiens
tgggggagttgagatcattaatggggatcgtaaaataaagggttttcaacactggggaaaagcccggttggatttatagccccaccagatgatgccaaaagtccggggagccctgtttggggcaaatgccaccagaagttttttggactaagccttcagagggtggagctcgtcgtcagctctcctgctgtgatgtggaagcttctgatatttgaagaaaccgaatgtctctgtagcttcctcttccctgccccagtattgctctggatttatcagcgatgcccctctgtcactcatgccctgcctaattgttcccaatggtggaaagcttcatgtaatatgatccgggccccccccccgtttttttgaaagtgtgacagtgtcccaccggtttttcagccctaggggagggggcagatggtggttgcatgggcttcctgggtctcccctctccgtctggcctaaaggtgatgtatttggtgtttggccccgccgtcccccctctttagggttaaggggcatgtggcccccccctccttcccgccgtagtcgcttttctgttacccggttaggcctagaagttttccctcctctgttaatgtggttttaaattttagccctgaatatgctttttttttttaaagagttttgcgggttttatgt

SEQ ID NO: 547276 - DNA, 121 bp, Homo sapiens
tccagtcgtcgatgagcttctgggcagacttggtgacctgccagctccagcagccttcttgtcgacagctttgacgagggcagcgtgtcagagtctgagtcgggctcagtcgaacggactg

SEQ ID NO: 547277 - DNA, 719 bp, Homo sapiens
  misc_feature (41)..(41): n is a, c, g, or t
  misc_feature (579)..(579): n is a, c, g, or t
  misc_feature (656)..(656): n is a, c, g, or t
  misc_feature (678)..(678): n is a, c, g, or t
  misc_feature (687)..(687): n is a, c, g, or t
cattccttctgaaactattccaaacaacagaaaaagacggnctcctccctagctcattttatgaggccagcatcatccttataccaaaacctggcaaagacacaacaaaaaaaagaaaatttcaggccaatattcctgatgaacatcgatgcgaaaatcctcaataaaatactggtaaaccgagtccagcaccacatcaaaaagcttatccaccatgatcaagtcagcttcatccctgggatgcaaggctggttcaacatacacaaatcaataaacataattcatcatataaacagaaccaatgacaaaaaccacatgattatctaaatagatgcagaaaagaccttcaataaaattcaacatcccttcatgctaaaaactctcaataaactaggattttgatggaacatatctcaaaataataggaactatttatgacaaacccatagtcaatatcatgctgaatgggcaaaagctggaagcattccgtttgaaaaccggcacaagataaggatgccctctatcaccactcctattcaacatagtattggaagttctggccagtgcaatcaggcaagnagaaagaaataatggggtattcaaataggaaggaaaggaagtacaatttttttctgtttggcacacaacatgattgnatatttagaaaaccccatcggncttcttcanctcaaaaaacttcctttaagctgattaaagcc

SEQ ID NO: 547278 - DNA, 355 bp, Homo sapiens
  misc_feature (82)..(82): n is a, c, g, or t
  misc_feature (92)..(92): n is a, c, g, or t
ctgttttctcccgatgctcctgttaaagatgccttgtcggcagaaacaaagtggctgccagtttattaaaatgcctgacaantgcaacttcncagtacccgggccttgcatataaataacggagcatacagtgagcacatttagctgatgataaaaacccctttttttcccttttccccctaaaaatggtaaatttgatcaaatttacatgtatgaacttaacatggaaaatgttaaggaagcaaatggttgtaactttgtaagtacttaaaacatggggtatttttttggttatgaaaattttgtattaaaaccattgtttttgtagtttaattaaaacatttttttggtgtta

SEQ ID NO: 547279 - DNA, 118 bp, Homo sapiens
tgggggtccacatccactccaaggggactatttcccccggaccccaccccagtctccccacacggacctttgttgaattaaagtttgtaagtaaatggttttaaagaaaaaaaaaaaa

SEQ ID NO: 547280 - DNA, 122 bp, Homo sapiens
tgcagaccagtgtctcctctccctgcactgccagctcctactgtgcatcgccccatatatactgggtgtgtatgtgtgtgtgtgtatgagtgtgtttaaaaaatctgtcccaccacacctgg

SEQ ID NO: 547281 - DNA, 1405 bp, Homo sapiens
  misc_feature (259)..(259): n is a, c, g, or t
cttggttatgtagtggtaggctactcactcgtgtatcaaaacccggtgttctctcttatattatcgctgccgggtttactcttccaccagtgctcgtgttccctggttgttttgggcacactctaatacacgtgtttgcaacaacacgcagtggttgtccgcgtcccagtttctcctcgggttttttcgtccgacccactggtgctccccgagccgctgtggtataaggttgtcataacccgcctctactcgttgttanacaccgacgtgtaaaaagagtggttccacagcagaaaagatgctcttgttaggagaaaattgcgctcaccggaaagtgtgggcgtccccaaaaacattttggttttttggaggggtgaatttgtccacacgagatttagggagcctccacaattggggctttataatttcctctggggaattctctttgtcaaagggactcccacagagatttaattttgaataagaggagttaccactggaaatctttgtggtctccgtaaaatatgtaccaacccggtagaaggttctcaaggataagggaatgttaaagctccaaaaggaaccttggtgtaccaactatgaggggggaaaaatggggaactctggggaatatggaaggggccccacgagctgatgttatggttttgtttttgcctggtgtcaaagattccaccacatgggtactatgaggaaaattaaagtttaataatttcacggaaaccttcccccccacacccctatgaacactgggagaaacccaagggttacctggtccctactttgtccacgcactcaactgtttcacatcctgtaaaaggtcacctatacttggaacataataattgttttcttttgtaaaattttgcccacgtggagcttttatgaaataacaccacccgctttgttccgcagactttttccacaaaaatttgagatttaaatgggttgttaataggaataaatattttgggagaccccacataaccgcttaggccctctggtaatgttaataacccaccacctgtcccaagagtaaaacacacattatggtcacaggcactggtggctcacggcctgtataatcccacgcctttttgggagggctgagaggcacaagtggagtaaacttgaaggtcacatgagagtttctgaaaaccaccgcctggcccaaaccaccgtgtaaccccgctctttatcttaaaaataccaaattagccacgaatgtggtggcgcaccacacccgtaaatcccacgctactcacggaaagctgaggcacgggaaaatcgcttgaaacctcgggagaggtggaaagttgcacagtgagccgagatcgcacccctgcactcccagcctgggtgacaacagagcgaaactccatttcca

SEQ ID NO: 547282 - DNA, 347 bp, Homo sapiens
aaagtctgatggtagaaatccaatgaaatgggagaaggcaggagagagaggtcatcagtagatctaagtcggcttgtttgggttgaggaggagagaacccgaggaaatgaccatgctctggggacaggggtaccttagattctctgtctatttttcctctagcaagccagctgtgctgaagcccagtagagatgaagagacaccagccagagaaaaccccctctagaaggaatgtatttgttgctaaattttgtagcactgtttacagttttcctccatgttatttatgaattttatattccgtgaatgtatattgtcttgtaatgttgcatagtgttcacttttta

SEQ ID NO: 547283 - DNA, 302 bp, Homo sapiens
ttttggggcggggggccttttttacccccgggcctaatggggggtttcccttttgtttcccccccggggcccccaattttttagggggggggccccttttgggggcccccctttgccccccccttaaggcccccccccccaaccttttatttttcctgggggtgcccccccgggccccccttggggccgggttttttccccccccgcccctttttcggtttttttttcgggcaaatcccccggggggggttttttttttcccctggggggcctgccctcccccttaagccttttagggccca

SEQ ID NO: 547284 - DNA, 210 bp, Homo sapiens
tgcattccagctcacaccctgactccaactccccacaagcatgtagatctcccagactcatccaccttggaatccaacatccccaccaagcatgtagatatcccagcctcaaccaccctgactccaactccccaacaagcatgtagatatcccagactcatccacctaggatccaaatgcccaccaagcatgtagatatcccagactcat

SEQ ID NO: 547285 - DNA, 453 bp, Homo sapiens
tgagtggtctctccccgactccagccggggttttacttgcttggcaactccagttttccctgcctttgatgcacagtatggaggctccacgtggacgtccaaggctccatgcagtgctcctgactgtccgaagtcatagagcagcttttctcaggtggctcctgagacgtttctttgtttttgttttgttttgttttgttttgttttgttttgttttgttttgagacggcgtctcgctctgtcacccaggttggagtgcagtggcgcaatctcgactcactgcaacctctgccccccaggtttaagcatttttcctacttgggaggctgaagcaggaagattacttgagcccagcaggtcgaggctgcaccaacccatgattgcccccctgccctctagcctgggcaccagagtaagcccctgtctcaagaaaaaaaaggaagagagaagcta

SEQ ID NO: 547286 - DNA, 527 bp, Homo sapiens
gttccccgcaggaactgagtcagaccccatctcagggccctgcacaagataggtgcctgctctaaggcgtgcaccctcgccacagccctggcccgtcttgacgggcgagggttacttgtacttgtcccaaccatacaggatgatgaaagctgaagactcaggtggccatgcaaccctgggtcccagctggagctgcccggcacacgccgacacttcatgcaccagtggcggtggccaccacttgtgctgcggagatggctgctgactgcgtgcgcagatctcggatcccgaaagctcccctcctgggccaagaatctgggaccccgaatcgcacccgattgcgtccgtgtttcctgctggcccgctggcccagaggcaattacgtcatggaaggggtccctccaaagtgaatgaaggcccatggcccttggccaccggggacaggccggaacggccctgtgcctttcggacttatacagaagtggccgtggtattttcgcaatggaaccccggattcctccttggtc

SEQ ID NO: 547287 - DNA, 209 bp, Homo sapiens
  misc_feature (1)..(1): n is a, c, g, or t
  misc_feature (24)..(24): n is a, c, g, or t
nttttattactgagaggctacaanatctattacgcgaggaactcctcctcttcctcccaccacaaccttttagaaagtggagtctgtactcacttaacatcagtatgccagccactgtgtgcccacgggaagactcgcactcctcctgcacgagtgggtgcttcacccccaccccacctcctaggtcgggagggcccctcgttaagctt

SEQ ID NO: 547288 - DNA, 796 bp, Homo sapiens
gcgtgtactttcaatgctacgttccccatagcgtggtcctggtcgtgctgcggtggtgcggtggagtgtgtgttgtctggcgccctggagtggcttcattaactatctcaagcctgacatggtcaaagcatggggtcccgctcatggtgtggatagcatgcgtggagacgcgagattttctttgtcttacagccattggcacttgggggcctcgtcaacaagtcctgggcagttacgagcggctttaacaaataactggttacaaggacagccatcaatcctggcgtctcgatcgaacgagtgggacgcagcttcatttagcgtggcttacgtggtcttctcacatcctgggcttcaatggcttgccagagcaggcggcgtgcagcagtctccaggggtggcacgagtcagggccgtggcctgggcttcattcgcctatccctgctgggctgtcacgctgatgccagttgggcccgctctgggctgcccttgtttcttcttgcattgcttgttgcttgcttggtctcgatcagccatgtgttgtaggtggtaggagggcgttcatcaccggcgctcctcgacctcctcccgggctcctactacttccgtttccaaagggagatctctgtggccctctgttgtgccctctgcttttgtcatcgatctctccatggtgactgatggcgggatgtacgtcttccagctgttttgactactactcggccagcggaaccaccctgctctggcaggccttttgggagtgcgtggtggtggtctgggtgtccggagctgaccg

SEQ ID NO: 547289 - DNA, 1611 bp, Homo sapiens
ctagctagcgtctgcaggccagcccgatgccagtggagtagggctccgcagtatgctcattctctaccgacaggttgtacagcctctgtaccccgactgcacagggtctatgccacctatactaccgagggcctagtgaccagactaccctataccctaccccgtatgtacctagtaccaccacatgccatatactaggcgagactaggcgcgcaacctaggtactacaacggcaggaccctagccagtatccatcaaagcaagagtgggcgagcgtactatagccctcatatatggccccaacaccacgatatatcctatcagatccactaagacactcatactaagagatagacacatactaggaggcactaccaacagcccccagcggcacaagacacacatgagacacatatacataccaatatctacccaccacgaaacccaacgcgctctccccacgctctccccaatctccacgaacaacgccgtctacgcgcgggcctaacgcgtttcccgtctgccccaggacacgtcaccttgcgcacgccctggagccccacgaggtcgcggcacctcactagccgctcaaccgcgcaactctcactcatcctcagacacaccaagggatcttccacaccgccacacacccttgacgcgagccccacaccagctccctccgcctggaaacatatccacacctcccgcctcccgcaccacacgtcaactacggtgagcacgaccgacccaccctgcacgcgcactttggacacaccgccggcagccagcaccaatccaacaccacagcggctcggccagccgccgcccaccccccccagccctgtggccggccatcacacaccctcggtatcacacacaacggcacaacacaacacacaacttgacaattgcgactattcaccgctggactcaaactcaggcctcgagcgccgcagtacgggtcaccctccctatggcgtgcccttacttcacacacgaccttcggccacgaaagccggaggcaagcaaaacgggtggcgcccttccgcccgaagcccccatacgcttccacagtccccattcgcccaatcccccccactagcaaaagcacaccaaccgcaactatcacacaaccattgtaaaaacaactcaacagtcacccaaactaaacacaacgcatgaccaataacacctctacaaccaccatacctaccccccatccaacaaaacatccaaacaaaacacaaaacaccccacacaataaaccataaatccacatacaacacaataacatgctaccacgcaccacccaacccgacaccgcccagcacggctactaccactagaccagcgacatacaacaacaccgaaacctggtgcctgacacaccatcatcccaatacctccgccacacgacccctccagatctacccctggaccaggacatatgaccaggagactcccagcggcacacatgacacacgccgacacctccgcgtaatccacaacaacccgccaacccactaatacacccccgcgcagccaaacgaccaaacccatacacatcacttacacgaccacacacacatgcgaaggagactcactagatac

SEQ ID NO: 547290 - DNA, 860 bp, Homo sapiens
ggcgtggtgagcgagaagtgccgttgtcgacacggagatcctgccttccctgttcatgcgctggaccaccgagcttaatacgaaggacaagttgcccggcatcacccacctcaagttccgtgtgcctcgtggtacctgtctgcgagcagcgtgcattatgtggcggcgtccagtgcagtatccacggagagtactctgttggtaggtgtctgtgtgtccctgccgacgatggaaggggcaccatcaccgcgcgatggatagcgaatcgatcttcgcatgcagcatctcccccgtggttggttgacgaaacagtcgccacaattctcaaatggcgtatcctatcggtcaacaacgatctggaccgtgtgtcgggcgtggactgctggccatgacttgcccatcgtacgctcatccagacactcgttgctccaggtggccaagcgactgctcggtattctagccctgtgcctcgaggctgtttcccttggccttccactgaacgtgcgagtcgtccttcgtccgttgcaccggctctcattgcagaccatggccgtcttctacacgctctgctggccccgaggcctgtggatgagccggccatgaatgctgcccccgtccaccgcgtcgccccgtccgtccacttagaggctatgcagctatcgtggacgtcactggccctggtggggattgacagcacgtggcaagctgagcgtgctccgctctcaccttccatgggccacccgctggaacgtgggggtggcgctgcggcgctgctcttctgctgagtactgcatgttgccggtacgactgggggacatctgctggcgtgagccagttggcccagagctggtggaagctgc

SEQ ID NO: 547291 - DNA, 567 bp, Homo sapiens
  misc_feature (363)..(364): n is a, c, g, or t
  misc_feature (372)..(372): n is a, c, g, or t
  misc_feature (454)..(454): n is a, c, g, or t
aaagaagaatcaataaagactcatggcttgaagcctaacaatagataagatagagctgccatttagtgaactgggacaggagcagttttactgagggaagatgagtttcctttttgagtgtattaagtctgagatgcatattagacatccaagtggggatgtcaggtatgcagttggatcaggggaaaggtccaagctggggctatcaatttggaagttgtcagcctatagatgatatttaaagctgtgagactggctaagatcacagatcagagcatgtggatggacagagcagccatcagaggggaccctcatactaggtggtctgggaattcagaagaaccagcaaaggaggctgaaaannggtgaccnctgtgagacaagacctagcagaatgtaatgtcctggaagtcaatgaagagtattccagaagaggtttatgcatttttttttntatgctaagaataaactctttttttttttatcctggttgttgtgtgtaacgtaattagttcatttccattgttgtataatattccagtatatgaataaaccatacttattatt

SEQ ID NO: 547292 - DNA, 137 bp, Homo sapiens
atacatataaattagctcgtaccaggatcttgtcacctcaaagcacttgttatgttgggagtcttagatagcctttcgttggggggttgggggggaaacataatgatcagggccccctcacacctcattcctgcagt

SEQ ID NO: 547293 - DNA, 110 bp, Homo sapiens
ggtcgactcttgaggactccccctttggtacttagaagctcacctgggctctggtgcggctggctcttacggtgtatccccaagtccccggtgaatcccccggtcgaccg

SEQ ID NO: 547294 - DNA, 110 bp, Homo sapiens
gctcttcggtccctcagcacatctccagtccacatctccagtcctccagcacatctccagtccacatctcccagggggggtcaccgcagctcgcaattcgtcaatccagg

SEQ ID NO: 547295 - DNA, 190 bp, Homo sapiens
atcccgagcctccaagcgaaaggaagtgccgcgcgcacctcagcctatgggcctggctgccaagactccgccattggaaaccgagccaacaggaagccagacgtgcgtgaagtaccccattgatcactaatgcgtacaggagatgcaaccaacctgagccccagccagcacatgaaccaacaccccagac

SEQ ID NO: 547296 - DNA, 117 bp, Homo sapiens
ccattctcattcggaagaaaacaggaaaggtgtcccataaacaagttgcagcagaattgctggatagggaagacgccagaaatgagatgttagagggagaaatgatatgttggaagg

SEQ ID NO: 547297 - DNA, 237 bp, Homo sapiens
cctcagctcggtaccgacaccaattgatcctgtagaaagcatacagaaacaaaatggggaaaggacacattatctaataaatggtactgggaaaactggatagccatacgtagaagaatgaaactggatccctagctcccaccttatacaaaaatcaactcaagatggattaaatacttaaatctaaaaccaaaaaccataaaaattctagaagaaaccataggaaaaacccttctg

SEQ ID NO: 547298 - DNA, 176 bp, Homo sapiens
taaatctgtacatcgctgctcttcctcgagcaagagtagaaggtacagctgaagtcgcctcactacattacatcccctcttccctcctggacacagcagtgtgatgcggtcaatgggatattagattttggtagatgtgggcagacgtggcagctaggggcaaggaggacaatgta

SEQ ID NO: 547299 - DNA, 101 bp, Homo sapiens
tttcagcatgtggcaggctggtctcaaactcctgacttcaagtgatctgctcgccttggcctaatctgttcatattttttgtagagacaagatttgccatg

SEQ ID NO: 547300 - DNA, 396 bp, Homo sapiens
gaggatccccactatcatgtggtctacaggaggtggctttttagacatgactgttgtagatgtacctgcgggaaggttagccagcaacttcaggtcctgtgaggtatcctgctgtttgtgactcagaaatgaacaaatcatgtttctgatctttgaaggcactccagactgaagaacggcacaggatttcattacctgttctccatactgcaaacttcgagtcattgccttgagagctttaacaatctgagccttagtggctgctgggctgtccaggttttcaaggccaatgccttcgagtaattttaagaggtatggaaccaaatctgctttcggggcctgtgctactaattcactctgctccttctgaaacattcgattagttgcttcacaggc

SEQ ID NO: 547301 - DNA, 84 bp, Homo sapiens
gttgagatctcagtgtaacaggactctcctggaggctgtctccgggccctccccgcggccgacgtcgctcgcttctctccccgg

SEQ ID NO: 547302 - DNA, 577 bp, Homo sapiens
agaccttgatgaaacataaagagccctatcaaaaaccagatatcaaatcacatcctgcttcaacaaccaaacagaaatacgcagtcgaggaactaggaatgtaagtaactgcaagaagcaagaagtgctgaagaaatataaatgggcctatcaaaatccagacaccaaatcaaataccacttccaaaaagaaaaagaaaaaccagttgaattagtcagcaccactaactcattccaaagcaaggaccacctttattttctcatgtataaggccagggctgaccactctcccttctttgaacccagccactacgcctctctaacccaactcgtactctgcttaagtggttttagtctttaaaagaacttggcttgggaaagagcaataatgatccgaagctaaccacttagctcattagtatgtcatctagacaggcacaatcaattccaacagcatcgagtaagggtattccctccccaaaaggtctgcgctattaatagcaagaaagttcccaggctatggtatattagtatcccaaaagctctgacacagaactggcatctcacttctgagctcc

SEQ ID NO: 547303 - DNA, 173 bp, Homo sapiens
ggccaggctgatctcgaactcctgtactgcctcccacagtgctgggattacaggcgtgagccaccatgcccggccccaagtgtattcttaagtggatctgaaccaagatctaactggtaaaagtccaaattcttaacctacatggctgcccttgactctgcaaggaacccacg

SEQ ID NO: 547304 - DNA, 882 bp, Homo sapiens
  misc_feature (358)..(359): n is a, c, g, or t
  misc_feature (367)..(367): n is a, c, g, or t
  misc_feature (392)..(392): n is a, c, g, or t
  misc_feature (761)..(761): n is a, c, g, or t
  misc_feature (809)..(809): n is a, c, g, or t
  misc_feature (852)..(852): n is a, c, g, or t
  misc_feature (869)..(869): n is a, c, g, or t
  misc_feature (875)..(875): n is a, c, g, or t
gggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcaggttctgttgtaggaagagaggnngaggcatnccctgaattccacgcatctgctggnaacgagccgtgtcagatcgcaacaatgcccatgcagcacacacacaatggcacctcccatgccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggntactgtgatgatggctgcagtccagttttatgattctgcttttatgtngtcccgttgataacagtgacttaacaatatacattcctcatanataaaaaaaaaacaagnatttgnattctta

SEQ ID NO: 547305 - DNA, 882 bp, Homo sapiens
ggaccgggcggctcggaggacccatggcggattcctcgccgcactgtccctgcggaaggcggccccggcgcggggcctcggcccttcgcgcgccgggccaggggccgggttccgagtccgaggaggcgagctgtcgtggagcgtggccggacaaaagacccgctccgtagggaagcaccgccaagcgtggggggcccgtaggggcgcgggggtatgagaggcgcatggggccgcaccggggctccgggggggaaaccagggtggaggggaaatcccgcgccacaagtaacgggggtcccgcatgggacccagtattaagggggccattacgctgttcaccactggtgtgtatcttgctggacgaacacttgtgaccttccgagtttattttcaggagaacgccttgggggtgaagggactaaccctcattggtttctccagaaatggaccgtggcgtgttaaccgcttctccaggggaagaggacccacggtgggggccgggaagagacactccgttctaccaagtcatcaggaatttggatgtacagcctgtgacagcttggaggatgtgttcagcacaagagatttcctgaagagagattgatttggcagaattagtttataacaccggcacgcaggaggtaaaagagaagagagttgaagatgtccctatggaatttcctttacacaaagtaaggtgattgggggcattattttaccaaattgagatttgttggcctaaggatcacagtggagattaaaattctgggatctatgtgcacttaactcaactggagttactgggatggcgagtaagccgggtataataactataggagaggaggggacaagaactggggggggagaggtaaatgcggacag

SEQ ID NO: 547306 - DNA, 677 bp, Homo sapiens
  misc_feature (358)..(359): n is a, c, g, or t
  misc_feature (367)..(367): n is a, c, g, or t
  misc_feature (392)..(392): n is a, c, g, or t
  misc_feature (630)..(630): n is a, c, g, or t
  misc_feature (647)..(647): n is a, c, g, or t
gggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcaggttctgttgtaggaagagaggnngaggcatnccctgaattccacgcatctgctggnaacgagccgtgtcagatcgcacatgccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattcctggatggatcacttggaacttcgttggggtgttttggaggtctnggggtggaactgcgagnagctagagtggggggagcgccggcggtggg

SEQ ID NO: 547307 - DNA, 221 bp, Homo sapiens
atctaaggatcccggagccttaaccttatgaaggaatcattagttcagataaaacatctgatgactgagatggaacaaatagagagggacttgcgatgtatatccaggtcaggcactttcaatatctgactttgttgattcactttaagggttaagggtccggggggtaccggagggtcgactacgtacatccatggtgcattagctaggtttcctggtgt

SEQ ID NO: 547308 - DNA, 386 bp, Homo sapiens
agtgcaggtaaggttccccatagaccatggctgaggcacagacaggcaggacactggacacagctgtacaaccacagaggtcacgctcagtgtggtccttgaacagcgctcttcccacttgagaggcgtccaagtaaaggtggcaccaagagcatctctcaggccagacagtgtgcacgtgaagttcacttcttgaacctaagagcaagtcctcgaggtgcctggtcgttgcagcgacagtcagggggtggcaacaataggaggagaggttgagggaactggacaagggcacagtcacatccttggtgggattcgtgtagtgctatcacgtggcatgtcaacggacttgccatctgagacactagtagtagagccggcaaggtcaa

SEQ ID NO: 547309 - DNA, 882 bp, Homo sapiens
  misc_feature (358)..(359): n is a, c, g, or t
  misc_feature (367)..(367): n is a, c, g, or t
  misc_feature (392)..(392): n is a, c, g, or t
  misc_feature (761)..(761): n is a, c, g, or t
  misc_feature (809)..(809): n is a, c, g, or t
  misc_feature (852)..(852): n is a, c, g, or t
  misc_feature (869)..(869): n is a, c, g, or t
  misc_feature (875)..(875): n is a, c, g, or t
gggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcaggttctgttgtaggaagagaggnngaggcatnccctgaattccacgcatctgctggnaacgagccgtgtcagatcgcaacaatgcccatgcagcacacacacaatggcacctcccatgccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaagaatagaaggaggataagaaagtggcccgggtgaaggcgctatatgagcaggagagggacttcgttggttttttggagtcttggttgtgactccaagagcagagtgaggaagacccccaagcatagactcgggntactgtgatgatggctgcagtccagttttatgattctgcttttatgtngtcccgttgataacagtgacttaacaatatacattcctcatanataaaaaaaaaacaagnatttgnattctta

SEQ ID NO: 547310 - DNA, 957 bp, Homo sapiens
aatttcggcgcatatcggctcatcggctgcgccggtggttttcccatgtggcgaaaacggttccctccccgcctgtcgtcttcgagtaacccggcatttccgcccactggtttggacgccccaccgtttggggtgaccgctgtggcgacgaaccacgggcgccgaggtgtccgagaagtctcccgcgtggggccccccgcccccagcggccattggtcagccgggcgccgtccacaaccacctctttttgttcgttttattttcgcgcccgataattgtgctctttgaaagccgtggcccccacctcttctcccgatttgtgcccggagaagccccgggcttacggagctttctcccttgagaatccgcaaacccagcgtcgccggcccgccggttttttctccaaggacaatcccagagacgcccccctggaagaatgaagtggggggtaaacaccccccaaccgcgcccccttgaagcccttccccccggcccccctgtgaggaaaagcctgttaccccggcgcccctttggagactcttcaaacccgcggggggtgctgcgccccgaccggacgccccactactctctgggaccctccgctggggagacactccctctccctatataatgaggaagatgaagcgattattccaaagagaatgggggaccaaacaaggagcccacacccccaccagcgttggtgtgcccccgaggcattggctgggccgaatatactttcttcacgaaggcgtcaccatcttccagccccgaccttagaccgcttcttgagaccgccccccgacagttttgtaagggccccctgcccaaaattataaggggttctcttcccctaaactcctctcttcccctcccacaccaccataggcgaagcgcttttttaaatccccccaaccctgggcccaaagggaaaaaaacttttttaagcccaaaaaa

SEQ ID NO: 547311 - DNA, 707 bp, Homo sapiens
gtattcgataccgcatcgccaaaatggattgggtataatgcatgcgcctgtgcttccagcttgatgtgaagctgaggtgagaggatctcttgagttcagaaggttgaagctgcagtgagctgtgactgtgccactgcactccagcctgggcagcagagccgctatgtctggtcatccaggttttgcagtagcgaattctgactcgtctttttaagtgctacgtagtccgtgtgtgagatagagagacgcaggtggcacgaatctcatgatcaccgggcaactctcactttctctgggtacaaagatgatttctcctaacctcagcctcctgaagtaggctgggattaccaaggcacatcagccaaacaaaaactggactacgtctacataagtggtaccttccgcgtaagggaccatgggttttctagcccaagaataaggggcgcttcggctcaggtcctacaaaactgtcctggaacctgcaggagtagaattcttagacttgaagtacgggagacttccacaaaaagttagtcttggagataaacaagcggcataagaggagacaccatacccaccaggtatgacatttacgtatttcttatcgctctacacactcctcattgcgctccccacctcttttcttcttctcgacctcttcgcatcccatgcgaatattccttctgtcaatcttcacatcagataca

SEQ ID NO: 547312 - DNA, 128 bp, Homo sapiens
acgatatacggtcatacctgagaaccaaaatgaacgaaaatctagtaacgcttcattcatatgcccccacaatcctaaggcctacccgccgcagtactagatcatatctattaaccccctactatatg

SEQ ID NO: 547313 - DNA, 121 bp, Homo sapiens
accgcctaagccgagcaccttattctcacaacggcaattattcccagcgaggctcgcgcggcagcaccccatccaccacctcaagctcagtgccgatcaagcggatgccaagccggtcggc

SEQ ID NO: 547314 - DNA, 385 bp, Homo sapiens
  misc_feature (358)..(358): n is a, c, g, or t
  misc_feature (360)..(360): n is a, c, g, or t
  misc_feature (367)..(367): n is a, c, g, or t
  misc_feature (370)..(371): n is a, c, g, or t
  misc_feature (373)..(375): n is a, c, g, or t
  misc_feature (377)..(378): n is a, c, g, or t
gtcgtggtctcgagcgcagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggtntnaaaaaanaannannnanntcgtagc

SEQ ID NO: 547315 - DNA, 734 bp, Homo sapiens
ctctgcccagctgggcccagctgggtctgccacctacctgttcagtgtcccgggccgtgaggatgaggccgcatagaggcctgaggatgagctggcaaggcagtgagaggggacaaaacccaacctgtgttgggagcctgcagggtggtgcttgggactgagccagtcccaggggcattgtatggcgcctggaggtggggttgggaattgggggctggtgccaagcctttccttcttgcagtttggaaccctcttgtgtgttccctccccctttgtgggccgggcttgaagaaggccccccaggtgtggacctatggggagaacttcaccaggtttggtgtgggcccttcgcggggcctttccgcccccaaagaaatagacaaacagcacaaggggcagccaacatacaacacaccacagagacacatttttttttgctggagcacaagacgtaccgacgacggccccttatcagcaacaaaaccgcttttcggctaaagaccacaccacttcctcgatgaggcaggcgcgcgggggtacccccacagacaagcgctttacaggccaggaccaatggtcgcgcacacacgcggggttccccacacaagagaacaccccgggggcaacaaaaccacaaaacgcgcgtggggggaatcctcccccgaaattatagaaacacggccccggtggaacacccgcgagcggcctgttctgagaaacaaaactcgcgaagc

SEQ ID NO: 547316 - DNA, 603 bp, Homo sapiens
tgtccccgggaggcggaggttgcagtgagccgagaccgcaccatgcactccagtctgggcaacagagtgagattccgtctcaaaaaaaaaaaagaaagggaaaaaaaattagtttttaccttcctttccttgggttctcaaccggccatggaaatttcttggaacactctccaaattccaggtggattacttccaaaacaaattttatacaggtattaaaataattttcactttcttaatagtaataggtatcacttaaaaaagcggctcggggtaatagtaaatcttctaaacaggctacaattccaggtgccagcgttacattaacccacacttatggtccttctagttggaagaacacacttagggcctatatttacacttggcctggtgtacgccttcaggtggccttaacgtgggggtggccaaattaaatttttccggtagaaatttaccctggacttgggtaaaaccccactccggtttgggtttacattggccaaaaacttcttcaaaagggcctcggtattcatctgtacgtccttggaaactcatcactataacttcgggattcctcaggtaatgggactgctgggtggtgac

SEQ ID NO: 547317 - DNA, 129 bp, Homo sapiens
atgcaatcattttctatttttgtatatagagacacagagtctctctgggttcgccaaggctggagtgcaggggcataagcttggctcacggcaacctcgtgcctccataaattaaagtagattctccgt

SEQ ID NO: 547318 - DNA, 244 bp, Homo sapiens
ctcgtccaagaagaagatcttcaatgggcctcatcccctacgaccagagcggcttcgtcagtgccattccggcaggttcattcaccacccgcaagcaggcagttgggaccttggttggttgtcaactcaagggcccagttccagattcgtcaacaacaagtttcttggcatggagttggtgtcattggagttggcaggagcccaggcctgagccaacagtcggtccaagaggtggcttccattc

SEQ ID NO: 547319 - DNA, 1115 bp, Homo sapiens
  misc_feature (5)..(6): n is a, c, g, or t
  misc_feature (50)..(50): n is a, c, g, or t
  misc_feature (701)..(701): n is a, c, g, or t
cgtcnncggtcatctccggcgcttctagggctggttcccgtcatcttcgngagccgtggagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaacaaggccagcctgccaggagtgaagaaagctttgggcaaatatggtcctgccgatgtggaagacactacaggaagtggagctacagatagtaacagatgatgatgacattgaccctctttggatctgatgatgaggacggaaagtgaagaacgccacagaggctaagggaacgaaccgtcttgcaccaatatgaatcacagaaagccaaaaaacctgcacttgttgccaagtcttccatcttactagcatgtgaaaccttgggatgatgagacagactatggcgacactcagaggacgtgcgtcagaagccattcaagcagacgggcttagtctggggctcatctaacactagttccagtggcgatacggaacttcangaaacttcaaactaccagggtgccagctcgcacgcatgatcaaggtggccacacactatgcctggccggtgacgatccctgcgctgcgaggacccagtgcaccagtgacgtaggcgcgaaccacacagacctcacatcacgccggaatcagggccgtcacacacgctcgcccacccacccatacaaagaggcgaccgcgcaaaacccaggggagaccacatacgcgacacccaggcaagagggtcacacggcgagcgtaaacaaaagaacgcgcgccacacccgggagaggaaacgccaagacacgggacacgcaaccgtgcgtatacaaacatccaacgacgcgataaatcatgagagacagacgcgagtcgagatccctgaaccaaaccagacaacgacgaggccaacagca

SEQ ID NO: 547320 - DNA, 1111 bp, Homo sapiens
  misc_feature (697)..(697): n is a, c, g, or t
tacttattgtggttctgacggtagctgaggcgtggcatggtgatgatgtgcgaggtccacaatatagctcggctcgctttcttgctggatccccagactctcgagactgcagtcgatcgaaccactgggattcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaacaaggccagcctgccaggagtgaagaaagctttgggcaaatatggtcctgccgatgtggaagacactacaggaagtggagctacagatagtaacagatgatgatgacattgaccctctttggatctgatgatgaggacggaaagtgaagaacgccacagaggctaagggaacgaaccgtcttgcaccaatatgaatcacagaaagccaaaaaacctgcacttgttgccaagtcttccatcttactagcatgtgaaaccttgggatgatgagacagactatggcgacactcagaggacgtgcgtcagaagccattcaagcagacgggcttagtctggggctcatctaacactagttccagtggcgatacggaacttcangaaacttcaaactaccagggtgccagctcgcacgcatgatcaaggtggccacacactatgcctggccggtgacgatccctgcgctgcgaggacccagtgcaccagtgacgtaggcgcgaaccacacagacctcacatcacgccggaatcagggccgtcacacacgctcgcccacccacccatacaaagaggcgaccgcgcaaaacccaggggagaccacatacgcgacacccaggcaagagggtcacacggcgagcgtaaacaaaagaacgcgcgccacacccgggagaggaaacgccaagacacgggacacgcaaccgtgcgtatacaaacatccaacgacgcgataaatcatgagagacagacgcgagtcgagatccctgaaccaaaccagacaacgacgaggccaacagca

SEQ ID NO: 547321 - DNA, 690 bp, Homo sapiens
  misc_feature (5)..(6): n is a, c, g, or t
  misc_feature (50)..(50): n is a, c, g, or t
cgtcnncggtcatctccggcgcttctagggctggttcccgtcatcttcgngagccgtggaggtacgagcttaagacatgcctattttattaatctacttccaaacgcaacgaaaggtccatggacaaatttttttggggatttgggggggggggacacccccaaattttatttgttaaggattttcagggggcccctcaaagtttccggttacggcttgggaagaaaggtgggaagtgcgaaaaacgttactttgaaccattttttagaagcaacccgtttttttccggggggttccccggggaccgtgcggagttgggaaggggaaagacctgctctttcccgttgtccttctatttatagaggaatcttttgcccgggtcgttctttctagagggttttccccccttttgtgtgtccccgttcctcggtatcaggccgtggggagcagctccaccacatatatttgcgtgccgcaatcctccgatattattccctttgtggaccccttttgtcggttccccaacaccagatgggcgatctgtccgggatctaactaaggcctgaccgatccccgaattggcgtggggttattaccttcccgggaggaaagggaaacccgtgggaataagaaaggggcccaccttgtccccggctctcgcatgggttgcttcaacgaaattaacccggt

SEQ ID NO: 547322 - DNA, 1639 bp, Homo sapiens
  misc_feature (5)..(6): n is a, c, g, or t
  misc_feature (50)..(50): n is a, c, g, or t
  misc_feature (1285)..(1285): n is a, c, g, or t
cgtcnncggtcatctccggcgcttctagggctggttcccgtcatcttcgngagccgtggagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaacaaggccagcctgccaggagtgaagaaagctttgggcaaatatggtcctgcctgcatgtcggcacagcaccactcaccaggcaagttggcagctcacagcatcagtccaagcatgcatgcatgcaccattagcacctcatttgcgcatcttgcatgcatgcacggcagtgcaacagttgcacagccagccaactgcagtgctcaagtgtgcaagcacactgtcatgtgccaacacatcattgcaatcaacacagcacacagcccaatacaaacaccattggccagatcttgtcaagcccacagtcgtatacccatcgtatcacctcaagcattgttgcacacaactatgtgggacattgcatcgcaggcaaccaggcataattgggcgtgcaaaatataccacccagggaagatcgcatgtcacatggcaacagacactttacccactcgacgaccgacacacgggaatctaaccacttcattgcggagtgacatacaattcctcaaaacaacctacagcgttacccccaagatctggcagacataacaccgcgcaacattctcacacagcaccacacccttgtacaccaaattcaacacacgcttgtttgctcaagctcatcgccccacgcactagcaattccacaacaagcgcatcaggtgacaacacccaaggcacattcattggcacctggcgacaaggctgaacagccacgacaactcaagagcaatatgggacatataacatggccacagaggcacacatacagttgacgtgccacaagaatgcccaacaattggtgacaattgtattcgtgccactaggcgattattagaacaacacgaaacagaaaccacccctaccaaacaaatcgccacaatacatcactgtgaacacgacaacaattgcgcacaacttactcgcacaagctcaaacacacagaaacatatgaaacaacacnggcaacacaacaccacagacaaccagacaaagcacacaaaaaccagaccacaacaccacgaaaaaagaaacacacaaacaacaaaccaacacgcgcatagagacaccaagatatacgacgaagagagagagcgacggcaaaaagcatcgagcgaaaagaaagcacagcagcacaaagacgcgaccacaagacgacaggacggaacgagcaagagaaaccacaacggtaggcagaccaacgagcaacgaaggcagaacaccatagacgagaacacaccaacaaagagccaggaccgagaaaaaaaaggaaacgacacagaacgagagaagacgaagcagaacgaacaagaacagc

SEQ ID NO: 547323 - DNA, 121 bp, Homo sapiens
tttagatcacaattgtccgcccatgggctgaagggactgaggagggtgcacgttggctagactgatgaggacacgagaaaacctcaagggagatcttcttcaatatcttggtgccgggagc

SEQ ID NO: 547324 - DNA, 695 bp, Homo sapiens
taaaaaacaaaaaaggagacattacaactgataccacggacatagtcatatcattagagattattatgaaacaactgtatgccaagaaattggaaaagctacaggaaatggatacattcctgagcccctataatctatcgagattgagccaagaagtaactagaaaacttgaacagaccaataacaagtaacaagattgaactggtaataaaaagtctcccaacaaagaaatgtccaggaccacatggcttcattgctaaattctgccaaacagttaaagaagaattaagaccaattctcaaactgttccgaaatattgaagatgagagagttcttccaaactcattctacaaggctagcattacccttatacaacaacaaacagacaaaggctcattaaacaacaacaacaacaaaacctacaggccaactgtattctacaaaacaatccttaacaaaaataccagcaaaaccatatccaagagtacatcaaaaagattatacatcatgaacaagtgggatttatcctagggatgcaaggatggtgcagcatacacaaatcaataaatgtgttacatcatataaacagaaggaacggaaaaaaaccatatgatcatctcagtaaatgacgaaaaagcatttggtacaattgaacaccccttcatggtaacactcccaaaagttaggggtagaag

SEQ ID NO: 547325 - DNA, 602 bp, Homo sapiens
  misc_feature (46)..(48): n is a, c, g, or t
  misc_feature (50)..(50): n is a, c, g, or t
  misc_feature (52)..(52): n is a, c, g, or t
  misc_feature (55)..(55): n is a, c, g, or t
  misc_feature (63)..(64): n is a, c, g, or t
  misc_feature (67)..(67): n is a, c, g, or t
  misc_feature (74)..(74): n is a, c, g, or t
  misc_feature (76)..(76): n is a, c, g, or t
  misc_feature (100)..(101): n is a, c, g, or t
  misc_feature (106)..(106): n is a, c, g, or t
  misc_feature (120)..(120): n is a, c, g, or t
  misc_feature (127)..(129): n is a, c, g, or t
  misc_feature (313)..(314): n is a, c, g, or t
  misc_feature (341)..(341): n is a, c, g, or t
tcatacctgactcttgaggatccacgacgccccgtgtagggctgannntngncanaggtttgnnccnaggaagngnagactgcagtgagccgatatcgcnncacancgctccagcctggncgacagnnngagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaaggnnctctctggcagcagagattaaaaactngcccaacttcatttccatacttcagggaacagcatattgaggatttacttatctatgacttgaattccttctttgttaccaagttaataaatgaccatgaaactcctgattaaactggataatgaaggattctgtagacttggctgcacgtatcggctttgtttgacttctctcctctctgttaacatctcagatcttgaatattccacattccccagcagcgtttgggggctgactataagtctatcaattccaactaaa

SEQ ID NO: 547326 - DNA, 309 bp, Homo sapiens
tcttctggccacgccgcacaccactggactggacttgggcatgatcgtcaacttgggacattgcagcacttcacgcactttaaacacgttgatgccatacaactgtttgccatccaggcggaaaagcaacaatctccaggcgattctgccctaccagctgtgtgcgctggtttactgaatccatcacacctgccatgcccagactcctaaatcctaggggtacgacgcgtacccaacactaaacggcacgagctttgctatttactgagtatggatattaaaacgacagtttcccgacaccctggccgc

SEQ ID NO: 547327 - DNA, 2016 bp, Homo sapiens
ggtgtctacatgcctgtcgtgttgtgatttgtgttcttgcttgctgtctgtcctgcttcgtcagtttgccggtgtgtgtgggcgtgctctgcgtcttcgtttgtgttgttggctgcttgctttcgtggtgttgtggtgtgtccctgcgtagtaggtgtgccgcccgcgtggtcgtgatcttgctttcgtttgggtgtgtgttggggctgtccttgtattcgctctgatagtgcttgtctagttctgctgtgcgttgtgtgtgtctcttaagttgttgtagttctctccccctgctgctgtgttggttttgtggttttgtgttttgctgtcctagtgtgttgtcgttgtctgctctgcgtgtgtgctcgcgtgtgtgtgtctgttgctggcatgccgcattgttgtggttgttttgtctggttcctacactgcctgagtgtgattgtgatctgttttgttgtgtcgacagctagtgtggtctgctctccgtttgggtgtggtaggaggtggcggtgcgtcgtgtgttgttgtggtggtgttctcttgtgtttttggtgttgggtgggtgtgtcgtgtgggtgtgtggttgttcgttctgttgttgtgtgttggtggatgtggtggttgggtgggtacgctacctcgcatggggggtgtgtgtggttgcgttccttactgctagttgtgtggttggtgtgtcgtcgtggttggggtgtggggtgtggcggctgcttccgctgttggtggtggggtgttgggttgggtgtgcttgtgtctgctccgactccggctctctgattggtggtgtgtgtggtgtttgtgtgtctgcgcgtgtcctcttcttcttacgttttctctagtctgttgtggtgttggtttttcaccatctgttgtgtggtcgtggggtggtcgctgtcctgttgtctctttctggttgattttcactcgtttgtgtttcgtctctgcgtgctcgcgctacggtctacggggtaggggtggtgttggtctgtctcatgctgtagttcgtttccctgctcgtgcttgattgttgtggttcgtgctcagcgtgtggtgtttcacgtctctcttctcgttctttgtgtgtgtcggtgtgtggtctcccccgcgcggtgttcggcgttgtgtgtggtgttgacggtcccaccccccccgtctgcgcgcgtcggtgcgtgtgtggttactcgtcgtttctgtgcgccgctgtttgcgttgtctgttggtgtgaggagagaggtggtgtgtgagtaatctcgctgcgttgagtgggttctgctctggttgtgagctcgacgccctctctgtgtgtgtgttgtcgctcgctggcgggtgtgtgatatatgagagtggggtggtgtgtgtcgtctcttcctactccccctgctgcgctctgttgtgtgtgatggggtcgtctctctctgcgtcacccgtgctgtgtgtgctctcgcgcgcggtggtgttgtgttcctagcgcgtgtggtgtcgcgaccggcccgctggtgtcctcccgcgctggtgtgtgtctcactgtggtggctgtctcggtgtgagtttgtgtgctgccgcgcgcgtgtgtgtgtgtgggcctcccgtcgtgcgtgtgcgcctcgcgtgtgtgtgaggggtgttgtgtgtgtgtctctctccaccacacacgttcctgtgtgtgtgtgtgtgtgtcgtcctctcgtctcccgctcccccctccactcaccaccacaagacggtgtgtggtggtctcgtgtgagaagacacctcagtggagaagagttgcccacacccccacccaggactccacccctgtgggggctcgagcacacacaccaccccccagtgccacgttgacagcagagtcagacagtctgactcactccacagagagacacacccccccccccccccccgcgggtgtcccccctggcgtgggtcccctcgccccctttcccccttatgtgtgtgtgtgtgtgtgtgttttaaaaaataaaaaataaaaaataa

SEQ ID NO: 547328 - DNA, 246 bp, Homo sapiens
gacgaggctcccagccgcgaccgcaaccctgggcctgtccatgccccggcgttggacgcgggcgggtaggacagacagatggacagacactagcacaggctacgagggggctgcctcagagcggagggaagatctcgggattgtggagaaggagtctaaagacagccgtggctctggtggacggggcaggaacagggacagaattgtgctgcaggagggagctctcctggctccctacgcctatgt

SEQ ID NO: 547329 - DNA, 691 bp, Homo sapiens
tccagatggccctggaactggattggctattgcagtgggcacagggggacgccctgtgtggaagaaagctctggctacaggtcctgggctggaacttcgagggcttgacgcaaggcgagggctgggccagtgttcccacagaactggtccaactggtggtggccaagaacgaactggcggtggccaacgagctgggcctactgagagggcgtggacacctggaagctggggggaacgtggctcccatgaagaggtggagggcttggtggagaagaatcggttccccatgatggtccctgaagaactctttgaactggagttcaacctggtcctggtactggagccacgaaggcctggttccagaagaagaatctggagggcctggaattccacactggggccttccagttgctgggccggtacaaagggctgctcaacgaggatacctaccaggcccggatttacaactcggccaactggagtggctttgtgaccgacaggtcctggagtggacgggagtcacaactggtctatcaggcccaacggggggccttggtccaatattctctggatgacttccaagccccttctgactacagatactaaccctaccagtccttccagaatccaccccaagttctctttcaggacagagggttctggtcctggttactccccacattccgtgtgg

SEQ ID NO: 547330 - DNA, 1105 bp, Homo sapiens
gctgagctttgctgggggtacacttcaggtcctactcatctggttcactactgcacctggacgatgacactcgaggaggctggagaacagcaaagatgggtgcctgctccttcctctgggactccctgacctcgacgggacacctgaccctgactgccagtacggaatgctcacatatagggtgtctgacaagccctgctggagagatctcacccagtcgggtggcaagagatgcaggaggacctgtttaaccaagcactttggctgtcccttggtggacgggtgtatgccgtgctcggggtgaacacccactatgtctgggcctagcctggattcctgcagcacacataggcatggatggcaaagcacataatgtctagctggtctgtgcgacgaaaaactgtgctaaccccctcccactcaaaggcttccatggccaggggcatcatctagcagattctagtccctagagacccctatggctggcagttgagagtaccatgccagggtagcgccccagagccagttgcagcgagggcatagtgtccagagctccacggcctcgaccatgccagcgcaccatctagagcccacaacgccttggccaccagtctgtgagttgcctagcgagttcgtctgcgccataccctctttagagcacccaacaaccatcccaggcctaccctggactcaggtggacagtgccgcctgcgcagcctaatgcgaagatggacttggtatgcacctatccaccatgcacatgaggaaagcttatacacgcaattcagtgccaacctaaggtaagtccccaaatgataaggattgcaaagacacaatccacacatgaagtcttcatccacgactaagactataccacagtcatgtatcaacatgagcaaatccgcagcccaaaaccactcaccccccaacgaactcctgcaacgctatcgcactatcctaagacaagtcgcaaaacgcgaatccctccccggggcgcccgaagataaacgcccaacgcacggcgccagcaagaccgacacgcacgagacacccgaagagccactagacgccagacaccacacacaccgattcacacgacggaacg

SEQ ID NO: 547331 - DNA, 330 bp, Homo sapiens
  misc_feature (166)..(166): n is a, c, g, or t
aaacgggcaactctggaccccataatatcaaaaactttcactactggaatgcctcatagcatttacagagatccagaaatggaggctgtaaaaattatgactaggtaagagttggctagagacaaggaagcatttccttggccaaaaatagagctgaactctcctngctgttgccagcattacaccacatacatttccaccagttatttgaagaccccttcacaaccaaagacagccagggcttcgcaaggcccagacaccccgctgactcatcccatctgcagcgtgcaaagtgctatttgtcactgcctagttatattccactctgcc

SEQ ID NO: 547332 - DNA, 476 bp, Homo sapiens
  misc_feature (20)..(20): n is a, c, g, or t
  misc_feature (98)..(98): n is a, c, g, or t
  misc_feature (197)..(197): n is a, c, g, or t
  misc_feature (204)..(204): n is a, c, g, or t
  misc_feature (261)..(261): n is a, c, g, or t
  misc_feature (340)..(340): n is a, c, g, or t
taaattcgcggccgcgtcgncaccgaaggttctacggcaaagactcccccgcctgccctcaaggtgaggagatgctcaccgtgttgtctggtgcggtngccgacgccaatgacgagctggccgacctcgtcgcgtgggattcctcccttgagggaatgggaacgaccttctgcggcgcgatgttctctggccctcanctcggcntcgttcacatcggtgactcccgtggtttcttgctgcgccaaggccggatgaagcggntgacccgtgaccactcatgggtgcagtccctccttgtcgatgggcggtttacccctgaggaggccgctgtgctcctgcnccgctccctcctgctgcaggtgctcattggtcaacctcagctcatcccgggcacccaaatcgtggttcttcggctgggcggccgctttctcttctgctccgtcgggctgtgcggtctcgtcgttgtcgactcggtc

SEQ ID NO: 547333 - DNA, 1266 bp, Homo sapiens
ggacaaagcagaaacagaggcatccatgagccattgcataaggatcgtggagactgtcaaaccactctaccggtggaaccaagccctagagaagctgggtcggcatggaccaggctgtcgcattgacctgcagagatgtgtgagcttggatgcccaacgaagcaaagtattccaggaggccttctgcggaagcatcgcgagggccaagattcaggacacggtgcgatacatgtcactcgtacagaaatgcccaataggtggaacagcatgtttctcgatactgtgggtaccccagtacagcagcaagcgggccactggagtagaacagaagcgacacacagggcttctacaccaacctggctgcgtagcgtggccagaggaggctgcttgggaagcaggaagcaaggaatctatcgccggaagtgaaatcggcggtgccaagcctcctcctgccgcccagtccctagcttggcgacccattcgcgactagcacgaccctggcctctcccatcgtctcgagagcggctaacatcgtcgcttccggccacggagatatggccactccgtgacctccctggggacatccatttcaatctcaccacgctgagctcacggctgcgctaaaccccccattatggcacttctcattaatcagccggaggaaagcgcctgacgcccgaccattaaggcaccctcccaataccatatgaagcacggggaggggacaagcgggccaacgaggccatgtagataccgccgtgtggaactggtccttggacccaagcctctgccaggcaaagcaaatataactgctcgcacgaccttgttgcccttcagacagggccacggcgtgcgtcagacgtcaccgagggcctctgccccggaaagcgacccaggacccactctcgcttccccccacttgcagatagtaagcgaaggcggacgtacgcgtatggcaccataagcagtcacaagggcttgaaccggagacttcgccctgctcactagaatctcacgtacagacggacgactcttcaaccgccaaactccctctgcgatagcacaccagcgaacactagtactctgacagctcataaccactcgaatgcgagtctccagacggcggacgcgaccatgggcactccaaacttgagcctcgacattcgacccccacataccacctgtgacacttaaagacaagacagtggaactgccacccgcagggaataagtggtgcactcgatcttcaaaaatacggaagccccc

SEQ ID NO: 547334 - DNA, 183 bp, Homo sapiens
taaaaaaaagagtctgtttcctatggtgaaaaacttggtttaagactctatagccttggaacaattcctaccctgtcacttaatttgtccagtttaatacccttggacgagtttaccttaattatctgaaaattcagatttttgcatcgtattaaaattattcatttgcccctttagaattta

SEQ ID NO: 547335 - DNA, 231 bp, Homo sapiens
tgggcgcggcgcggcggctggctgcctggacctgatggtggacctgggcctgccggctggaaaacatctgggtgaccgatatcgaaggcgtggtctacgaaggccgcaccgtgttgatggatccggacaaggcgcgcttcacccagaagaccgacaagcgcaagctggccgaggtgatcgagggcgcggacgtgttcctgggcctgtcgtgcggcggagtgctcaagccgg

SEQ ID NO: 547336 - DNA, 464 bp, Homo sapiens
tctggacagcagatgtcctgggttctattaccagtagcctgctggtcacaggcgcactacatgctgaagccctgggagcagacggtgttcaattccatgctaatatccattgtggagatggcactatacacaggatacgtcttcatgccccagcacatcctggcgatatggcactacttcgaaatcgtacaatgaacaagatgcgatcaggatcggaggttccttggggaagacccagcctacgaagtcggaatgagaccatcagatgtgataagaaactcttctagatgtcaacataaccaaccttataaagcataaaattcatgagtcgaacaggaaaatcatcctgactcatgtgttgtgttctttatttttaattttcacagaggctcttgtatagcagtttttgtctattttaacatcgtagtcatttgtactttgatatcagtattttcttaaccttt

SEQ ID NO: 547337 - DNA, 165 bp, Homo sapiens
tactgacgatagggcgactcccttcaaagctgaaggactttgtttagctgagcaattccagcccgtcgctctggcaacagtctttgggtggacttacatctcatgcatcactaaacagaggaatagccattcagcaagtaatgggggtctcataaaaaaaccaca

SEQ ID NO: 547338 - DNA, 168 bp, Homo sapiens
tgacgaggaggagctggaactggcactgctagagcgcctcttccgtttggctggggttggctccggaggacgtccctcctctgtgctgtccacctcctctgtgctgtccacctcctctgtgctgtccacccctctgtgctcctcctctgtgcctctctgtgctgtcca

SEQ ID NO: 547339 - DNA, 500 bp, Homo sapiens
  misc_feature (5)..(5): n is a, c, g, or t
  misc_feature (81)..(81): n is a, c, g, or t
  misc_feature (90)..(90): n is a, c, g, or t
  misc_feature (92)..(93): n is a, c, g, or t
  misc_feature (106)..(106): n is a, c, g, or t
  misc_feature (119)..(119): n is a, c, g, or t
  misc_feature (122)..(124): n is a, c, g, or t
  misc_feature (147)..(147): n is a, c, g, or t
  misc_feature (163)..(166): n is a, c, g, or t
  misc_feature (168)..(169): n is a, c, g, or t
  misc_feature (211)..(211): n is a, c, g, or t
  misc_feature (213)..(214): n is a, c, g, or t
  misc_feature (238)..(238): n is a, c, g, or t
  misc_feature (240)..(240): n is a, c, g, or t
  misc_feature (260)..(260): n is a, c, g, or t
  misc_feature (288)..(288): n is a, c, g, or t
  misc_feature (302)..(302): n is a, c, g, or t
  misc_feature (306)..(306): n is a, c, g, or t
  misc_feature (319)..(319): n is a, c, g, or t
  misc_feature (327)..(327): n is a, c, g, or t
  misc_feature (335)..(335): n is a, c, g, or t
  misc_feature (342)..(343): n is a, c, g, or t
  misc_feature (349)..(351): n is a, c, g, or t
  misc_feature (367)..(367): n is a, c, g, or t
  misc_feature (370)..(370): n is a, c, g, or t
  misc_feature (380)..(380): n is a, c, g, or t
  misc_feature (395)..(395): n is a, c, g, or t
  misc_feature (399)..(399): n is a, c, g, or t
  misc_feature (403)..(403): n is a, c, g, or t
  misc_feature (407)..(407): n is a, c, g, or t
  misc_feature (412)..(412): n is a, c, g, or t
  misc_feature (430)..(430): n is a, c, g, or t
  misc_feature (440)..(440): n is a, c, g, or t
  misc_feature (478)..(478): n is a, c, g, or t
gacangtggtcacagaacacacacacacacacacacacacacacacgtgcacacacacatccccccacaactacagccgcnaaaataacnannatggtgttgtaanatccccccagtgnaannnaaaattccccatggtgacctgtnacctgctccctgaaannnnannggccaggcaggtcacggtggggacgcagaaaaaaattatttntnnatcttgctgttttctagccttgantnggggacatgagtgaaaacanggggttttgaggagtaacccttgtaaanacatgtactccaanagcnaggaatcccaaanctcctgtncaaaaagntactggnncccctnnntccccaaacccccccngcngacccccagncccctagctcatccntttntctnttcntcttnttccagtgttcaaagagnacccccagcngggcagggaaggcccctcccggggtttacatgactgantccttctcagaggcgaccgtgg

SEQ ID NO: 547340 - DNA, 440 bp, Homo sapiens
  misc_feature (21)..(21): n is a, c, g, or t
  misc_feature (294)..(295): n is a, c, g, or t
ttccatgttttacttgttacnagtgtggcctaaacttttaacaatacccattttacatttgtattatttgtgtttagtagtatattttaataaagggggccacaatatactaaaaaattaaagacattgcttgcacaacctttcctcacctgtgaccaggctatcagactagatgacatatttagaggtaagattaaagttattacaaaaattgttaaaaaaaattttttttaagttctccctatgagctcagtctaataaaatgtctcaagaaaagcattttacaaaaagaannccttaatgggcataattttaacaatgcaaatcacctttaaaagactgtgtgcctgtaatcccagctattctggaggctgaggcagcaggactgcttgggcccaagtttgaaaacagcctgggcaacacaggctgttaaagaaaaa

SEQ ID NO: 547341 - DNA, 475 bp, Homo sapiens
tgccgagtatgcattaaaggcacagaaactttacattttgggggtcatttgttgagtatggtgaagtggttccttggtcgacaatggaaccacttggtgcaggtgccggagtcgaacgtcctgcactgggaggacaccaaagtattccgacagctgtgcttcgaacgcctgcacttttggcccgctggtgatccagcctgagcgcagtacatcgccgaccgccgagatggtggcttcatcaatggtaggtttggaaaacggcagaaagggctgttggctcataacgacgaaggcatccgtttcagataggcgatgagtagtagacgtatcagtaccgcatggttgcacggttcaactgaatatagcctgtcacgcgtgaatgaatcgtcatgttacgagcaaaaaaaatgccgctgcaaaagcggcatcttcggtgggtgcttcagaaggaagtggttccttgtcgggtaccgag

SEQ ID NO: 547342 - DNA, 638 bp, Homo sapiens
  misc_feature (9)..(9): n is a, c, g, or t
  misc_feature (63)..(63): n is a, c, g, or t
  misc_feature (83)..(83): n is a, c, g, or t
  misc_feature (124)..(124): n is a, c, g, or t
  misc_feature (154)..(154): n is a, c, g, or t
  misc_feature (163)..(163): n is a, c, g, or t
  misc_feature (223)..(223): n is a, c, g, or t
  misc_feature (253)..(253): n is a, c, g, or t
  misc_feature (274)..(274): n is a, c, g, or t
  misc_feature (281)..(281): n is a, c, g, or t
  misc_feature (299)..(299): n is a, c, g, or t
  misc_feature (307)..(308): n is a, c, g, or t
  misc_feature (332)..(332): n is a, c, g, or t
  misc_feature (338)..(338): n is a, c, g, or t
  misc_feature (344)..(344): n is a, c, g, or t
  misc_feature (354)..(354): n is a, c, g, or t
  misc_feature (402)..(402): n is a, c, g, or t
  misc_feature (415)..(416): n is a, c, g, or t
  misc_feature (423)..(425): n is a, c, g, or t
  misc_feature (428)..(428): n is a, c, g, or t
  misc_feature (430)..(430): n is a, c, g, or t
  misc_feature (432)..(432): n is a, c, g, or t
  misc_feature (439)..(439): n is a, c, g, or t
  misc_feature (461)..(461): n is a, c, g, or t
  misc_feature (484)..(484): n is a, c, g, or t
  misc_feature (491)..(492): n is a, c, g, or t
  misc_feature (505)..(505): n is a, c, g, or t
  misc_feature (534)..(534): n is a, c, g, or t
  misc_feature (546)..(546): n is a, c, g, or t
  misc_feature (574)..(574): n is a, c, g, or t
  misc_feature (633)..(633): n is a, c, g, or t
gcatcccantacagtcctggtgtggggcctcacctcagctccttcagcaagctgttgacagancccagctgctcctggaagtngccctcgtcctcaccatcctgcagctccaggctggccagcncctggtactcagcctgcaggctggccagtntcctgccgngctgggggtcctgacggtagcggtcccggcaggtggtcaggaggacgcccagtgtctgcngcaccttctcacgggcatgatgctcgggcngcgccagggggtgggccgtgntctcgcnccagccctgttccgcacnggcctggnngggggtgtgcgctggggatactgntgcggnttgctntggggacatntcctgggtcagctcagcctcctcctcggcgaacatgcttctccgtgancgggtcgtggagnngtgtgannnggngngnggggagngcctccgtgccgcttctcctgngccagggtcgctcagggcctgcngccgccnngagcttcaggaantgccgctgggcataggggaagtggcgcanaggtgagcacantgcaaacaggaccttcttctttgcagtnagcggctgctccgtggccaggatgaccagcagcttctgcagggctcccccttcgatggncttca

SEQ ID NO: 547343 - DNA, 262 bp, Homo sapiens
attctcgtttatcgccgacacccttcggagtaaaagtatggctagctctgagatatttaaagggcgaccctaaaaacgttcgcgaaaaaatgcgaaaggcgttttcctgggagaaatgttattccgttcaaaaatctacaacaaaaaccggacccgaagcaaaaagtgcaaacacctcggtccctcaaagagcggcctccacccaaaataaatagcgcggcgaccaaacgggcgcgttacaaaacgcggaatacccttcccg

SEQ ID NO: 547344 - DNA, 472 bp, Homo sapiens
  misc_feature (345)..(345): n is a, c, g, or t
  misc_feature (347)..(347): n is a, c, g, or t
ggagactaagcatatgggtggtagggggtatgctcctcagcggatttttcatgagaagtatttatcctagaagcgagggcttttgattttgagtttcccgcatctgaggtatctgtaccttcttggagaaaaagccaacgcctcacatcactctgtgtctctacgtggggcagggaggcgaggcttgctaacacccctttagattctgtggtctagaaggaagaaatgaggaaaacaaacattattccagacttttctgtcatccaaaaccaataaaacacaattctgttttttatacagtactagccaaagaaaacaaaaattagagcttctaagagcagtctngngctcacctttatacttttacacctgcgtgtatataagtataaaataatgacgtttggacaaagaagctttgtagttatttattttaaagttacagtactttaaaactcctcgataataaatagcg

SEQ ID NO: 547345 - DNA, 551 bp, Homo sapiens
attaacctaggactaggaaatctgactagttcaggtggcataactagtgctaaagtcatacatgagctttatcatcacaatgctacgaacccttatataagaaaatctagagaatcattaacaagcaaataacagaatagagtaggggatgagctgggacactctggggtcagactgcctgggattgacctggccctactacttgctggtggtgagatgctggccaattatgagtactcacctgtaagatgtgagcagtaagaaagtgtatctgcctcactgggttgtcagaacagacaatcccggtacagttctcggagcgtcttggaccatcactgtatagctagttaatactttagtaagtacaataaatttcagtcactctatctgaacatggtaactgcaagatatctcccttatttcctgtacttaactttaacctccacttcactgtgtccctctgatagggacacaagtgggttctgaagtgccctaagcctgtgctggtggcagatctgcccatgtgggtcctgatcctgcgtatgagctga

SEQ ID NO: 547346 - DNA, 292 bp, Homo sapiens
tacctgtatctagctactaaattatcaacaaacaattaatattactgttcactatttgtcactgctaatacacaggtttttcattatctgctctgggtttattattttatatttatataaaagaaagtattgccctgtcaccccaggctgaagtgccgtagtgataatcttggttcactgcagcctcgacctccggggcctcaggcgatcctgctaatttcagcctcctgagtagctagggactacaggcttcacactaccacccccagagcaaaaatgagatgttggacgg

SEQ ID NO: 547347 - DNA, 452 bp, Homo sapiens
ggctcgcaatgtgaggacccaagtctaaaattagacatagtaacacatatgtggtctgggtctgctgttctaccagcccgtagcctctacgatattcatgctacagcaatccccagctgtcgtgagttcatccaatagatgcgctctcagctctgcctctgtattctacttgagtaactcttacccatccagtcacctcttctagagaacctccttgaatattcccatgaaatttcacacctgcaccaccaaccccagctgcccatgcttccatgtcccaggcacctctctggccttctccttcctatgtatcattttagtgtctgtctgtgtgtttttcttaactctttgaactcccaagggcaaggatcatatttatcttcaggtgtgtgtgtgtgtgtgtgtgtgtgtagtgtgtgtgtgtgtgtgtgtacttatatatatacaggcat

SEQ ID NO: 547348 - DNA, 154 bp, Homo sapiens
  misc_feature (10)..(10): n is a, c, g, or t
tatcaagtantaaaaggcaagcataggatttcacgcatcatatttccaactccctatcaacattgcaccatggatgaactgtttctcagcactgtgctgcttcacttgtgacttcaaggatgcaattgtggaggcagcacagtatgcacatcag

SEQ ID NO: 547349 - DNA, 382 bp, Homo sapiens
acgcgtccgcccacgcgtgcgaattgagacattttactttaatctttaaaaaaaatgcattaaaaacacactcaaaaaaaaaaaaaaaaaaaaaaaaccagactgggggaaaaaaggtttggccttatcacagaatttttactgtgctgtataaatgtttgcaaatgcgaaaagtgtgcattaatagtgtgtttccacattaattaatgccgccttcaagagcaatattgtgcaggtaaaacgctgtttgtggttttctgttgcacagttaaagctgacccaccctatgcacaagacaatcaaatataaatctgtcctcctcaggatgcagataatactcatgtaaattatggagcacaatgtaagacaaaaggagacactt

SEQ ID NO: 547350 - DNA, 823 bp, Homo sapiens
agggaattaccgtcttgtttagcccccccctttgtggagtcccgcccctggttgggccatctcgcgcccccttctgtttttgggagaggagatattaatccattccgcccccccctggtttcaatggcgcgggtcctatattcgctcccgccccctctctcgggacgagaggaaatcctctcgtactggagtcggggaaatactatgtggcgcaccctcccgtgcggacgcgacaaccgcactcttctcctctgggatgataactaaaagtatcttggcgccccacactagattgtattggcttctctggataggtcgcaactaaaatatggtggttaccccacgtgaggttaattttctatagcgagaggcgcgccaaattgttaccatttgtttgtaagatacgcggtgctccactccccactgagctacttcgccgctatttgattcggcgagagagagcatcacccccctccagagagcgaaatgctatggatttagtagacagtgcgagataaagaggggtctatatcataaaagccccactgtgggtgtctaaccgccttatatactcctccatagaaagctttataaacactcctcagacaatcatttcctgcgttcttcactctctttttgcagagtcctcgcttgttcttcctcacgactcgtcttaatttcttcttcacgtgggactcagcgtcgtacttcggacgaagacaaaaaacgcgcccccaaagagcgtagttcagggacccaccacgttcctccacactcaatttgaaaagtcaaaaaaacatgtcataaacgacccacaaaacgc

SEQ ID NO: 547351 - DNA, 246 bp, Homo sapiens
tgcagacttgccgtcggccacagcaaactgacatcaaaaccccatgttgcccagcctgaccccacagaggctcacggtgacaaccaccgaacggaaaaactcaacttcgtaaacagataataacgaagtcttagacgtccccaccttaaaaacgcgaagcgtgaacaatccggcgagcccgacagtgtaaccgccacagcccccgcacgcggggcgggctgggttagcgggagatttgagcggccg

SEQ ID NO: 547352 - DNA, 843 bp, Homo sapiens
ccgactgacgtgtgttggctgctaccaccagtatttatatagtgtctcgaccacttctgggttggcgaagtgcggtgacaaaagaggtgcggtcggagggtatgtacccgccccccgttttgtatgagatgctcgcctggtcagtgatattggggcgtcttacatatatagtgaccctctctggtgggtgcagacgccaaccaggtgcccccgcgtgggtagggggtctcataaagaataggcccggcctttggagggtaggagtagctacaatagatatgatagagccctctccaatatgtattcttttccctcccagcgagtcacaacacacaatttgtgttttttttacacccccagctatatatatcgaccactatatgtacttccttattatatacaatgtgcattatatatggtaaatttatatttaggacctataataatcagtaatagtagatagagatcttcatacagtgtgtaagcgactcgattacgagttaccctatgatagcgtacctcgcactcccgtttttcaaagttttccttctatcttgtcctccctcgtgttgttacatctaaagaagccccctattgtgttttgcacttcatgttatgcccgctatcgttctgggtgtaagtggtaacaccacggacggtggtattttaagtctgtagaagtgaggtggccgttccgccaagaaagagatttttagagacgcccgtcctctactccgcctggaagtatgtaccagtaagtcattaaagtaagacgaacagttaaaaaggaaaaattgacatttgtaggacgtaatcaagcatatataaacaaataatagaata

SEQ ID NO: 547353 - DNA, 109 bp, Homo sapiens
tggacctagattatcccctacttcaaagtcagatcgctctacctattaactcttcccactatttgctacatagacgggtgtgctcttctagctgttcttagcgtagctc

SEQ ID NO: 547354 - DNA, 630 bp, Homo sapiens
  misc_feature (104)..(104): n is a, c, g, or t
  misc_feature (200)..(200): n is a, c, g, or t
tcttaccacaaagaatcttgtgtggggttctggaagaaatctcaactgggttatcatttcacactaccttgtggggtcgccagtgatggagcaaatacccaggnaggccttgggctcagtctgggcattaaagggacagagtcagttcacaccctgtttgtgattaaagagggcacagcagggccagtgtgagtttacancaacgtaagcccaggggcaatggtttgggtgattcattttcccctttaggtggtgccaggggttggaggcccctaaaaaaaaatcagtaagccccagtgtccccccagcccccatgtttatgtgaacatgcgttgtgtgctgcttgttttggaaattgggcctgggtccaggcctagggtgagttccctgtccgtacaaacccaagatcagggttgagggtaaggaaaaaaaaaaattaggaaagttgggcccaaaactggagactgttttttttttctggaaatccaaaaattgggcccgtggagcaccagtgtcagcatcaggggggaacctttaaaacagcagggggggggcccaggcccccaaataattcttatggccccagccaggaaaaatggcagtttttaaaggaaaaaatgtttgggccca

SEQ ID NO: 547355 - DNA, 103 bp, Homo sapiens
gcaagacagagaattggcacgtggccaagggatcgggctggaaggcccaacaaggctgtccatatacactcggtctggaggcagcccacgtgtcaacacggag

SEQ ID NO: 547356 - DNA, 343 bp, Homo sapiens
aaaaggaaaaaaaaattgggattcccctggcataaactttagtttgcccagttcccagctactacttgggcagtaattgctttatgcggctgtaatccataacctgtgaagacagcccatcatttaaatccccttccaaataatatttgggtagtgttagctgtgaatttcccctggccagctgtatctctataaaaataattccatgtattaatagtcccagaaagcctgtaagtgagcaactatttttatgaaacggccccctatggataaattaacttttccaaaaatcttgtttactgtatgatattttaaaaccctgtcaaataaaatatatatccca

SEQ ID NO: 547357 - DNA, 121 bp, Homo sapiens
gtacgaggtcgagcgtcggacctgatatatatgtaccatactttctttatcaatccaccactgatgggcacctaggttgattccatatctctgctattgtgaacagtggcatcgataaaca

SEQ ID NO: 547358 - DNA, 922 bp, Homo sapiens
  misc_feature (619)..(619): n is a, c, g, or t
  misc_feature (682)..(683): n is a, c, g, or t
gcatgtttaagggagggggaagccttcctctcaattgttgtcagtgaaattccaataaatgggatttgctctctgccaaaaaaaaaaaaaaaaaaaaaaaaaaaaaaaaaaaaaaaaaaaaaaaaaaaaaaaaaaaaaaaaaaaaaaaaaaaaagaaggggggcggggccgcgcttaaaaaaattatcccctcggaggggggcgcaccatatttgttcgcgccaaccccgtttttttgttgaacaaagggggccaccataatagggagggagtcgttttattattataccgacagcagcgcgcgggcggcgcggtctatttaaaaacacagcgtgggtgagtgggagacaacccgttctgtgggtgcaaggtaatcttcttgaagaagagagcccccactatctcttgggggggggcgaacactattgtgggggacacacatcatatcctacgagaggatttattaagggggctcagtgggggaggaatatatatacaaacaatttgagagaggtggtattactagtgtggtggtaatcacaccggggcatctatatggtgtgaggggagggagagaagaaaactttgtgggctctcgagagagagattattaattatngctagtcatcatatttctttctccctcgcgggggcggttcttgtttgttgaaaataaactatnngcgaccgtcgaggatacgaatgcgacagacaaggaagcaaagccatcatcacgacgaacgacagaacacgccgacagcggcatgagacatagtaacgactcagcaacggaacgaacagacgaccaacacacaaccgagcgaagaaggcatctgaagagacagcgaagcagatagccagctagatgagcagacagcgagcagacgagcaccagagcaaatacgaagcaagaaagaacagt

SEQ ID NO: 547359 - DNA, 178 bp, Homo sapiens
ttaactaaaggccgacaaagatgatcactttagggtggatattattaaaaatgaaacagttatctttaagaacggtcagctcagtggctggtgcaaaggatgaactgcacattgttgaagcagaggccatgaatgacgaaggcagtccaatcataagtcacactcggcaactttgaaa

SEQ ID NO: 547360 - DNA, 231 bp, Homo sapiens
taccacttaagtgaatatacatggaagaatatatatatatacatatatacataatatacataaatattcataaatatatatacacattatatataaatatatttatcattaatatgtatataaatatataaaatatgtacacaaaatctatacataaatattaatatatatacataaatataaatatatatacacacataaatgaaaggtattaccctgggtagtcacaga

SEQ ID NO: 547361 - DNA, 703 bp, Homo sapiens
tgccacgtgaatcgaggcagtgtaaaagagacgcgcaatgtcaaacagaggaaatatccaaagaagtgcatagatgcatactaactataaagagatatagcacacgtatgtaaacagcggcactattcacaatagacaaacaattggaaccaaaccaaatgtccatcaatgatagactagggtaaagaaaatgtaggcacatatacaccatggaatactatgcagccataaaaacagatgagtacatgtacctttgcagggacatggatgaagctggaaaccatcattctgagaaaactatcacaaggacagaaaaccaaacaccgcatagtaactcactcaaaggtagggactttaacaatgagaacatatggacacagtgcagggaacatcacacaccaggacctatcatgaggtgtaggggctgggggagggataagcattaggagaaatacctaatgtaaatgacgagttactgggcacagcaaaccaacatggcacatagtatacctagtgcaacaaacctgcacattgtgcacatgtaccctagaacttaaagtatagtaataaaaaaaattcaccaaacaccacaaaaaaaatcaagattgtcaaagacaatttccacgtcacccgaaatccaaataatattagacaaagcagggagtcaaccagatatggcccaattggcaaacgtccaggacaa

SEQ ID NO: 547362 - DNA, 147 bp, Homo sapiens
actagaggaccctcatttacgcaggaactacacccttatcccatactagtaatatcgaaaccatcagctactcattcaaccaatagccctaggcgtacgcctaaccgctaacattactgggcaggcactactcatagcacctaattg

SEQ ID NO: 547363 - DNA, 278 bp, Homo sapiens
ataaatattgtgctttctgactgctacaccaactggttgttcccctgtccctctccctccctttgggcttccctattccctgagacacaacagtactgacattaggccaatgaattaccctacaatggcctctaactgttcaggagaaaggaagaggctcacgtctttgactttaaatcaaaaggcagaaatgattaagcttagtgaggaagacatgttgaaagctgaaacaggccaaaagcgaggtctctttctccgtcgacgcggccgcgaattta

SEQ ID NO: 547364 - DNA, 150 bp, Homo sapiens
gacttaataagataataactatactaggaagattgagatgaactccaacgcttattctcatgctacctatatcgcatgtgttgctgattgttttatggctcgatgaccctactcatggttttgtactaagacttcatttacttaacgacg

SEQ ID NO: 547365 - DNA, 374 bp, Homo sapiens
tgggctggatataggtgtgagccagtgctgcctgggcatattccaactctttctaacagacactcttgtcccttgacattctgctaggtgaacagaagtgtgtaccgagaccagtgagagaactctccccggagctccaggagtgggcacctttactcgcctgggacattccagcctggcacagcaatcccccctcgccttcataccctaactaccgccgtctgttgcgtgattcagccacgacctaggggcgctggtggctgaaggtcggtgtatactcgggatgcctagtctccagggagaggggaggcagcatttcagagagctgccatgtgttttcagccctgaggtccagagaactgggaaatgctgtc

SEQ ID NO: 547366 - DNA, 337 bp, Homo sapiens
acattacctgatattgtttatttttaaaaactcttatgagacgtcagtcttatatatctcaggctgcagatcgttggcttacttgcccagcttggacccttggcagctctttaatgttactaaatccgtgactcctctaattctgaccctaatccattggattccttctcctcccccaggctgctggacactccggaaatggcaacttgcttcattacaaatgaatacttgatctcagctgggctctgaacttaggtcttatgtcttttccttcctcaaagtcttccatcttttcccacctaaatcaattcaagagtagtttccaatgttatccttt

SEQ ID NO: 547367 - DNA, 612 bp, Homo sapiens
gtacagcgcacgcatgaagctgaattgggctgtggagctggagcgaggatacaggcccgccgtggcgggcatctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaacggtgacagcgacaggggagggcactgggccaccgagggctgccaggtgctgggccgcaagaacggcagcaccacctgccaattgcagccacctgagcagctttgcgatccttatggctcattatgacgtggaggactggaagctgaccctgatcaccaggctgggcctggcgctgtcactcttctgcctgctgttgtgcatcctcactttcctgctggtgcggccatccagggtcgcgcacgggga

SEQ ID NO: 547368 - DNA, 790 bp, Homo sapiens
ctccagccgcccggggaatacctctagttcttcccggccgcctgcgccttccgccccgccggctttcctcctccgccctgcgggtgcctcctttcggcccccgcccggggtccggcgcagtggcggtcgcgggcccggcccggaaggggcaagatttcctcctcgggggagcctttcccaacccagggcgctatgtgctccagtgaaaggccaaggaggggaagtgagggcaaggaggccggccagacgagtgactcccccgggtaccgggcacacaaaaggcccgggccgtggtctgtggggagccccaggtggaaggtaaacaattggcaaaaacacccctattaatttcccctgtgcgtgggcgtggatacaggcatttgagggactgtcgcaccttgggaagacaaaaacattttatcaaaggaaggacccctataaaggagcccttttttttcaccccgagggaaggcaaatgcaacgaacagtccttttacaccgagggggtatggtttcacccaaggccccccattaagagggggccctccaaaatatgttacacctcgtttttacaacacctggggcaaacctaatagcacccacgcgtttttgtccacaaggcaaacggagggacacagcggcgcatgaggcaacccgttatggtggggaggggccccaacaactttcgtaagcagcaaccacactcccgtggtgggacctccattaagcccccaagaaagaaatggccccaccaacaaaagatgcgctacaacttctcccagtacaattt

SEQ ID NO: 547369 - DNA, 132 bp, Homo sapiens
tctagcaggatctgaggtctttacccctggcaggtcgatacactccagtggtgcagccgcctttgaatagcacgacgcggtttgatagtgacctgcacaccactctctttaagttctcgcgaagccccaaat

SEQ ID NO: 547370 - DNA, 116 bp, Homo sapiens
cggcacgaggcctacctaacaagggcagtggctttttatttgcaggaattgttgcccaattcgggctccccgatgcaatagggtctcacctggaaacatgatcaccctctcaatca

SEQ ID NO: 547371 - DNA, 105 bp, Homo sapiens
ggatttgctggtgcagtacaactaggcttaatagggacatgtccctattaagccattcaagcttctaacgttagaagcttgaattcgagcagtagtagtagtagg

SEQ ID NO: 547372 - DNA, 1876 bp, Homo sapiens
  misc_feature (1840)..(1840): n is a, c, g, or t
  misc_feature (1869)..(1870): n is a, c, g, or t
tgatttggggcgggcgggggagtctccaggggaacctcgaggttgcccccagcagaacccatgcaccgctaagccacccgagcaccgcctccttccgctcgggcccgccccggagctgcgggtcgctccgagcccattcccgccggaagtgcgtcaccagcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagagggagcttgtgaagaccctcatgatctcttggctactcccactccagagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggtgggtggtgcccggccccaccactgtgcctgtcctacaccgtgggctccatctccctggctcatctatcctgatgctcattcctcctaagtccctgagttcagcccccacaggaatctgattgagccagagcagtgcaccttctgtttcacggcttctcgcatcgacatctgccttcgtaagaggcagagtcagcgctgggggggcctggaggccccggctgcacgaggtctgcacacgagctcccttcattgcccagttccacgtgaccaggacccaaacccctgtcacatgctgctaaccaccagccntctcattccccctttttaaggtgcagtgnntggtgc

SEQ ID NO: 547373 - DNA, 142 bp, Homo sapiens
gatttctagcaggatccccctccagacaggactaaggagaaggtccagatgcgggttatcttgaaagaaactaagtgacattctacgcagagagttgtctatgttgtctgaggttcagcagctgttaatctccttcctttgg

SEQ ID NO: 547374 - DNA, 168 bp, Homo sapiens
gggccgcgaggtgatctgctactcaagagcaagctcagtagggtccccccccacaggaaacttcgcagtgctgcaccaggcgaggaaacgagacctctttcgttccttctagcaaggtctggacggacgtagaggttattgaaacctgcagacttgttctgacggagg

SEQ ID NO: 547375 - DNA, 720 bp, Homo sapiens
  misc_feature (98)..(98): n is a, c, g, or t
gaaagtggaccgaccccgtggggcgagctgatgccgtcagatgaagagtcctctgaggaatagcaggaggagtagagcgacgaggagtacccagacanaaccggcttcttcactcgtgcagacagtcacagtggtttgatcactccagacggcttctcctctgttcctgccggtatggagactccagagctgattgagctgaggaagaagaagatcgaggaggccatggatggcaacgagactcctcagctgttcactgtgctgccggagaggaggacgggacctgtcggagctgctatgatggcgtccacacacatctacgacatgactacgacggtgacgagtcgtaaggtgggcgtgtctgtgctggacggagactctcagggtgtggaggtggccctggccccagaggagctggagttggaccccatggccatgacccagaagtacgaggagcacgtccggagcaacaggtggaaaaggaggatttcagcgacatggtggccgagcacgccgccaaacagaagcaaaagaagcgcaaggcgcaaccgcaggacacacgcggaggagccaagaaatacaaagagttcaagttctagagctgctcgtccttcagtcttttattgtgcgggagcacacatgtttgtgcgtcaccttacagtgagccatgtttttcatttacggtcaatgtttttgtaaataaaatcccagtccatgcca

SEQ ID NO: 547376 - DNA, 654 bp, Homo sapiens
gggcagtgaaaccatcaggtcctaggcttttctttggtaggagacttttcattacagcttcaatctcattacttgttattgttctgttcaggtatatttcttcatgattcagtcttggtaagttgtatatgtccatgaatttatttgtttcttccaagttttataatttggttcataattgttcaaataagtctcttataatcctttgcatttctgtgctatcagttgcagtgtctcctttctcatttctgattttatttaagtcatctctcttttttcttattccagctaaaggtttgttgattttgtttatcttttctaaaaatcagctctttgttgcattgatcttttgcatttttaagtctttattttgtttatttctgctcttatttttattatttcttcccttctacttaatttgggtttagattctgtgtgctgtattccaaataatttatttgcttgtgtattctagttgaataattctctttatatttaactgtatgtaatttacctcttatttaactgtattcaatgttttgtttaacctgtttaatttctaattttaactattatatcttttattgttataagttccacttggtactttaaaaaatctgcctgtcaattccaatgctctattgtattttaatt

SEQ ID NO: 547377 - DNA, 636 bp, Homo sapiens
cagtctgatctcgtactcctggcctcaagtgatccaccagcctcgtgctcccaaggtgctgggattacagacgtgagccacgtgccgagcaggttccttctttaccttctaatgaaacatttaaactataagtgtgcctgagaaggttaagtttgtggagctctgtagcatgtcagagaagagtagtttttagagatctgggaggaatattttgagagatacatattcttttctaagtatgttatcacccgtgtggtgttgagcatatcgtcccaaaaacctgcttcagcagagcatgttctaggccaggcatggtggcttcacacctgtaatcccagcactttgggaggccgaggcgagggtggatcacgaggtcaggagattctaagaccagcctgtgctcaagatggtgaaaccccgatcgtctgctgtaagatcacgaaaaattagccgggcgtggaggtggtgcgcctgtcagtgtatctcgtgagagctgaggcagagattgcttgaaactcaggaggtggaaggtgataggtagagctgagatggcgccaatgagatcgaacccgagtcgacagagcaagattaccgtcccatatagaaaaagcagtttatggcatacagcagggatat

SEQ ID NO: 547378 - DNA, 148 bp, Homo sapiens
gtacacggtccccatgagcttcagcacgacagtgcctgcctttggtcccctctccaacctgctccccctacccatcgtgaagtctctacatgacagatgctgggcggcttcagctcacctgtgtgcaacagtgtctagctagagaaac

SEQ ID NO: 547379 - DNA, 184 bp, Homo sapiens
attcgcggccgcgtccacatttttacagtttctggtttcacatgaaattgtttgcactactgagactgttactacaaactttttaagacatgaaaaggcgaaaagaaaaccataccgtccccattcctcctcctctctgagggactggagggaagccttgcttctgaggaacaactctaattat

SEQ ID NO: 547380 - DNA, 572 bp, Homo sapiens
tgtggctaccatgtctctcgcgcgggatgtcgctgggctgtcggacctgggagcctgtgcagccgcaatggattcaacgattcgaatatatgggcaatcttctgagagatatcaccagggagactaataggtccatcaacaaagcatccagaaaagttaccaagtctatgaaaatggtagcggtcggcaaaatatgcccgagctgagagagagctgaaaccagctcgaatatgtggatgggatctttagctctgtatgagaaagctgatatcaaggggcctgaagaccaagaagaaacgacctccttatgggtgtgtcctcagatcgaggactgtgtggtgctattcagttcctccattgcataaacagatgaaaagcgaggttgcatacgacttaacagtcacgctgggcaatggaacgttatgcttgtggacctggtgaccaaaatcagaggcatactgtataggactcattctgaccagtttctggtggcattcaagagaagtgggaagaaagcccccatttgggagatgcgtcagtcatggcccttgagttactagattcgggatatg

SEQ ID NO: 547381 - DNA, 260 bp, Homo sapiens
ggggtgggggtgccgctctaatcggctccatatcattggagtttacgggttctcggtgttgggtttctgcattctttactgcgctcagatttaatgccttacaaagggaaagcctctggccgtcacagcgtaggacgcatgaaggtcactcgtggtgaggctgacatgctcagacattacaagagtagagagggagaatcctaggacagaggaactccgagagatgagtgtctggagcgcttcattaacaggttaccttt

SEQ ID NO: 547382 - DNA, 419 bp, Homo sapiens
  misc_feature (68)..(68): n is a, c, g, or t
  misc_feature (149)..(149): n is a, c, g, or t
ccaggagaatggtgtgaaccccgggaagcggatcttggctcaactgcaaccccttgccttcctgggcnttggacagtccttccccactctagccgcgcaagtagctgggaccaacaggcccgtccactggcctgctaatttttgtattntgggagtttttttgtagataatggggtttcgccatgttgcccaggatggtgaactcctgggtagattgcctgaggtcaggagttttgagaccagcctggccaacatggcaaaaccttgtgtctactaaaaatacaaaaattagccaggcacggctgggcacggtggctcaatcccagcactttgggaggctgagacaggcggatcatgaggtcagaagatggagaccatcctggctcatatggtgaaaccccatctctactagaaaatgt

SEQ ID NO: 547383 - DNA, 171 bp, Homo sapiens
cggtcgcctctcgaggctccccgattcactggttgatatatagaagcttatatcatttttgaataggggacgtttttattttgttacttcttctctctccttttcttttctttattttttgttctttgggaaaagggtgctcctcttttcccccgggtggagaggcggggg

SEQ ID NO: 547384 - DNA, 956 bp, Homo sapiens
  misc_feature (751)..(751): n is a, c, g, or t
  misc_feature (792)..(792): n is a, c, g, or t
  misc_feature (816)..(816): n is a, c, g, or t
  misc_feature (819)..(819): n is a, c, g, or t
  misc_feature (826)..(826): n is a, c, g, or t
  misc_feature (859)..(859): n is a, c, g, or t
  misc_feature (867)..(868): n is a, c, g, or t
  misc_feature (870)..(870): n is a, c, g, or t
  misc_feature (873)..(874): n is a, c, g, or t
  misc_feature (876)..(876): n is a, c, g, or t
  misc_feature (878)..(878): n is a, c, g, or t
  misc_feature (884)..(886): n is a, c, g, or t
  misc_feature (896)..(896): n is a, c, g, or t
  misc_feature (898)..(898): n is a, c, g, or t
  misc_feature (914)..(914): n is a, c, g, or t
  misc_feature (924)..(924): n is a, c, g, or t
  misc_feature (926)..(926): n is a, c, g, or t
  misc_feature (928)..(928): n is a, c, g, or t
tttaaatcaaccagtgatgcccccccagacccaaaggcgggtcaaagccgcctttccgtccttacttaggctgcaggataaatgtgttaacttacacaatttttgcacacttctaagttgatggtgctaagtgatggtacaaatgaagcaagtttaatattgaggggctgtgagcacctccctccatgtgaatcataaaactggtgactttcctggtatttatttacaagagtagcaaaacctcgttagtgtcgcctctcagatttaaggctttctgatgacactattcttaagaccagcattgatccgttatatacaaatatatgttttccatcgtttattattgctattgtcagaagaaagatgaacctgtattatttatgcatctacccgagtaactgcgcatggatacatagacgcactgtagcaaaacaaactatgttgtaaccacctctgactactatttgtatatcaaagttgatgtacttttgaaatatttggatctagtttctaagttatgtatagtgtttctatatgttccccagaaattacttctgaatctgtcaccacgcataatgagttcttggtgatacaatggtgagacttgtaatgagcaaaaagctagccgtggacgtagctcctcttttccttctttctgagtaacctgttttgtgattaccgtaagacatcacagattacctgaaaccccttccagtataactaggccctccttccttccacatttaattgnttaatagtttgaagaaactattggaaatgggcattttatangacatgtatggctttacaatattnaanatgagcnaaaagaaaaaatatgagaaggtttatgtgggtntgtaaggnnanggnngngnaagaannngtagtagttnanaagaggggaaaaaccnttaaaatcantnangcaaaaaaagggtggggggaaaaaaaaa

SEQ ID NO: 547385 - DNA, 481 bp, Homo sapiens
aaaaaaactctgccatttctcctgctgaactgttgaaagaaaaaatatagaatgatctattgctcaccagctttattttttaaacaacgccttattttgttgaaattgtcaaagactggatttagatctcataaagctttgttaaatgtttcccagtaaaaagtttgaattcagtaaaaattattgggtgttgtattgatcaaagcatgttaccccttccccccttttatagaccccccattttttttatgttaactagaaagcttttgttaaaaggtatttgttccttatttgggccacccccttgattatgcagacaacctcatcagctgcctaacttatccctctttgaacttttgaccccctgttggatttgctggaaatttagttcccctggaaagttttttttacttctctatggggatttttgtgaaggattcccaaaggttaagtttaaataaaacccagggattttttgcca

SEQ ID NO: 547386 - DNA, 113 bp, Homo sapiens
  misc_feature (106)..(106): n is a, c, g, or t
ctgtaagactaacagcaaggattctgggcgaacagaaaatccacccagagaagaacaccttcggaaaaattgttcgctgtgaaagagtttgaatcacatctggatnagttaga

SEQ ID NO: 547387 - DNA, 347 bp, Homo sapiens
  misc_feature (29)..(29): n is a, c, g, or t
gacatgatcacggctcactgcagccttgnctctagagctcaagtgatcctcccacctcagcctcctgagtagctgggattataggagtgcatcaccatgcccagctaacttatttgtatttttggtagagacagagtcttaatatgttgcttcactggtctcgaactcctgggctcaagtgatcctcccaccatggcctcccaaagtgctgggatgacaggcatgagcaccgcacccaaccaacaacacacttttgagcatgctctttttcaagggttggaagacataacattgtgaagatgtccatgctgcttaaagtgacccacacattcaacacaccgtcgacg

SEQ ID NO: 547388 - DNA, 381 bp, Homo sapiens
catgttatgtgcaattttagctttagttttcttacctgtaaaatgaggacattaagatttaccttgttgcattaaatgagtaatgattatgggtaaactacctagttcacagaaggaattcaataaagcataatttttttatttttcctttttctggaatcctcagtgtcttccttgctactatttctgtaatttcaagaacctgacctcatggtttaaacttcctgccctccctagttatggctaactgagagatagatggtggagtaagcacaattttctgtgcaattatattttctacaaaatcagagtattttattaaaaataagtaagccaaatattagacacccctatatttaaattgaataaaacatttagaac

SEQ ID NO: 547389 - DNA, 601 bp, Homo sapiens
accatgtgttggtcactttatagagaggtacaggcagtgtttttcccccatgctggtgactatacaatggtgtggcgtcagtgggtgttttgtgtgagatagtggatgacacaagtgtgggtcttaatttctttctggttatataattggggggatacttttttttttgtggttcacaggccatggtgtccacggatagatgtaaggggtagagtttgtggtaagagtaaccccaccggtaggctgtgttgggaggatataattgaagcttgattagacgcctttgtttttatagggtgaatgagtcacgcactcttagctgattgtttgcttcgtggggtgaaatacaattagggctgctgtgttgagtcctatgcgactccgcgccagttagtagtttcttcatgaatttagtttttatagcggcttaccccttaagagggggttaaagttatgtcatttgtgggcaacaagttgacaaagtgattgtcattgttttgattcgtcaacacagggtatatgggtttcccaggatattctttagggtttttttgaacaagttaatttaaggatattaagggttataatttgttattagata

SEQ ID NO: 547390 - DNA, 441 bp, Homo sapiens
  misc_feature (7)..(7): n is a, c, g, or t
  misc_feature (20)..(20): n is a, c, g, or t
  misc_feature (169)..(169): n is a, c, g, or t
  misc_feature (173)..(173): n is a, c, g, or t
  misc_feature (433)..(433): n is a, c, g, or t
aaccaantgggaaattaaantgaataagatggaaaatcctccctaggttgtttaagattgcctgttcttggggtggagggaattaaaagtacgtggtgtgacctgccattttcctgtatcctcttattcattctgtaacccttaaaaagtaagaaattatcccgggtancggntgtcacgccctgtaatccccagcactttgggaggccgaggcaggcagatcacaaggtcaggagttcaagacaagtctgaccaaatggtgaaacactgtctgtactaaaaatacaaaaaaattagccaggtgtggtggcaggcgcctgtaatcccagctactcgggaggctgaggcaggagaattgcttgaacccgggaggtggaggttgcggtgagctgagatcgcaccactgcactccagcccaggtgacagtaaaagnctctgtct

SEQ ID NO: 547391 - DNA, 971 bp, Homo sapiens
  misc_feature (1)..(1): n is a, c, g, or t
  misc_feature (486)..(486): n is a, c, g, or t
  misc_feature (488)..(488): n is a, c, g, or t
  misc_feature (901)..(901): n is a, c, g, or t
  misc_feature (903)..(903): n is a, c, g, or t
ntccttcgctagagctcagccacctgaggcaggatgctagatccatgagcagcatttacagagggaaataaggacactcaccaaatagggctactttgaagaaggacacagctgtcttagtgggacgaaggcagacgaattatctcctggtgcttaagactctgacactgtgacttgggatcaaagactgggtacctgcttgaaccgcgctcttactcatttcctcctgcagatcgtgatttttgctttttgtgtgccctcgcacggtcttttttcccttttgccacgtcgctaagctgccctcccggcgcgcctctctcgcccgacggccctccggggtctccgccgggggtgctctccgcgcccgtcgctccgccgccgcgtgtcctctcttcccccgctcccctgcctccccccgccgcgcgtcgctttccccggctccccgccgcccaccctttttttcgtggccgacctcgtttttttttntntcacccgtggcacgtgctgctgtgccctttgggggtgtcagtatacgtggtctccgtttcttctggtgttccccggtgcgttagcgtcggggtggctgcttcccgctccggccggtcacgctaatctgtgcctgtccggcgtgtcaagcgcgccgaggaccgccctccgccgtgccgtgtactgtagcgtcgcatccctctctctcccggcccgctgtcgggcctgcttctctaccgcgcggtgcgcttccccccctcccccgcgcgtacctcgcgcttcccctccggccgcgcccccgccccccacccccccgccgcgtgcgcgccgccgccggcgcttcccccacccgccgcgcgcgagccggaaggatcggtcttctgtcccctacaatcctgttcgtccccccgtacgntntcccgacaccgtctgtcgtggccgttggcccggtgcgcaccagccagcgcaacagcaagaagatcaag

SEQ ID NO: 547392 - DNA, 297 bp, Homo sapiens
gtgtcagctctggtgcatccacagaaatgagcaaatgggtagaaggtgtccatttcatggtgcccagcatggccgtggatagtgattaagaagctctgccctcttccatatgcagtgagactatgtgctccaactccagaaggggctgtgtaggaggcagcgcacgacgcacagggaccttaccggtagcttcccgtcaggaagctaatgaggagcaggagggcctactctcttgaaaagaagccatatgtgcccattgtttcccctccatgccacgaataatgggacattatcctg

SEQ ID NO: 547393 - DNA, 232 bp, Homo sapiens
  misc_feature (15)..(15): n is a, c, g, or t
  misc_feature (22)..(22): n is a, c, g, or t
  misc_feature (42)..(42): n is a, c, g, or t
  misc_feature (64)..(64): n is a, c, g, or t
  misc_feature (82)..(82): n is a, c, g, or t
  misc_feature (97)..(97): n is a, c, g, or t
  misc_feature (121)..(121): n is a, c, g, or t
  misc_feature (129)..(129): n is a, c, g, or t
  misc_feature (153)..(153): n is a, c, g, or t
  misc_feature (155)..(155): n is a, c, g, or t
  misc_feature (193)..(193): n is a, c, g, or t
  misc_feature (204)..(204): n is a, c, g, or t
  misc_feature (206)..(206): n is a, c, g, or t
  misc_feature (217)..(217): n is a, c, g, or t
  misc_feature (222)..(222): n is a, c, g, or t
tttagggtccccctnatctgcnttacaccctggtagaaacanaggcctcttacctcattttttnctaaagagcagctctttnaatcaacagactttnactggaacacctaccttgcaccanctattctnatttcagagtccatcttttctctntnggaatgtacaggctaccgagacagaaccatggaaacanaactggaatgntntatgatactgnaatanagatccccca

SEQ ID NO: 547394 - DNA, 595 bp, Homo sapiens
cgacatttagttcagggtagaatgactcatcttaggtgggtacaggctcaagaccgatacggtaacgcatatagagtcttcaaaggagaaacagaatactgtgacatagaagagtgctgaagcgttatcaatggatactacaacttgcgagacctgccacaattgactattgagtacaaagatcctagcaaacgaataacctcttctagacgagccttaaagacaacacctgagaagtatgttgcgacacacagacatagcattggagcaccggggatgttaaatgatacagatgtaggagcagctctatcgaccgtcaaaggtctgagatacgtagcagggctcaattctcagtgcgagtcgactataaagcagatgcacaactagttacggacgacaaggggcttaaaggagtgttaacccgttgagtatcaggtgcatacgtccttttgaaattgggtctaaatgaacccgacgtatttatcaggaactgattaataaccaattctgcacccaagaataggctctatgcccgtcaaataggaatcctaaaccccggggaggtagaccactaaggtcatagggataccactaa

SEQ ID NO: 547395 - DNA, 936 bp, Homo sapiens
caccatagcctaccccttccttgtactatccctatgaggcataattatacacagagctccatcgtgcctacgacaagacgagacctagaaatcgctcattgcatacgtcttcaagtcagccacatagccctcgtagtagacagccgattctcatccaaagccccctgtaagcttcagccggcgcagtcatcctcataatcgccgcacgggctgacatcctcattactattgctgcctagcgaagactcagaagctacgaagcgcactcagcagtgcgcatcataatcctctgctcagaggatcttcaaatctctgagtcccagctaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcaccaccaaattagcaacataaaacctcattcacacgagaaaacacctcatgttcatacaactatccccatctctctattccttgaaccgaatcataccggtttctcttaaaaacaaacaaaaacaccttgtgggcgcgccgcaccggaaaagtttaacccattgtggggcgggcccaatatatgaaaagtgcaagtggatccagaaacgtgccacaacggtggtctccaaaaagcgggggcgagtctcaccaaggtgcttgtttcgacacctcactcccccgcgtcgtgataaacgcggagcagcacaacatgcaccaacacacaatcgcgctcatctattcattagtacacctcaaaagacaaaaacaaatcagcgaaaaagacacaagaattcgacgagggaaaaagaaaaat

SEQ ID NO: 547396 - DNA, 548 bp, Homo sapiens
ggaacccccctccgttttgtggcgaagcctggctcccacccaaggtgtttattcttccccgccccgcggggaccattgggggacccttttgtggcatcacgaaaccacaagtccccggtcgggcctctttgggaggcccccccaccagtgggttggaaggccaaaaatccttcttgtttgttctcccagccccccccccccaattggggttcatcagggttggttttttttagggcccctagttggggggccccccccaaagtggttttggacccacccaagcgggggggccccctgggggtttttttcttttcccaggaaaaatttatttgggcccccctgggtttccggtgcaatgaccccctccccaggggtttttagccccctccgtttgggcaaccctagggaccagggtgaggaccccccggatgacaccccccccccccccgggtggatgggggttttgccccccccccccagggggggccctccttagggggaagttaaaagggctcaaaaaggcccaaataaagggtgtgggccgggga

SEQ ID NO: 547397 - DNA, 104 bp, Homo sapiens
tcgacagcatcctaaccagaaaagggatggaggggactggcaggatgaacagcggtatgaacatcactagcatctggacattttaagtacgtggttgtaaatgt

SEQ ID NO: 547398 - DNA, 333 bp, Homo sapiens
  misc_feature (70)..(70): n is a, c, g, or t
gggggaaaggaaggggataaaccaggaatttttagggcagtgaaaatgccttctaaggtgatatgataangtgtatacatattcattatacatttgtttaagcccacagaataatacaatattaagagtgagccttaatgtaaaccatggaatttggatgataataatgcatcatgtaggttcatggattgtaataaatgtaccactctggtgggagatatgataatggggcaggctgtgcatgtgtcggggcagagagatatgggaaataactgtgccttctgctcaattttgctgtgactctaaaactggtctaaaaatatgtagtctatt

SEQ ID NO: 547399 - DNA, 406 bp, Homo sapiens
  misc_feature (135)..(135): n is a, c, g, or t
  misc_feature (183)..(183): n is a, c, g, or t
  misc_feature (269)..(269): n is a, c, g, or t
  misc_feature (274)..(274): n is a, c, g, or t
  misc_feature (339)..(339): n is a, c, g, or t
  misc_feature (399)..(399): n is a, c, g, or t
ggatgaagccctgatgacagccctcaaaaacccatgtttactctgagagaagagctggtcaagccagagtttcagcagctcagtgggcctctgaagacaaagcatgttcccctctcacttgcaaatctccagccntcttgctgccctgaagattgcacaggtttggcagagatggccctgccnatccttggcaaagtgctcccttgtcccaagctcagcttctccaaccagaaacagggctggagccccacaaactactgcacaaagtnctcanctgggtgggccttacaggggtgggtcaaactgtaatttgacctttgacccccccacttttgcagnatatgtgaccttgggtcaggttactaaacttttctgggtttccttattctggaaataagnaaaagta

SEQ ID NO: 547400 - DNA, 1692 bp, Homo sapiens
  misc_feature (290)..(290): n is a, c, g, or t
  misc_feature (420)..(420): n is a, c, g, or t
  misc_feature (1350)..(1350): n is a, c, g, or t
ggcgcccagccctgttattccacttgcagactcccatcagattgtatagagcgagcagtgcggatgccaaggagaaggcattccagatagcgactcgagggaggcagcttcgtaggcgaagttgctgcgcctgttgcacatgagtactgtggcccctagcgacgggggtcgcaggaggtgcccaagctcaccacgataccggggactgcacagtgagtgcataacactcactacttcctagctgagccatgttgcttcctagacaaccatgctgcacttggcgctttctntgactggtttctgcgcttcgcgtggtggtgcgatctagctctcagtttcgtgactcagcctccttgtcctgagttagagctcatttgtcgcgcgctggtctgccttgagaccgtcgggcattcatacgantgtctggtttctagttaaaactaactccttggatagacatcataccgaattcacgcgagtggacaccggcttgccgcctgctcgtacgatccggattggacgactcgcgtcacgtgcacccattgaacggggggctctcagctcctcgttaccgtagacttgggacttgattgtgcgcgtagttgagttgcagcctatttcgatgaaattcggttgccatcgccgattccttccttgtggatggatctatactcacctggtttgctcgccctccttgttgggggcacccctttcaagagaactctgtgcaccaatgtcgagtatccgaagacaaaccgtatttgactccgggggatcaacgactttagagagggagttgttcgagtaaggaaaggccgcctataataccatacatggtaggccttccccattgggaggaaggccccacgtacacatggtaataccgactcgtccttgcgtgttgaccttttggtggactcgacgtttacaaggctccagagagcctacgtggtgggcacctggtggccgaagcgaagcggccacttgttggcgccgagcccgtactccgttttccacccttggggtcccccggccagtttcttggacacacttccagagttgccccctctttggcgtttcacttttcgccgcgagactgggggcatagtcggccatttttttgcccaggacgttgtggcccttgcaagggaaccggacacgttccccactcgttggccattgtgcctggtgtttggggagccctttctgggtggctggggaccccccgaggaggggctccacatccggacctttgatggttcgcgcctttgagacacagggtgtcagtcctatgggggcggatataacacccttttcgggggcttccacgtgtgccttcccccaaggaanggccgagacggccgttccagctaccatttagccatgggcggtacccgagcgggaacttttcacactccttgttaaccagtctttggggatggcatctccacaaagagcccccgcaacactgggcggcacagaggtatctataagttactggcgcatagcataacccccgcgggttagaatgcatctagtagcagtcggaacatatcgaacacagagacaactgtgtccgtttgttcgcacaccacgactcaccgctcgaagtgaaaccccagaacactagtggatataagcgccggtacattgagttactactcagatacatcggagcacaaaccaacatct

SEQ ID NO: 547401 - DNA, 393 bp, Homo sapiens
cacggtggctcacatctgtaatcccaggacttgggaggccgaagcaggtggatcacctgaggtcaggagtttgagaccagcctgggcaacatggtgaaatcctgtcactattaagaaatacaaaaaaattagcctggcgtggcggccaagcacctataatcccagcttagttgggaggcctgaggccaggagaatcacttggagccaggaggcggacggttgcagctgagccgagatcgcgccagcctgggccactagagccaagacgtccgtctcacaacagcaccacaacgacgccaacaaacaaaaacggggggggcgcacagggccccgcgggaagcgtttacaaacagcggttgggggggggggcccgaagggaggggaacacggggc

SEQ ID NO: 547402 - DNA, 651 bp, Homo sapiens
  misc_feature (25)..(25): n is a, c, g, or t
aatatgctgcagaaaatgccagtgntcttacatatcagatgggagatcggctctcccatgccaagatgtctgctcttaacatgggcttccttcaaacactctgcattgcatttgtttgcatttgttttgagacatcacaacagtaaagagaaaaaaaactcccatttgcatagagcttctgagtcttcagagactcgtgtgtctcctctcactgggcattcacttccatcttgggaggcgcaccattttactcctctcacagaaaagaaacagaagcaccgagcggttaaacaacttggtccaaagccacttggtatgtcatgacttggtacgtcatgaagttgggctggaatttagctggaaaagtgcaggatgagcggctgcatttgtaagtgcataaaataactatgagctcaatgagtaactgacgtacaccatcacactcaccctgggtgctgccaagcgtggaagctatttaaccacagctcactctaagcacgacgatggagtttatctataaacacatttttcattattaatcaagtattggctttgctggcatcatttttccaacagaactttatgcaataaaatatccttcaccacaaggttgagtagcacagagctatcctgagaagagtctttttggga

SEQ ID NO: 547403 - DNA, 931 bp, Homo sapiens
cggtcacgccgagccagcgcctgggactggaaccgggccgtagcccccccgagtattcgtccatccatcgtcctctaccagtggatcccctcggcagaagtgaagcgagcatgtcgggctcgtttgctgcaagaatggtgtagagctaggatcctgacgcggttctgctagcagcctgacggaaagtgcggtcttccgtggagaggacgtggggtggcagagcaatgcggtgggtaaacgtaccgaccgtgcgtactctagaaacgctaaagtcagaaggaagaatactcacagggaagaatagatagcgcttgatatgtagatgaacggtgcgagcgaacgaccttagcacggcagacagaaacctagtcaaagtgatggataacgtgcatctacggaacattgtgatcatacacgaaggggtgttgacttcgacatcgcaagagctagctgactgcgtcctctagaggataactggagcaggactgaataactgcgtgtagagtactccgtgaggagcatgactggactcaaggcaagactgatacctatgaacgctggcctgcgtagtcgaagtcccgtagaatgaggtggtgtaactcctagacatgccaattgaccttgatccgacgatgatgcgcatctaaggctggaatccatcggcttcgggccatgattggcttatagccaaaaggaaggggcccaaggatggtcctttcgtcaccaagtttacagaaagccaaatgcttgccatccgagaactgtgagagtagccatcgagagataaaatcctgagtcagacttcaagccgttacaagatgggcgtgggggaacacgcacacgaagacttcttaagggccaacttgggacagaacgcagacccattgaatcttggcccctggcctgtaacgtgggacttatgatggaagat

SEQ ID NO: 547404 - DNA, 83 bp, Homo sapiens
agaaggcctagagaaggctgtgagccaaggagggagggtcttcctttggcatgggatgggcatgaagtaaggacagggactgg

SEQ ID NO: 547405 - DNA, 437 bp, Homo sapiens
tctccaagacattttctatggagtacagctacaggatatcaatcatatacagagaatgcacaaatatggaatgaaacctcagcaagtaaagtggtggtaatgaaccaaggtatagaaatcgttgatttagctatgagaatagttggagctaagagcctagaaatgaacagacctcttcagcggtactatagagatatacgtgctggattacataatccaccaatggaagatatggcttacactaatattgctaaaagtattacaaacaaactctaatgtcatattgatattctttaaaggaatgagatggaatttaatattcttcattgcaacgcatataaattttaaaaaagcgcaatgtacattaataatttaatttagtcattgatagacttgtcgacgcggccgcgaatttagtagtagtagtaggcggccga

SEQ ID NO: 547406 - DNA, 289 bp, Homo sapiens
gcagcgtgacggtgagatgtgtccccgcgcagtgactggccatggtgctgacgcggggctgagcctggagcacagagagggcgagcggagactcgctgccagtactccagctggtacagaacgcagaccagcacgccctcctgctctgaggacaccatcccctcccaaggctccgactacgactgctactccgtgactggggatgcggacagcgagggcccgcccgagttggacaagtcatccagcatcccgcgcaacagcaacatcgcccagtacaacctgccggtgg

SEQ ID NO: 547407 - DNA, 214 bp, Homo sapiens
aggacacacaacgagtagtcgtcacagcacacacaaacccacacaacacacaacacaacaacacacacaaaacacaacacacacacaacatacacaaccacacaacacacaaccacacaacatacacgaccacacaacacagtgcacacaaacatagcacacacaacacacaacccaacacacaaccacactatacaccatatcgcgtcagaat

SEQ ID NO: 547408 - DNA, 351 bp, Homo sapiens
ccccattcacgttcgtgggagataatgttttttcttttctttcttttgttttgttgtttctgagatcatgccattgcactccagcctgggcgatagggcgagactctggctcaaaaaaaaaaaaaagaaaagaaaaagaaaaacgaaaagaaaatgcttcggggacttttcaagtatgcctggctattcagacatcctcagagattaaccccaaaagtgagtgattatctcccgtgagacccaggtttagaaaaataacttcacaagtacaaaagtgggattatggccctaatgtgagcccactttaaagcaactaccataaacaatctaaagcagagtctgcaactgtgc

SEQ ID NO: 547409 - DNA, 159 bp, Homo sapiens
gagaaacctacccaaccaagaggcgccctgctttgtaatgacctttacgaagacacgtctgatacccaacctgacagaggaaacaacagtagtctgaaagggacagaatgagagagggggctggagaaagaaatgaataaacatgaatgcatctggaga

SEQ ID NO: 547410 - DNA, 179 bp, Homo sapiens
tggactgcgggcaaacacaatagcatgtgtgcagttggacaaaatcctgggttactaggtgtcttcagaagctgatggcatccaaagcaaatgaccaccaaggtattgtatcttctaaacatgtataattagagcacagtgcctccgtgaagtcaggttgaccaagtatagggaaacga

SEQ ID NO: 547411 - DNA, 181 bp, Homo sapiens
atctcgccttgtagccagatgatctcaaaataataataataataaaatatataatatgtatatatacaatattgattactgcaaaagatagtcatgacaaagatgaatcctttatcagacacccttgtagtggagcatctctccccacgacttttttcttttagttatctttttttgggaa

SEQ ID NO: 547412 - DNA, 187 bp, Homo sapiens
acttagaggatccgcgggcgaattctactactactgtgaggagggctacgtctggccggggaggacgggactcagtgccaggacgtagatgagtgtgtgggcccgggtgctccttttgcgacaggttgtgattcaacacacaagggtccttccattgtggttgcttgcaaggatggttgctgccccc

SEQ ID NO: 547413 - DNA, 1469 bp, Homo sapiens
  misc_feature (859)..(859): n is a, c, g, or t
ggccggacaggaggctgccggagggcgggaggcaggagcgggccaggagctgctgggctggagcggcggcgccgccatgtccgacagcgagaagctcaacctggactcgatcatcgggcgcctgctggaagtgcagggctcgcggcctggcaagaatgtacagctgacagagaacgagatccgcggtctgtgcctgaaatcccggggagatttttctgagccagcccattcttctggagctggaggcaccccctcaagatctgcggtgacatacacggccagtactacgaccttctgcgactatttgagtatggcggtttccctcccgagagcaactacactctttctggggggactatgtggacaggggcaagcagtccttggagaccatctgcctgctgctggcctataagatcaagtaccccgagaacttcttcctgctccgtgggaacccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttgggagccgaggtggtggccaagttcctccacaagcacgacttggacctcatctcgccgagcacaccaggtggtagaagacaggctacgagttccttngccaagcaggcagcttggtgacactttgactcagctccccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgaccatcaccccacccgaattccgccaaagccaggaaatagcccccgcaacacctgtggccagatgatggattgattgtcagaacatcatgctgcatgctgcggggggtcacccgacccctcaggccaccgtaggggaacatgagcctcggcgaatccctacctcgcgaacatgaatcatagcaagggcacccccaggatgttcctgccgccgagggtacctgaccaggacctggggccagccgcaccgcaccggcgccagccgggttccaccccgtgcccaggcgcaccggacgggcaccctggccgacaaggcacgcctccaaaaaacaacaaaggggccagacacccggccccagcacccaagacaaggacaacccacgacacacccaccagcggacacaacgacagccgccaccacacccccccacc

SEQ ID NO: 547414 - DNA, 182 bp, Homo sapiens
cttgcggtgggcggcgaagtcccgggcaaaagcccgagcacggtgtccgcccgcaaactgatcctccaccatggtgaggcccatggcgtttaccgacatgtaagtgcactgggtcagcggcgggaaaaccagcgccaagaagcaggcgatgcccgccacttagctcagcacgcacaacggcg

SEQ ID NO: 547415 - DNA, 167 bp, Homo sapiens
accagggtctaccctcgaaggtagacagaacaggtagtcctgcacaccctccagcccgctcacttgctgcttcaggtgggccacggtctgcgtcagccgcacctcgtaggtgctgctgcggcccttgtttattcctcaccaggtatgctcagacggttcatctatat

SEQ ID NO: 547416 - DNA, 504 bp, Homo sapiens
gcagtatacaatcgtacactagaatgtgaccaaggagtgaccctggtccgaatctcattatatcttgaataggatgcaagcgcctgcatccttccccgagaaccaatctatagaaatgtactgttggcattgctgctgtttataaacatctgcgatagcttaggggtgtctagccctgtcaatctggccaaactctgtggctaaaaatcagaaagctcccctaatgggaaacttggtcactctacccccagagcttgcaaggctgtggcctaacgaatgttctagaagttcacagcttcctccctcaatgtcttccacttcgacattttccccagagttcatgacatatgataaatgccaacttataaaacaccttaagacagttcactgtggctgcattccatttttagaaaaatgcaacaaagagctggatgtggtggctcatgcttataatcccagcactttgggaggccaaggtgggaggactgcttgagtccaggagtt

SEQ ID NO: 547417 - DNA, 227 bp, Homo sapiens
gaagcgagctcggtacctgtaagcattcgtgatccgaatgaagaacgagttggggcttccacagccctccgtctcccaagaaagtcctggctcctctcccaagaaatccaggtgctttccagcactccaaagggtatcttaaatgcaatctcgtctctcttagcccttggccactttctcccggatcctgccctgtgctcagttgttgtacgagacacgaatgttca

SEQ ID NO: 547418 - DNA, 119 bp, Homo sapiens
tcttacactgagttttgtctctaggtaagcacaactatgaatttctgaagggtagggaccatatgccccaccccagttctggccttcgtgttctacaattacatacatgccgggctgct

SEQ ID NO: 547419 - DNA, 623 bp, Homo sapiens
  misc_feature (7)..(8): n is a, c, g, or t
  misc_feature (12)..(12): n is a, c, g, or t
  misc_feature (21)..(21): n is a, c, g, or t
ccaattnnactnggtaggagncgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaagggactcagaattcatgattgaagaaatgcaggcagacctgttatcctaaactagggtttttaatgaccacaacaagcaagcatgcagctttactgcttgaaagggtcttgcctcacccaagctagagtgcagtggcctttgaagcttactacaggcctcaaacttctgggctcaaagtgatcctcagtgctcccagatggtcttagtagactgctgatggagtctcatggcacaagaagattaaacaccagtgtctcccaattttaataaatttttgcaatccataaaaaaaatctaaat

SEQ ID NO: 547420 - DNA, 567 bp, Homo sapiens
  misc_feature (12)..(12): n is a, c, g, or t
tacatataaatngagctcggtacctgtaacattcgtgtcccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaagggactcagaattcatgattgaagaaatgcaggcagacctgttatcctaaactagggtttttaatgaccacaacaagcaagcatgcagctttactgcttgaaagggtcttgcctcacccaagctagagtgcagtggcctttgaagcttactacaggcctcaaacttctgggctcaaagtgatcctcagtgctcccagatggtcttagtagactgctgatggagtctcatggcacaagaagattaaacaccagtgtctcccaattttaataaatttttgcaatccataaaaaaaatctaaat

SEQ ID NO: 547421 - DNA, 689 bp, Homo sapiens
ggggtttgcttgtcactcaggctgcggtgtggtggcacacctggctaatttatgtatttgttattttgggtagagatggggtttcgccatgttgcccaagctgttctggaactcccgggctcaagtgatccgcctccctcggcctcccagagtgctgggattacaggcacggaccaccatctctaccaaaaaaaaaaaaaaaaaaaaaaaacaaaaacgaacgaggggtgggccccaacaagaaaacaatcctccccggggggcgccaaattcttatcagccgctgacccaccatgttgtcgtggaagcacaagggggcccccacataagtggaggggagcagctaaataaaccaggcaacagacgggacggccgggttttaaccacaccgactcggttcgacgtgggaaaacagcgggaggcagcggagggacaccctgtagggagggcgacaccacccaaaccatcggaggggggggccaacaatcagtggggccagcacaccactctagcaggaagcatgtaaagagcccgcagggggcgtagataaacaacaactcgacagcgcatcatcgggtgggcaacaccacgcggcggccaaacgcgtgtcccggtgcgacaacaaactgaggcaagcgagacgtatgcacccgtcagacaattatttagcgcggagcggtaacacacga

SEQ ID NO: 547422 - DNA, 304 bp, Homo sapiens
cctgtgagactgagctccctctctctccatttatacgttctctttatgccctttgcttctctttcagagcaattcacgttgacctgggtcaccctcaacttaaggctcataactcccctagatcctcagggtccacactaaatgtgatgaaatatgatggaagccacatacttacttttgcattttgtagtaaccacattttaaaaagtaaaacaaaagaagtgaaggtaattggaataatatcacagatttaaacaaatctatccgaaataccaggtctacaagtataaaatattttaacatt

SEQ ID NO: 547423 - DNA, 226 bp, Homo sapiens
  misc_feature (7)..(8): n is a, c, g, or t
  misc_feature (12)..(12): n is a, c, g, or t
  misc_feature (21)..(21): n is a, c, g, or t
ccaattnnactnggtaggagncgactcctgtgaggtatggtgctgggtgcagatgcagtgtggctctggatagcaccttatggacagttgtgtcttggggaaagtatggtgggaagaatgaaatctaagaggtggtctcagcctgtgatgctttaagagtagtggacagaagggatttctgaaattctattctgaggctttaatgttaacagcattaatatttaac

SEQ ID NO: 547424 - DNA, 156 bp, Homo sapiens
tatggtatttcccataaacagtgcagctaagaaacagtttagcagcaaaatttaaccaggattcagattatatcccattcttgtctctcgggcctgagaggtaataaattccccatatgggtcctagatcctcccccaaatggttttcccccatct

SEQ ID NO: 547425 - DNA, 964 bp, Homo sapiens
gcatataaacaaggtaaagaattaagtgctttgcttttgatgtgcatacacataaacatctcaatgccttgaagagcaatattgctgcccgcgtgtcccacctccagccctaaggcggtttccccctatctcagtagatggaacatacaatcgggttttacacgagacattccattgcccagggacgggcaggatacagatgccttcctcttgtctcaactgcaaagaggcgttccttcctcttttactaatcctcctcagcacagaccctttacgggtgtcgggctgggggactgtcaggtctttcccttcccacgaggccatatttcagactatcacatggggagaaaccttggacaatacctggctttcctaggcagaggtccctgcggtcttccgcagtgtttgtgtccctgggtacttgagattagggagtggtgatgactctcaagggagcatgctgccttcaagcatctgtttaacaaagcacatcctgcaccgccttaatccatttaaccctgagttgacccagcacatgtctcaggaagcacggggtaaggttacagatttaacagcatctcaagggcagaagaatttttcttagtacagaataaaatggagtctcctgtgtctacttctttctacacagacacagtaacaatctgatctttcttttcccccacacattactgatagaacgttgttgatggtagatttcccgggtcgctggggtggtggtcaccccgttatcccaagctttggaggccacgtgggcggttcacttggcccgggttggaatcgctggcactttgtgggacccgctattaacgcggcccacttgctggggggggcggaacactggccaattacagcgggcggggcccctttttttatccgcttagcatggcccccgccggacgtctcgtatgcaccatcctcccggagcggccgcttcgctgcgggg

SEQ ID NO: 547426 - DNA, 241 bp, Homo sapiens
gtctctagcaggatccccgtaggtaagttttgatccaagaggatcaattacgcctactcgacaatacagttgcaaaataaggtttggaaccagtggtagctagtctacacctacaacagcgatcttgcttccctttagacccctgtacatgagctctcctctccccgcttccttcatccccttagcaaccactatatctaccttctgtctgtgtggatttgcttgttcctaacgtctcgag

SEQ ID NO: 547427 - DNA, 283 bp, Homo sapiens
gctcaagttgatccttctcctcgtcacgtagcctctcctccggtttcacacagcctctcctcaggttcaggtagcctctcctccggttcacacagcctctcctccggttcacgtagcctctcctccggttcaggtagcctctcctccgggccagggttaacccccatgaacagcatccagacgggaaacacattatgttcatgggcatcggcaaggtgatgtcccaggggggatgctccaggtggacgggatgacaccggctcacacgggtcaccatttcctt

SEQ ID NO: 547428 - DNA, 1307 bp, Homo sapiens
gcagcgggagggcgcgcggccgatgtgtacgtggtctcggcgccgggaacatggctggagagccataggtcgtggccatgggactcgtgtggcagggccaaggcttataggtagtcatctcagacttctacgagatgcagcttgggcgtacaagtttcgctgtggtacctgcatccacgagtacaacttgacatgactcgcgaccactacaggccactggagaggggtggggtggccgctggcgtgtccgctggttgcacgttgcatgtcgagttctgtgaggtaccatcagctgcagaaggtgctagggatgtctggacatggcccattcgctgtctagatggagtgctctaggaggtatgaggctgtagtcgactcacgctgttccatcgtttgctatgcgttggaaattgcccgagggggggaagacgagaagacgatggggggtgtccttctctcattccttgcagagggactatttagactaggccgtgggagggggtcgcgggggtggatctccctacacaagtccgaacaaaacttctggtggaactttgggtagaaggcaaagggggaccaaggcatgcaattaaactgggggtttacgtaggcgggattgtcgtttgtaaaaccagagtgcgctttgtttctggtgcaacccgtttggcattagagtgaatcttgttgagcctgggggaaccaaggaaacgaagaaggttagattcggcgtgactcactggtgggtgaacacttcccctgcaccgccaatcaccggtttaccccattggtggaacaaatgccgaaattacgcatggaacttttacccgttaggattagccacctgttgatgttcatcacggaggggggactcatgggtttgtggtcccttttaaggaccggtccgccacattcccttagaactcaacgaagggtgacccttgggctcaggttggtggagtgtgacaggttggtgcttggtgggagtgggtctaacagttcttacatcacgggtggggtttcctatttaaaaactttgcgaaggtgtgaggaacaacacttgattttttaaaaggaatatatataacaaactcgagaaatgtaggatgcatgggtcgcggggatcgcaatttcacaggggtgtttgggcgaaaaacagagagggcgaacatttgtgggcagttgatgtaaagtgtcggggttgtttgagcagcaatatttggtgttaacacagggggggatgaactaggagaggaaacaagatgaagtggatttcgtgttagatggagacagacgaggcttgaggtata

SEQ ID NO: 547429 - DNA, 1570 bp, Homo sapiens
  misc_feature (31)..(31): n is a, c, g, or t
  misc_feature (706)..(706): n is a, c, g, or t
  misc_feature (892)..(892): n is a, c, g, or t
  misc_feature (1118)..(1118): n is a, c, g, or t
  misc_feature (1350)..(1350): n is a, c, g, or t
gcgtgtggatattgtcttctgtcgctgaagncccaccgctttgtggatgaagagttgcgttcctttccgccgtcttatggagtggtagcccctcgctctgtgtggggtattcgtgcctccttttaagagggagctcttttctttatagactctgcaccaccggttattgttatgtaaatagttgtggtgggaaaccacaccccgcggtggaatgtttatagcggggtctttttcctccccgtgtgaagcggccaccacgcgtggtgggtttggtgagcacccttttttttttgctcgtgggtgaggtgagtgacaacacccacgctggtggcccacacctctggtggagaaaattttttgtcaccaacaaaacaggtgtttataaaagccttcttgggttaagaccccactctgttccaacacctgtgccccacattatctttataaaaaagacgcggggttatcttttaatgcccccctccacgctttaaattgtgcgtgtttgtcacccaagaggttaacacccggtctctcgaagagggaattttcctcattgttctacccacccgcgttgtcctttggttgtcgtcaaaagacctcggttgttaagggctttgggagagttgtgtttggagaaaaccacacgctggtcctttttgtgggtgagacaactcacaggggcccctctctctgggtccaccacgcncgccgttgttgcttttgagaagacctttctcttgtggtgtttcccacctttccccgcggcgtaacttctcttcaccccccggtggagatttttttctcccaccacgtggtgcgcgacgcccacgcctcgtgagtgggtctcccacaaaggacacacagcttttctgggcgcccacccctctccagnggggaccctcccctcggtcactgtttgcctcggcgacactctttataggccaccggccagaggccccccctcgagacgctgtgtctcccccacacacagggtctttttcgcctctcacacggtgtcctccactctctcccctctttggcgctcgctggttataaagagaatatggcggagataaaagggggagatacacagggagtagagagaggccccctctctngagagggcccacacttggacgccacatatattccacgctctttatatattatctcttatatgtctgtgagagatgttggtctgttctgttttctccaccacgtttccacccccgcttctctctgagaacatttatggaccacgctatggccgcgctatatgaggagtatactccacggccctctaatccactcgtttggtgagtttcttctcttttctctataggtggaggntgtgagaatgttcttctattccccccacccacgagaaggagttattattcttatatgagctctgtgtctctgtgtcacgatgttctgtgatttacccctctttattgaacacacactatgactaacgttcccactcgtgattttttgttacccaattctttctgagaaaaaaacccacaacccaatgtgaaacctttaaatttaaaggcctttataatta

SEQ ID NO: 547430 - DNA, 450 bp, Homo sapiens
ccttacggtgctagacagaaaaataaatcccaataagtgtctctacctatactgcccctccatgatggaagagcccttcttaatcaacaatctaccggataatctgattgaactatgtgatatgtatcaacttttagcagctcgaggaatagcaatcctgcagaaaaatttggtgtttttacttttgtaaggagagtctgggtgggccttagtgaaggaaagttcatgtggcagatccagtgtggccaatgtgtagcctccatccttgccactgtggcttcctttttaaataaatattggataaacattagactgggggcacccgaaagccatatgtggcctataaacttctgtgtttggcccttatacgtttcaaaaattggaacatttcatgtcaccatttggttttatggcttctcttgagaaacaatgaaggaccatctgacaaca

SEQ ID NO: 547431 - DNA, 268 bp, Homo sapiens
attggttttaaacaccttcacgacaagagatcggcgggtcgatgcgccgtgttcaagtgcaagaacgagtcggacgtggcgtgcatttgtccgcctgcgaccatgttctgatagtagcgctgggaatcccgcttgaaccaaagcctggtgaatggccagaccttttccagtgaaatcggcctctatcagccgccctatttgcttgcggttgacatacttcggtacggggtaattcgcttttacttccttccggatacttatccgtgtc

SEQ ID NO: 547432 - DNA, 300 bp, Homo sapiens
atatatttgaatggatatatgatagtacgagaaatagtggaagtagtgataggtatgctgggagatatacccgagtctataatgctataattaccgtttgatattggaccatatgcatagtaccgagaaactagtgcgacagaagtgatcagagtattgcctgcttacgactatccccgacgctccttcaagctgcctactcacttccccttcgcatactcggcacccactactgcactagctaccgcacgcaaaccctagctgccgaagctacctgactcaagcgctactcgcctgctc

SEQ ID NO: 547433 - DNA, 350 bp, Homo sapiens
tcaaggatcgtggtgtatgatttgattctacctcttggttatgtgagtagtgtgtagcagcatgggtgtatgaatgctcttccagaccttgccttcagttcctttggatatgtggccaggagtgagagtgctggatcacgtgaaacagaggaagctccgtattgtctactacaggagttgcactgctgtacggttttaccaggagtgcgcaggtttccagtttcttcacatcctcatcagccttgttgctgtctgttgtatttttctgaatacgtagccataaataactggatatgaccgtgatcttccgtaaggttaaccaaccacagtaacggggggtaaccgaagcc

SEQ ID NO: 547434 - DNA, 572 bp, Homo sapiens
caacgatggtcctcagctactaggaggctggggcacgagagtcgcttgaatctggaaggcggaggttgcagtgagccgagatcgtgccactgcactccagcctgggcgacagagtgagactccatctcaaaaaaaaagtgtatgtgagtggtttccttcatgacagtaacacagttattatctaactgggtcaagtagagaaaaggcataatcctgctcatctttccttgtgccccttggcttgattatgttctttctcattaccttggccttctatcccagaccgaatgttttcagcttaaaactccattcaaacttgacttgaatttagcagctgaactgtgtggggaaagaagtttcactgaggtacaagaaaggaaggcattgtttaatctgtagaaagattaataaagcttttctaggcctgtgctcttcagtcacttagtggagttttggaaaatctatctcggttataaagtggtgcttgtcccaaggggtaagttgaaggagattacatgaaagtgttctctctgctcttagaatatcagcatgtggtcatttggggtcacctt

SEQ ID NO: 547435 - DNA, 490 bp, Homo sapiens
  misc_feature (142)..(142): n is a, c, g, or t
  misc_feature (240)..(240): n is a, c, g, or t
atctgatatcagacaaggtgtgctggagtaatgcaggtgctctgtcgtatgctcgatattggcggatcctatctgtgtcatgtcctcctgccactgctctgtctactacctgctgtcttgtcaggtcccagccctagctgtnctgatgcctgaccagcaggatgcaagctcaggagtgcatccaggataccaggactgcgagagatatgtggtacggggaatactctgcctgcttgcaanaggttttactagggtggggagtttctagaaagtagaggggctgtgggatcagtggtagtggtgcgtggcttttcttgagggcagaagatgctagaggaggttgaaccttataggggatgatctagggaatgggggaacttggggatgctggagtaagagggctgcctgcgtagggccaggagttgggtcggcagagatggtgctgtccatgcggaagtgctagtcccaccacacgccatctcacttacct

SEQ ID NO: 547436 - DNA, 254 bp, Homo sapiens
cgtaagtagttccgtgtggctcagtggttaaggaatctgactaggaaccatgaggttgtgggttcgttccctggccttgctcaagtgggttaaggatctggcgttgccgtgaggctgtggtgtaggttgcagacatggcttggatcccacattgctatggctgtggcataggccagcggctacagctccgattcgacccctagtatgggaacctccatatgccacaggagcagccctagaaaaggcaaaagacc

SEQ ID NO: 547437 - DNA, 259 bp, Homo sapiens
  misc_feature (1)..(1): n is a, c, g, or t
naccccccccccccccccccccatcttggggccttgcctggcagataacccgggttggccccaaaagctattaatacccgccagcatgtggggaaggacttatggtgggccagggggccctcatcctgctttttcccccctctggtttaaaaagaaaaataaactaatttcccataatttgggggggcaggggattggtttttacataagtcctatttaacccttttatatgttccagaaataaaagttaatttatata

SEQ ID NO: 547438 - DNA, 669 bp, Homo sapiens
atacacaagaaatatttattaatgctgtgttgaattgacagggttaacatatcaaaccaagatgaattaccacgtgggcagaaaggacatcattctacattataacccagtggtttctgctaccacattgggcatgcgcgcggggcactatgttagggagcatttcatatgaagcaagctacttctctctttgctgctacgaacctaacccttttcttgttgcctgacgtagccctagtcaccaggagacaacatgacaataatgcgggcccggcccgggacggggttaaatgctaccaggatgacctttgtctcatgtgcacatatattgccaagcatttatttccatagggtaggaggaccttgacacccatgcaattcccatagaaatcttaatggggaaaagagccgtacccatccccagctaaagaacccgttcctttgtctcactgaattttctacaggcgaatgaggaagagttaggaactcctccctgcttgggtggcgaaggggccttttatgagggaaaacaaagcggggggtgagaaaaacccacacttcacttgggccggcccctgtggccaaaaaccttgtgaaccaaagcgaatccaagcgtctttcttaaacaaatttgttgaatcctattccagcccccagcacttggttttg

SEQ ID NO: 547439 - DNA, 130 bp, Homo sapiens
acccgcgctgtaatcgtcgaactcggagccgtcgacgatgcgcgcgatgacctcgcgcacgtcatacggcttgcgcgtgtcggcggggatgatgccgttcagctcggccgggtcgtagcgcggctcgcgc

SEQ ID NO: 547440 - DNA, 1029 bp, Homo sapiens
  misc_feature (40)..(40): n is a, c, g, or t
  misc_feature (69)..(69): n is a, c, g, or t
  misc_feature (71)..(71): n is a, c, g, or t
  misc_feature (89)..(89): n is a, c, g, or t
  misc_feature (96)..(98): n is a, c, g, or t
  misc_feature (112)..(112): n is a, c, g, or t
  misc_feature (145)..(145): n is a, c, g, or t
  misc_feature (200)..(201): n is a, c, g, or t
  misc_feature (258)..(258): n is a, c, g, or t
  misc_feature (273)..(273): n is a, c, g, or t
  misc_feature (278)..(279): n is a, c, g, or t
  misc_feature (289)..(289): n is a, c, g, or t
  misc_feature (292)..(292): n is a, c, g, or t
  misc_feature (297)..(297): n is a, c, g, or t
  misc_feature (299)..(299): n is a, c, g, or t
  misc_feature (305)..(305): n is a, c, g, or t
  misc_feature (321)..(321): n is a, c, g, or t
  misc_feature (337)..(337): n is a, c, g, or t
  misc_feature (345)..(345): n is a, c, g, or t
  misc_feature (347)..(349): n is a, c, g, or t
  misc_feature (362)..(362): n is a, c, g, or t
  misc_feature (369)..(369): n is a, c, g, or t
  misc_feature (377)..(377): n is a, c, g, or t
  misc_feature (386)..(386): n is a, c, g, or t
  misc_feature (395)..(395): n is a, c, g, or t
  misc_feature (399)..(399): n is a, c, g, or t
  misc_feature (451)..(451): n is a, c, g, or t
  misc_feature (460)..(460): n is a, c, g, or t
  misc_feature (464)..(464): n is a, c, g, or t
  misc_feature (489)..(489): n is a, c, g, or t
  misc_feature (555)..(555): n is a, c, g, or t
  misc_feature (564)..(566): n is a, c, g, or t
  misc_feature (586)..(586): n is a, c, g, or t
  misc_feature (706)..(706): n is a, c, g, or t
  misc_feature (845)..(845): n is a, c, g, or t
  misc_feature (862)..(862): n is a, c, g, or t
  misc_feature (1028)..(1028): n is a, c, g, or t
tcttacatgtacagtcatcttaaaaagacaaatattaacnaatataagataaaaacaacacaatttatnangacatgttattttgtgantttcgannngtaaaagggagcgnaacttctaaacggatctataagaagacaattcnactttttaagacacttttacaccagacagacagtgagatattactaatttaagtnnacactaaaacactctttactgacgctcgcgccgaccctatactatctccgctccganccttcatctacccanctttnnataccctccncanaatcntncctagngcatgctgagactgcnaagaagagtgcttgantggggggnannnggcatgtgctagngtgtganctcctgangagctaganatacatttntttnttctttatccctggattcctaacacaatgcctggttcaaactaaaatgcttnaacaacgtntgcngctttgaagtgaactggggcaaatncatctttccacctctggtccagttttcactccatattaagcacatctgaggttcctgggttgtttntggttgttnnnttttgactttaaattgagtnaggtaagccaatatgcatacattttttacatcagctttctcacatcagcctcagaaccaaatcatcactgggctgggaatattctcacgtactccgatacttatttgttggacaacagtnaatatcaatgtgcaaaagtcatgcattttcaatgcaggataaatatgctcttatgaatatgaatggaataaaggccctgtttctccatgttttaaataacagatacatagcatcttaaattatgacttaattagcagtntttagacactgaacatnatacactgtattacaatgcaatgtggtaggcttccattttaggaaccaaaataaatttcacatgaaaaaatatttattttaattcacatcaaatacatttagaataaatctaaatttttagcatcataatacttacaaacaaacacagataaactttgggtgtatna

SEQ ID NO: 547441 - DNA, 871 bp, Homo sapiens
cttcggagttcgcccccttcgggactcgcctccgggagaccccgagggggagagggcgcttcctccgcgtccatcgcccttgccgccctgggagagctcttgtcagagctattagctctgctttctaagcagaagtttctgcagacagagacggtacctctactgctgagtccaaagtcaccgcggcatacccagctcggcagactccccttagtacgaaactgcttccatcagtaaaatattcaatgtccaggtccccgaggggccaatctgttaaatctttccagcttgagaacactttatctaccacgtccacacagcaatgaaggggacttcctgtgtagggtccagccctacgggggcttagcgggtgttctccccgtgtgcagagacaagagatcgtaagaaataaagacacaagacaaacagataaagagaaaacagctgggcccagggaccactaccaccaagacatggagaccgctagtggctccgaacggctggctgcgctgatatttattgaatacaagacaagggggcaggctacggacggtgagtcgtccaagtaattgataaggtgaagcaagtcacgtgatcataggacagggggcctttccctcttagggtagccgagcacgagagagaaggcagcatacgtcagcgtttcttctatgcacttataagaacaatcaaagactttaagactttcactatttcttctaaccgggtatctactaacgaactttcaaagaggaaccaggagtacgggaagagccttgaaagtggaccacgcagtgtgatcattcaagcccacaggagggggttaaggccccggatgactgccgccaggcctgggagatatccgctccaa

SEQ ID NO: 547442 - DNA, 225 bp, Homo sapiens
ctgttttagtctggattggtcagcgtcatttacaagacttaggcccagccttagacagccttacagcaccaaaaccaaccaaatccaatgctgctttatctcagcagtaccaaaccattggggtgggcgcacaaattttacgtgatttaggcgtagaaaagatgaagcttttgagctcacctttacgctttaatgcactttctgggtttaatttagaagtggtgg

SEQ ID NO: 547443 - DNA, 279 bp, Homo sapiens
cagcgctcccctgtgagccccctcgcttcccgacgttccgtgtcccccctgcccgccttctcccgcacaccgcgccgacgccaattccgcaggccgatgccacgcgaggaacaaggaatcgtatcgtatgtccgatatcccagaacctccacatctattcgacccgcttagctgatgcaagtaagcggtgatgagcctgattccagatggcacgtgacggattatatccatataagaattcacacagagaaacgggaggaagacccttactactgtcca

SEQ ID NO: 547444 - DNA, 468 bp, Homo sapiens
  misc_feature (189)..(190): n is a, c, g, or t
gaccacccatacgtagaatgtatgcacacatgactgtaagtcgctttggataaaagcgtctgctacatggcatatattattattatatattataccgctcaggaagcagacgcgttctgtctcctagagatgaacgtactttggtgcgaaagtgcaaatcaatcccagaacaacaacaaaggaccttgnnaagatgctggaggaaacaggtacaaatgtatctatatccacagtaaaactaatcctatattgacatatcctgaaaggccgctcaacaaggtagaatccactgctccaaaaccgacataataaagccagacaacggtttgtgactagacatggggacaaagattgtactttttggagaaatgttctctggtctgataactgtttggccataatgaccattgttatgtttggaggtaaaagggggggtactttgctgtcgacgcggccgcgaatttagta

SEQ ID NO: 547445 - DNA, 221 bp, Homo sapiens
tccaaaaaaaaatttttggttttgggccccggactgttttacccctaaaatttggcaattttttttccccgcaaataaagggctgggccttatttattgaactttatcattgaaaaccggttggaaaacctaaaaaaaggtggcccccctttgttttttttacctgggccctaaaaaaaagggcccaaccccttttttaaaaaaaaaaggtttagggggga

SEQ ID NO: 547446 - DNA, 336 bp, Homo sapiens
tgtttacggaccagagtaagtatagcaaaagaaagtaatcatagctaaacacacactcacaaattcctatcctttgaatgtcttacagcacccaacttcacctctcaaccagatcacagacaaatgatgtctcacagaagtctccctgatcccccatattactctctggtccccaatcatctctctgatccccaataatctctctgatacacccatattatactccgatcctcaattatctccttgggtcacctaataattttctctggtccccaatcctcacactaatccccaataatatctctgatcccaatattataccctaatcctcagtca

SEQ ID NO: 547447 - DNA, 933 bp, Homo sapiens
gctctctctctctctctctctcttcgggtctcctctctctctctctcctgagtgtgagcctcaggagaaaaactcagtctaaccccctttgttcttctcttgagagcttggcctgcaaggctgatctgcaacacagtgggtgttgggccccgtaacaggctccatggttctgtacccgtaggggcacatgtcttcctctgctaactgctgtgtgctgctgccatacagaaatcgacgccgtggttgataagaagatgaagatgctgagggacgaactcgatgtcgcgaagagaaagactgcgctccacgatgtgacggagaggaagactggacagacacacggcgctgatgcagcgacaagaggaggccttacaccgaatttaagaactactaacaacgatatcaccctcaaaatggctggccctcatcatctctctcaacgccgcatcgtggcacgacactgccgaaaaaggacgcccactggagagggagaatggcagaggtgtcggcccagaaccgagcgtctggggaaaacctctacaaagaagggctcgggccagatcatgagcgaccacgcaacacagcagcgccgcaacgctaacgagagggacaagcaggatcgtgcttgggcaccaaaacgcgcgtgagacacgtcagcggagaaaaaggagcttgaagagcacctggcggggcgaaccaatgacgttgtagacgcaggcgactaccaccgggggcggccacaaaggacgcgggcacgcgtctctctcgacaacgtaccggggcagccacccacggggtggctggcacagaacagacagggtccacaacaccgcggctagcacgcaggtgggccgctctgagcgccgctgtacaacaaaaggggggcgcaacggagccgcggtacctacgcggccctgtcccctgggggtgccc

SEQ ID NO: 547448 - DNA, 486 bp, Homo sapiens
atccggggaatggggcgggggatagacacttttgagctgctgcccatgtttgggtcccccgagtttttccgctccaaggtggatgaagctgtagccgttttcccgggtcctcatgccaagaaaaaagctgccccgaaggggggggctgttgttgttgttccctttttgacaagggaaaaccggttccaaagcccaataaccccttttgggattcaactcaggggttgaaggcttcctgggttgtcctttgggcccccccccccggggtttccaattgccaattttatggggccttttgggtccaaggggccattttgggggccctaggatttttccattatacggatatggtttttggggtttggtgggggcccgccgggggtaacttttttttttttggggggtttggttttttccccccgaaattgggtttttttggggggccccggtttttggttttcccataaagaaaaaaattttccctta

SEQ ID NO: 547449 - DNA, 792 bp, Homo sapiens
  misc_feature (25)..(25): n is a, c, g, or t
  misc_feature (87)..(87): n is a, c, g, or t
gcgcttatgttggcagaatatatcnggtgaagtggaatcgctgggtaaaaagggttaaatctgttaattggctttccacttaaatanaaaaaatgaagcgaagacaagaggatatttgcaaaacagccatgttcgggaatcccagttactgcttttatgtacatacctagtttaatttcagctttttattatttttccatttgcaacaaatctttctagatgagtaattctcaaactttttgatgctaggaccccttacattgtcttttgtatatgtggctatctgtattgatagtatattaaaaattaaaactaagtaaagaaaaatttttttgagacatggtcgtcactacgttacccaagctagtcttaaactctggcttcaagcgatccttctgcctcagcctcaagactgagaaattttaaaatagttatttattcatttaaaaagcaaaaataaggcgattacacgttaacattaaaaaaaaaaatgttttgaacgggcgcagtgactcacacctataatcccagcatgttgggaggccgagctgggcagatcacaaggtcaagagatcccgaccatcctggccaacatggtgaaacctcgtctctactgaaaatacaaaaaattagctgggtgtggtggtgcacgcctgtagtcccagctactctggaggctgaggcaggagggtcgcttgaacctgggaagcagaggttgcagtgagccaagattacgccactgcactccagcctggtgacagagcgagactccatctcaaaaaaaaaaaagtc

SEQ ID NO: 547450 - DNA, 399 bp, Homo sapiens
  misc_feature (8)..(8): n is a, c, g, or t
  misc_feature (215)..(215): n is a, c, g, or t
  misc_feature (259)..(259): n is a, c, g, or t
  misc_feature (276)..(276): n is a, c, g, or t
  misc_feature (361)..(361): n is a, c, g, or t
  misc_feature (389)..(389): n is a, c, g, or t
tgaacatnaaaaaaattgttcctcaatgacttttgagtaaacaatgaaattaaggcaaaaataaaaaaaattgaaataaatgcaaacagaaacacaacagattaatatcccaaggatgcagcaaaagcaatgttaagagaaaagtttatagcactccaggtcaacctcaaaaagctaggaaggtctcaaattaatgacctaacatcacatcttgnggaactagaaaaacaagagcaaactaaacccaaagctaacagangaaaagaaataactaanatcaccccgggggctgaacaaaaatgaaaccccaaaatttatggcaaaaaccccccaaaaccacatgttggttatttggaaaggnataaaggaaaatcagttggatcacttgncttggattta

SEQ ID NO: 547451 - DNA, 85 bp, Homo sapiens
ggatttgctggtgcagtacaactaggcttaatagggacatgttaacccctccactctttctttcaataaaacgcagttgcaaaca

SEQ ID NO: 547452 - DNA, 774 bp, Homo sapiens
ccactcctcatcctccctgagtgctgatattctctctctctctttctcttcctcttctttctctctcttctcctctctttctctcctcgtctctcttcctctcctctcttcctctcttctctcttcctctcctctctctcttcctcttctctctcttcccctccgtctctcctcccctcctctctctcttcctctcctctctcttcctctcctctctctacccctccgtctctcctcccctcctctctcttcctctcctctctctcttcctctcctctctcttcccttcgcgttctcttcccctcctctctctcttcctgtcctctatctcttcccctcctctatctcttcctctcctctctctcttcctctcctctctctctcttgctttcttctctctctcctgtctcggctgttgtgggttgcaggtgggtgctgctgttgtggtccttcccagaaactgcagtagagggcagctgggatcctaatgttactctggttgttacaccaaagaaaatatcggggtcactggcgagcccacccacactcacagaaatctccagtgtaagtccccctaaaaaacagcccttcattcctctcccattcagccatttgtattttgatgccatggcctcaagatcagagtgtggaaactcatcacgcctgggatatcctggtcgagccggacacggggtcttcgaggggtctgaaacccttttctcttggagattgtgttttaatattaactttaatctcacctgttctggtccacag

SEQ ID NO: 547453 - DNA, 178 bp, Homo sapiens
gatcttaggaaattataggtgtattatctgggggacaaaaaaaactttggctacgttttttaggaaacaggctcaaagctttataaatcaatatttagaaattagtttaacgatttactattatacctgctagtgatatttatgtgatatttataaatgaaaataaatgcaaaactat

SEQ ID NO: 547454 - DNA, 301 bp, Homo sapiens
atctttctacctaaccccaaattaactcccttccactattttattaaagctgctttcttcttgattcatttcagaaaatttatcattgtttgaaaattacaaagctgcactgagatttcaaacaatggcatgtatcacgcttgctctagcagatcactgatctttgtgggaccgcttgtaaactgcacatgctgaggaggcaacatcaattatgaggggactcttgaaccgttggtactagtgattatcttttccccatgtcttcctgtctctttacttacactgttattggagctacacc

SEQ ID NO: 547455 - DNA, 82 bp, Homo sapiens
gaatttaataatctgaataatttttaaaatttaaataaacagaaatgaagttaatttaaaataaatacctcagaagtgaaaa

SEQ ID NO: 547456 - DNA, 116 bp, Homo sapiens
gtctccctggataacttcgtgatctcgatgatggtgtcccaggccggcaccaccaccctgccgatcttcatcttcggcctgttgcgcatgggcgtgacacccgacgtcaacgccgt

SEQ ID NO: 547457 - DNA, 138 bp, Homo sapiens
ctaagatcaccttcttgagctctgtctgtacatgtgaccatgcacgaatggcgcccccacatgccccgcaggatgttggaccacgcacgccttgaagaaagtgcttcgccccctacatctcgtgaagatcttcctcca

SEQ ID NO: 547458 - DNA, 248 bp, Homo sapiens
gcaatcgatgagtatatcggcaaaacaaaaagataagatttttgacaattattgtaaaaataaaactcaatgcctggattttgcaggtagagagattattaaagatcacaagaaaaattcacaagtacaagaagaaaactctgatcaatttccaggtttttgagatattgatcatattattccacaagatatatttgataaaatagatcactccaaaatatctgttattaaaaagtatctcaattcac

SEQ ID NO: 547459 - DNA, 669 bp, Homo sapiens
  misc_feature (1)..(1): n is a, c, g, or t
  misc_feature (61)..(61): n is a, c, g, or t
  misc_feature (64)..(64): n is a, c, g, or t
  misc_feature (138)..(142): n is a, c, g, or t
  misc_feature (174)..(174): n is a, c, g, or t
  misc_feature (194)..(194): n is a, c, g, or t
  misc_feature (221)..(221): n is a, c, g, or t
  misc_feature (224)..(224): n is a, c, g, or t
  misc_feature (229)..(229): n is a, c, g, or t
  misc_feature (237)..(237): n is a, c, g, or t
  misc_feature (245)..(246): n is a, c, g, or t
  misc_feature (248)..(248): n is a, c, g, or t
  misc_feature (259)..(259): n is a, c, g, or t
  misc_feature (263)..(263): n is a, c, g, or t
  misc_feature (296)..(296): n is a, c, g, or t
  misc_feature (325)..(325): n is a, c, g, or t
  misc_feature (532)..(532): n is a, c, g, or t
naaaaaacaacatatcaaaagcaaaatgaaacaaataatccaagttgatgatcataaagtngantgatctaaagagagaaaatctgaatttaatcaagcttctagatctaactaccatactcacaggtaataagaggnnnnngggacatgtgaaacaatactacataattcagnctacaggaaattctagaagncgatctatttagtacaacaaattacanggngtttnataaagangaggtaanngngggcctatgangggnactgtaagtgatgcgaacattacagtacatganttggatcagattcaaataatctgtgaaanaattaggggccaatctagaaaatctgggcaccgggtatatggggataaaagaattactggtaatttgtttagctgtgataataatttttttaaaaagagaatatttacatttcagaaatatgtgtgtctgtatgcacacacacacacacacacacacacacacacacacacacacgcagtcagcctcctatgtccatgggttcaacngaccttggaatgaaaatattccacacacaaaaaaaattgcgtctgttctgaacatgtacatttttcttgttgttattccttaatacagtataacagttatttacatggcatttacattgtattacgtattataagtg

SEQ ID NO: 547460 - DNA, 190 bp, Homo sapiens
  misc_feature (48)..(48): n is a, c, g, or t
  misc_feature (94)..(94): n is a, c, g, or t
  misc_feature (138)..(138): n is a, c, g, or t
ctcacacgtgtgctccctgccctgctcctggccccttggcggccgggntgtttctggccatgggtcgctcccgccggacaggccgcaccgagcnacatctctagcccggcagatgaaggcgacggcggcggccggacnttggatgagattcaccgcgagctgcgcctcagggatccgcacgaccccagcc

SEQ ID NO: 547461 - DNA, 220 bp, Homo sapiens
gcggccgcctactactactactactgctcgaattcaagcttctaacgatgtacggggacatggtggcacgcgcctgtatcccagctactcaggtaactgaggcccaagaattgcctgaaccagagaattgcttgaagccaggaggcggaggttgcagtgagctgagatcacgccactacactccagcctgggggacagcgtgaaactgtgtcccaaaaaa

SEQ ID NO: 547462 - DNA, 126 bp, Homo sapiens
gatctaacagagtgtgcaggcttactggaggactgaagcgacttttgtgccgggacttaaaaagataggaggccaggtgtggtggctcatgcctgcaatcccagcactgtagaaggcagaggccgg

SEQ ID NO: 547463 - DNA, 466 bp, Homo sapiens
agcgggttgttgagaacggcggagcgagggacccctatgtggtggagggactgctccggggaaagccgagtgggcgctacgagctctggtccacgtgacctgccgggggcgggagcagggcggcgcgccggcctcctgcgaatgtcctatgtcttggggaggggcagtgatccaaactcgttcttgtcgcacccgatggggtggactcgggtccggtttgccgaagctgtcaacaccgtgattatcccccggggaacgcgcggactggaagcgagtgaggatgtctattcttcatacatttgaaccttcggtagttgccgacgagacagacgattttgaatgcacgccatggcacgagcatggaacccccctggctcttttgcactgattgcagtttcatgtacacacagtggacaagactctttgggtggcataagaatgcttgcgcctttgaaaacattgggaa

SEQ ID NO: 547464 - DNA, 402 bp, Homo sapiens
  misc_feature (16)..(16): n is a, c, g, or t
gcgtggtcgcggccgnggtacaggggaatggaatggaatggaatgcaatggaatggaatcatccgtaatggaatggaaaggaatggaatggaatagaatggaatggaatggaatggaatggaatggaatggaatggaatcaactcggttccaatcgaatggaatggaaaggaaataccccgaatagaatggaatggaatggaatggaacggaacggaacggaacggaacggaatggaatggaatggaatggaatggaatgcaatggaatggaatggaatggaatggaatgaaatgcaatggattcaactcgattgaaatggaatggaatagaatggaatggaatggaatggaatggaattaacccgaatagaatggaatgtaatggaatggaacggaatgga

SEQ ID NO: 547465 - DNA, 353 bp, Homo sapiens
gaacgggtgagtcattattgggataaattacccaagtgttaacctggtggctgtgtgatgatgacgcatggtctaatgactgcatgtgggtcgcagtaactcacagtgagctcactgggctcgtctcggggcacccataggcagagatgacgacaacaggaaggaacagtgacaaagcaggtggccacccgagaacactatagagaaaatctcacctggtccccagaccatggttctgctcacaacctcagaacttccctcgcctgactgtcctgagcacttccaggaaggcagcccctggctgtccctgaggtggccgcatctgtccttccccaccaaccgcatcacccgtt

SEQ ID NO: 547466 - DNA, 413 bp, Homo sapiens
tcgtatgatttggggtggagagttctgtagatgtctattaggtctgcttggtccagatgctgagttcaagtcctgaatatccttgttacttttctgtctcattgatctgtcaaatattgacagtggggtgttaaagtctcccactattattgtgtgggagtctaagtctctttgtaggtctccaaggacttgctttatgaatctgggtgctcctgtattgggtgcatacatacttaggatagttagctcttcttgttgcattgatccctttaccattatgtaatgcccttcttgtcttttttgatcttcgttggtttaaagtctgttttatcagagactaggattgcaacccctgcttttttttttttgggtttccaatgggctgggataatttttcctcaatccctttaatt

SEQ ID NO: 547467 - DNA, 134 bp, Homo sapiens
cgtcggaccctggatctggttttctcacagtgaactccatgttatattcttggccctagatgtgtattagaatcacttgttgccgggcgtagtggctcatgcctgtaatcccaacacttgggaggctgagatgg

SEQ ID NO: 547468 - DNA, 572 bp, Homo sapiens
gtgattacactggtgctcagggatagcctggccctgtagatgtacaagggaccctcacttgccctgctggagaggaaggaaagcgaggagctcgaggtgaacccggacccactggcctgccgcggaccacctggcgatcgttgtggacctggtagccgtggtttccctggcgcagattgtgttgctggtcccaagggtcccgctggtgaacgtggttctcctggccctgctggccccaaaggatctcctggtgaagctggtcgtcccggtgaagctggtctgcctggtgccaagggtctgactggaagccctggcagccctggtcctgatggcaaaactggcccccctggtcccgccggtcaagatggtcgccccggacccccaggcccacctggtgcccgtggtcaggctggtgtgatgggattccctggacctaaaggtgctgctggagagcccggcgaggctggagagcgaggtgttcccggaccccctggcgctgtcggtcctgctggcaaagatggagaggctggagctcagggaccccctggccctgctggtcccgctggcgagag

SEQ ID NO: 547469 - DNA, 401 bp, Homo sapiens
  misc_feature (2)..(2): n is a, c, g, or t
  misc_feature (21)..(21): n is a, c, g, or t
  misc_feature (167)..(167): n is a, c, g, or t
  misc_feature (309)..(309): n is a, c, g, or t
  misc_feature (321)..(321): n is a, c, g, or t
  misc_feature (324)..(324): n is a, c, g, or t
  misc_feature (343)..(343): n is a, c, g, or t
  misc_feature (379)..(379): n is a, c, g, or t
anccaggccaaggtgggcggntgcttgagcccaggagttcaagaccagcctgggcaatatagtgagacctcgtctactaaaaataaaaattaaaacaaccagccaggcatggtggtgtgttcttataggctgaggtggaaggatcactggagccctggagattaagngtgcagtgagccatgcttatgctactgcaccacagcctggggaacagagcaagatcctgtctcaaaaaaaaaaaaaaaaatagaagtagagagcaaattatttttttttgttaccattattttgtaacattatttttgcgcntaaaggaaaaanccnaaagtctggatcccttggnaccattataataaggtttcagacaccacatattctnccaacatttttcatgcttgaac

SEQ ID NO: 547470 - DNA, 124 bp, Homo sapiens
aactgggtagcaccataactttcatgttgtgagctctgggagcccagagggcagccgtagtgtgcctgactccgtggagagaggtaaagaaacagaccctgcttcttgccgcagaccccaccag

SEQ ID NO: 547471 - DNA, 377 bp, Homo sapiens
  misc_feature (32)..(32): n is a, c, g, or t
  misc_feature (84)..(85): n is a, c, g, or t
  misc_feature (164)..(164): n is a, c, g, or t
  misc_feature (311)..(311): n is a, c, g, or t
  misc_feature (367)..(367): n is a, c, g, or t
aaaattctcccagtcatgatctgaaaaaaaanaaaaaaagaaaaatgaaaaacactaccctaaggatgttattgcattcttttnntttttgggataagagtttcactcttgttgccccaggctggagtgcaatggcgtgatcttggctcgctgaaacctctgcntcccgggttcaagccattctcctgcttcagcctcctgagtagctgggattaccagtcccgccaccaccctcggctaatttttgtatttttggtagagacggggtttcgccatgttggccaggctggtctgaaactcctgacctcagntgatccgcccacctcggcctcccaaagtgctgggatttacaggcgtgagccacccnccctggccat

SEQ ID NO: 547472 - DNA, 209 bp, Homo sapiens
gatctgagcgctttataagtagcagtttcccctgctctcacgcttctcccctgcagccatgtaaggcgtgcttgcttcccctttaccttccaccacgattgtaaatttcctgaggcctcctagccgttctttctgttaagctcgcggaactgtgagtcaattaaacctctttcctttataaattacccagtcttgggtagtatctttac

SEQ ID NO: 547473 - DNA, 146 bp, Homo sapiens
gcccttttagctgtctctgaaacacttactgaccaagcgctgacttgtgcaggctatgtgcccctggaacccaagaaggaaaacagaatcttccctaccttctaggagcacacattcagtgaaagtgatggataaaacctaatcac

SEQ ID NO: 547474 - DNA, 457 bp, Homo sapiens
ttcaggctgcattgattttatatccagaaactctgcataaattatctatcagttctaggagcttctggcagagtccttagggttatctaggtatagaatcatatcatcagcaaagagatacagtttgacttcttattccatttggatgcctttcatttctttctcttgcctagattgctgtggctaggactttcagtactattttaaataggagtggtgagagtaggcatccttgtatagttccagttctcaagggaaatggtcccagcttttgtccattcagtataatgttagctgtgaatctgtcatacatggctttgattatgttgaggtatgtaccattttatagccagtttttaggaatttttgccatgaaaggatgttggattttatcaaatcctttttcagcatccattgaaatgatcatatggttatcgtccttcattctgttgatata

SEQ ID NO: 547475 - DNA, 702 bp, Homo sapiens
  misc_feature (2)..(2): n is a, c, g, or t
  misc_feature (143)..(143): n is a, c, g, or t
  misc_feature (186)..(186): n is a, c, g, or t
  misc_feature (191)..(191): n is a, c, g, or t
  misc_feature (194)..(195): n is a, c, g, or t
  misc_feature (211)..(211): n is a, c, g, or t
  misc_feature (214)..(215): n is a, c, g, or t
  misc_feature (225)..(226): n is a, c, g, or t
  misc_feature (260)..(260): n is a, c, g, or t
  misc_feature (268)..(268): n is a, c, g, or t
  misc_feature (278)..(278): n is a, c, g, or t
  misc_feature (299)..(300): n is a, c, g, or t
  misc_feature (313)..(313): n is a, c, g, or t
  misc_feature (320)..(320): n is a, c, g, or t
  misc_feature (353)..(353): n is a, c, g, or t
  misc_feature (356)..(356): n is a, c, g, or t
  misc_feature (358)..(358): n is a, c, g, or t
  misc_feature (360)..(360): n is a, c, g, or t
  misc_feature (362)..(362): n is a, c, g, or t
  misc_feature (373)..(373): n is a, c, g, or t
  misc_feature (384)..(384): n is a, c, g, or t
  misc_feature (394)..(394): n is a, c, g, or t
  misc_feature (543)..(543): n is a, c, g, or t
  misc_feature (554)..(554): n is a, c, g, or t
  misc_feature (596)..(596): n is a, c, g, or t
  misc_feature (702)..(702): n is a, c, g, or t
cnatacaaccttaattaaacaataattagagtaaaaatgatataatgaaataataaagtacttcaagaatacttttaatattatgaaaacgataaaatattcttattcggaagtctacattatacccacctgtttactaagtnctttctgctacacagagccaaaaaaagcccctccacacaaganacacncgnnccacaaaacttattanaannaaaaaaacgnnctatgacatcttcattacgcaacacaaactgtcnatcacatnaagttctgangcagaatgtgctcgtgagtcnntccacgctctgtngcttganacagtcggaaaacaaatggagttaaaccccgtntgngncncnctgcatttccnaaaatctggtntcctattccnggtatatggctgttcactctgttcattatcattccactgatttcaagtacagacatgtctgctttcttacaatcattaccttcccatactatagcacttattttttctaatcctgggtgggaactatggagccagggcaaatgactctnatgaaaagggncatctctatattcttttttcacacatggattaatctgatgantttccacatctgtctcactggtacaagatgaatggcattctgcacaatgtaacaagtcttcccataacacatcttctgtgtcagattctggccttgcactctcagn

SEQ ID NO: 547476 - DNA, 173 bp, Homo sapiens
tgatattctaacatctgatatcctgttatctagatgtagctcagaggacactctatgatctcattcagattccttagcaaccctgtggaagttaatacattaaaacacaccatcgatgtgactattgtaaggtcactgaggtgggactctcttgtgagaagtccagtcgacgc

SEQ ID NO: 547477 - DNA, 392 bp, Homo sapiens
  misc_feature (1)..(1): n is a, c, g, or t
  misc_feature (18)..(18): n is a, c, g, or t
  misc_feature (262)..(262): n is a, c, g, or t
  misc_feature (284)..(284): n is a, c, g, or t
  misc_feature (306)..(306): n is a, c, g, or t
  misc_feature (346)..(346): n is a, c, g, or t
  misc_feature (357)..(357): n is a, c, g, or t
  misc_feature (381)..(381): n is a, c, g, or t
ntttaaatcaaaagctanaaatgattaaccttagtgaggagggcatgttgaaagccaaaataagccaaaagctaggcctttgcatcagttagccaagttgtgaattcgaaggaaaagttcttgaaggaaattaaaagtgctactccagagagtacatgaatgataagaaagtaaaacagctctgttgctaatacggaggaatgtttgaggagaggtctaggaaccagccacaacattctctttcagctagggcttcaatccnggaacaagggaccttaactttnctttcaatttctctggaagggnttgggaggaggttcagggaagtttgccaggaagggaaaantcttggaagcntagttagttgggtttgggtttccntggagggtttt

SEQ ID NO: 547478 - DNA, 255 bp, Homo sapiens
  misc_feature (83)..(83): n is a, c, g, or t
  misc_feature (86)..(86): n is a, c, g, or t
  misc_feature (109)..(109): n is a, c, g, or t
  misc_feature (121)..(121): n is a, c, g, or t
  misc_feature (167)..(167): n is a, c, g, or t
  misc_feature (217)..(217): n is a, c, g, or t
tatgacttcgcctaagaggcggaggctgcagtcagctgagattgcgccatcgaattccagcctggggaactagagtgagactncgnctcaaaaaaaaatttttttaaanaagatgaaactntctcagattgaggctgaaatgggccctataacatatcctgggcaangacaactcagcagactacaccaagaaaatgagtacctcttccatgtattnctactgtgtgtgaacgagagatgaatttaacaccacca

SEQ ID NO: 547479 - DNA, 462 bp, Homo sapiens
gagcgtatcgaaagaccagccggtgaagccaggtacgactgatcacgcggtgaggccgacatgcaaaagaccagccggtgaagccaggtacgacggatcaagcggtgaagccggatgcaaaaggtccgaggttgctaatagatcacggcggattgacgccgaaaccgggtagaaacgatcatccagtgaagccgtcagtgccgatgccttcagtgaatgtcactaatgatgctgaagcaacatgtgcatgtgaacatcaatgtcgctcactgtcactgccctgatacaaaggacgggccaaacccggacttaaatcccaggcaaggtccgaagccggaatcgaacccccgtgccacagccggatccaaagccggaatcggaacccggcgccacagctgggatcgaagccggggatcgaaccccgtgcctcagccgggtccaaaggcctgaatcgaaccccgt

SEQ ID NO: 547480 - DNA, 145 bp, Homo sapiens
gtacctatcatacccaattggtacttcaaatctctccctcctcccaccctccatcctcaagtaagccctggtgtctatcgtggaacctacttttctatttctctttttttttttaatattactttttgactcttcacctgggagg

SEQ ID NO: 547481 - DNA, 426 bp, Homo sapiens
tgcccatgggtacagctcaggattgcaggggtggtacaggctgcagatttgttgccatggtgctcaacaggtgaaagagaaagtgactgcttccttgggaaacatcatgtaatacacctgtatcttttcccctctccctccttccacccctcccgttggttgtttgtggtggatacagacatattcttgtcaggtatgagaattcttcttgctttacttggtgcagatatcttcaaactggatttctgtcaagctcctccattccacatctcctgaacattatgaaaccagcttcaacatcaacttgtgctcagataatagcgttttgataagcttctgatagtgtgttattcatatatttcccttcatatataaatactaagcattttctaagtatcttcttcagcaaaagatcttctccagcat

SEQ ID NO: 547482 - DNA, 783 bp, Homo sapiens
agatactcgcaaagcccaccaccattcttcacacaacccgataccgactacaatcacgtaccccacactgcaacctatcccacacacctaccatacttacttcctactctcttcataactacaaccagcacttacttcctcacacacttattataaacttttaccggatgccacaaaaacctccccaatcccaccaataaaattcgccactcaataatttaaaaaaccatttccctacacttttaataccatttcttattcccctcccctaacatatactaaactccctatttatatccatctatcaattccccacattaccaccctcttcatctcatctcttctacctccacctccaccaacccttacctttttctccacatccatcacacttcaccgctttttaattcctctcaactactactttatccatacttcccctatattatttttctctctcattccacaattctgagcccttatcccattaacaatccatactcacccctatccaatccctttacacctctccacctttcaaatacacatctaacttaccttccctttccccactaatattcataacacccccccactccaactccttcgttctttactcttttccattttattaatatacatctcacctatacctactcctttcttatctctccttctctctcctatctctctaactaccttatcccaacccactccttaactctcttataccttttttaattaccactcccttctctctcttcttatatacagaaaactcac

SEQ ID NO: 547483 - DNA, 341 bp, Homo sapiens
  misc_feature (168)..(168): n is a, c, g, or t
tctgtaacactaatgtagctcagtgtatgtggatactaatataaacaagagtagggaagtctttggcactgcatgatgcgtgcggctattaaatccgagagatgagaagctacatgcacttttttttaatctacagatacctgccaaagcagacatgtctatcagatnttgaatgacatagctgtaagttggcggttgtcagctttccacataaaatttcatcagcaagtgaaacttgattacagcccacactagacaaggcaattcaggtgcccgtaccctgaagtccacgtgagactacaggagaacgtgcattatggtgcttgccagccagtctcttg

SEQ ID NO: 547484 - DNA, 399 bp, Homo sapiens
tcaccattaggcaaataccaataacggcggatcgtcgacggaaactaaagttagggggttctggagaggatattctcatggggtccccgcaagatactcattacaccaaagaaaacagtaactctacagggaagagaccgggtagacaccacctacatccggattggatgcagaggaggccagatctcttccgggttctggccagaaggcataatggcagtttaatcacgagaaaatatcaggcaaaccaaaatggagggggagtctacaaaaggccggcccacacttcccaagggctcgggtcctgaaagacggcagcagagactgggaaggcagggagacaacgaaatacaacgggggcgcttggggagggcccgggacaggaaaaaccgacactcg

SEQ ID NO: 547485 - DNA, 880 bp, Homo sapiens
  misc_feature (398)..(398): n is a, c, g, or t
ttgtccgcatgcgcgattgagccgggtgcatggtactgctgcatccgggtgtctggaggctgtgccgttgtccttggctaaaatcgggggagtgaggcgggccggtgcgcaggaaaaccgggctcgggaacccatttgcaacgaggggtttggaattggaccttgaaaaaaaatttgtcgtggattcctaagaggggttggaggattcgctcaagaaattggatttggactgtgcgggggaaaaagcgcgcaaatattaattggggtccaaatggggctggggggggctgtaactaattttcaacgggggcgtgggtgggaataactcataagatttcgcggtgtggtatttttatccccaccattgaatgtatttccaacccattcataccatggcntgttgctgtaataggcaaaccaataggcttcccataattgataaggggcagtaatcgatggacacaatcgtccggagtgaattagttacccggtgcaaggtttgtcctgtctcacacagggtcgccagattgggttgccgggggtacaattgtggcaccctgggggaatcttctgagttgcgcatcatagtggtgggacttccttagggcgggacgcttatgtggctacacgacagaagatattaggtatacgctggaagtggctggtatttcccagaaatggcttacatctttgaggagcgcgagggcacacaagggtttgggcccgacttggaagactttatgggcgtaacactttttgttccccaaggacaagcagcgcctgaattggttgctggtttaacctggcacctcccactttttgatggcattcaaacttatttctggtgtgtacccgaacgttggaatccaaacccgggacg

SEQ ID NO: 547486 - DNA, 571 bp, Homo sapiens
aaatccaatccaaggtttcccaaatcagcccgcacatccaaactgtccgctgcgttctaggaaaccttattggggtccggtactactcgtttcgctgttctatttctagatagagggagtgggggctacccgttatggcttgtttcgaattgggttgggccggaagatctagttacgaaggaaaggggacgtatggagggtggatttttttgggatattgttttatgtgggtaaagggggggagttcggttggattgttggcgtttaaagcctaagtggttgtgtcgagatgtatcgatccggtgggttgtttggctggttggggggtgattacgggacgtttagactataattagaaggataatatggggatacgtccgttgaaggtagtacgctttcgttgaagtaagctcatatctagttgaggtatcgattagtcgactgagtttatatccgcgctgccgatttcgcgccccctttccgtctatttagtgcgatgttgtgagtgtgggtgtgtgtgtgtttctctataaccgtttatagtgcttcctcgtgtgcttaggtgttgtgc

SEQ ID NO: 547487 - DNA, 454 bp, Homo sapiens
ctattattacagaatatatagataagcaacaagaagaaaatgatggccgggcgcggtggctcacgcctgtaatcccagcactttgggaggccaaggcgggcggatcacctgaagtcaggagttcgagaccagcctcaacatggagaaaccccgtctctactaaaaatacaaaattagccaagcatggtggtacatgcctgtaatcccagctactcgggaggctgaggcaggagaattgcttgaacctgggaggcagaggttgcggtgagccgagatcgcgccattgcactccagcctgggcaacaagagcgaaacttcatctcaaaaaaaaaagaaaagaaagaaatgacatcgatgatctgacggcaaggaatagctactgttaatattttggcatcctcctatatatcccttttttctgtatatgtttgacccgaacatagattatataata

SEQ ID NO: 547488 - DNA, 114 bp, Homo sapiens
tagactaggagcagatagaatattatagggcgtgatcataaaggtgatagctcttctatgataggggaagtagcgtcttgtagacctacttgcgctgatatgccattcttgctg

SEQ ID NO: 547489 - DNA, 430 bp, Homo sapiens
cgctacatgccgacaatcatatcacagggtgagaatcatttagcatgtagtgaaaggttttttttcagttgttctttttagaaaaaaagaaaaacaaaaacaaaaacaaaaaaaaaaaatcacaccatggctcacagaatgggcatctcattttggggacctcccatctttcggtttggaaaagggtacagtagtgcagggttcctgatgtaactttagggcttacaaggttgacatgtctcaggttcatggtgtggcgatgggggttttccgtctcaggtagatggcaaagtgtaggccccacacatgggaaaaaataataataaaacaaagcaaaaacaggaaattagggatttaagtggtatatgggttaatgtattttttcttaagtatacagggcacggttggaaaggtatggtcgagcaggtag

SEQ ID NO: 547490 - DNA, 505 bp, Homo sapiens
cgatatacttgtgaccttggtgactgtgcacgagctgcaggattgttctgtccagatagttatgtacccggacagtgagacactgagcaggtggtccttctgccataggcaggccagctgttggtccagaaccgtgtgagcccatggtcacctgtgctgactacgtagttcatgctgacgtcccaaatctctgaagttttgtccccataatcagagatcacatgggttctgtcgggactccaactaattgtgtaaatcccaccgtcgtgggccttgcttccgcccagcgcgcacaccttctccccagtcttcccgtcatagatgtttctggggccgtcagcactggctgtggcaaatctgttcccatcaggagagaatcgcacacagttgacaacgcggctgtggtcgccaactgtgaacttgaacttgaatgggggtccctcaaagaatgccgcgcagttatcatcgcttcccgtggccagccggtatggcggctctgcttgat

SEQ ID NO: 547491 - DNA, 103 bp, Homo sapiens
aacccccctggaaagggcattttaaaaccctgtttttaccccccaaccctgatgtgggtcccttatgtaaaaatttccaaaatttaaaatggatattttttga

SEQ ID NO: 547492 - DNA, 211 bp, Homo sapiens
tgaacactgcacacagtagcatagccatatctttaagctggtctttctattgtcacaaacctggagccttgatgcacaagctgaagaccaacctttagcctattcaagacgagtgtacttcagggcttctccatcaacatcttcagcgattatgaccaacaggcttactggtgcagcattggcacatttcaacgaagcacggaactggcca

SEQ ID NO: 547493 - DNA, 701 bp, Homo sapiens
catatatcatgcgtgtggtctgcggacacgagtgaagtgtacctgcccgtggaacatccttgtggcctagaatcatggcctgtttgcgtgcttgaggttgctaggatactgacctattaaacctggccgccagtgcctaacgagatgcgagcggaggcgtaggtccccgtatgggcgtacgtaagcgtgtccatgcaatggggatgtgagtccaaagaacgaggctaacaaaagcgaagtgtccgtagcatctaaatttccgtcgctgtcaatgacccaaggggacgcaaaacacccatcgtgtgcaacaagaagggacggcggggcccctgggggagaacccaaagcagctgggaaaggtaggcttacccattccagcctgaaaagttggtgcaggagggtgttgcatacaccttttcgacacaaggccaaccctgaccggtacagagtctgggccaagaattgggatacacattttcaagttccccaaacgggccatcaaactgtgggtgagccattccaaacttacctttgggcacgcttgaccggggtgacctcaagagacatccaattgtgtggcccttgtgacttgaattcaagccaagccaatggccccaaataaaagggcaggctggctctgtcccttttggcaaaaaaacaaacaataaaacacaaaacatcatttttaggggccccgacca

SEQ ID NO: 547494 - DNA, 837 bp, Homo sapiens
cctccacgaatgagaccattaacaatcattcgaagataaagtcatcatacttattagcgatggaatcaccacttctgacagagtgctgaggaaccagtactgggacaggtacatgaccaagtggctttctcactctaaattagctacaggacgcacacattcggtcctgtcagaagagatccagagctctgagtcacaaaggagcgtgaagaatctgcatccagtcctacagacagcttctcagctttcaagctggaggacacatcagagcctgggcactggtctgcacgcagctgagagtagctccctcctttccacctgaattcttcctcttacacatcacagcagcgaccacagctccgatgacacaacttgctaggacagccaggccagcaacaatgcccacgatgggacggtggactgtgaagacggctcccatctcatgggtgaggcttcgcagcccctacatgctgtacatggcatgtgtatctctgctcttctccagaaggcaccaccacagctgcccacttctggaaggttctatctcctgctggtctggtctccacaagctcagtgtcctgagtttggtcctcgccatcccgctgccaggtcagtgtgatctccgcagggtagaaacccagggcccagcacctcagggtggcctcatggtcagagatggggtggtgggtcacgtgtgtctttggggggtcagcgcgctccagcttgtccttcccgttctccaggtatctgcggagccactccacgcactcgccctccaggtaggctctccgtctgtccgctcacgggccgcctcccacttgcgctgggtgatcttga

SEQ ID NO: 547495 - DNA, 152 bp, Homo sapiens
gtgaactaagtggcttttttattaaagaaagccagaattaccaaagacttaaaagttggcattggggccctttttcttgccaaaggtgggcacaacgttgacaaagcgccggttggactgcatccgccgcttagcccttctgttgtcttctc

SEQ ID NO: 547496 - DNA, 358 bp, Homo sapiens
gtccttctattttagacggttgaacctggatctggctacatgtgtgcagaaacacaatgtcagaaatcttttctcactggcggtgggtggatgtggaattcaatttgtaacttttaggtctaactttcctaactgtgctttctgtcacaagccaaaatctgctttttgtctcaagttagctttccgtaagaatgaagggagtcccattttccaatccccagatctagacagaggtacagcagattgaatgaagaatattctggtgttactgctttattgctaatgaatcaatgaaaggcatggttttaaagctatcaaagtataaatagaacttgacaaggataatataaaatggact

SEQ ID NO: 547497 - DNA, 289 bp, Homo sapiens
ttttttattgggcggggggggggggttttatttttccccgggagccccttttcccctttggccctttttggggcccctttaacaccggttttgttcaaaaaccggggggggggggggggggatttccccggtttttttttccccccccccccccgggggggggggggggggggggggggggttcccccccccccccccccccccccgttttttttttttttttttttttttgtgttgcccccccgggggttttttttttggggcccccccttgggggtgggggggggga

SEQ ID NO: 547498 - DNA, 314 bp, Homo sapiens
aaaaaaaattttttttttttaaaaaagggaaaaccacccgggggcgttggttcccccctttattccccccattttgggagtttaggcagggggttcctaagttcaaaaaatggagccctttttggccaccttggtagaaccctttttctttatatataaaaaaattagttgggcatggtaaaacggccctttattccccctaattttggaacccaaggcagaaaatttttttttaccagggatttggaattttcatttaaccgaatttattccttttcactccaccctggtaaaaaatttaaattttttttcca

SEQ ID NO: 547499 - DNA, 465 bp, Homo sapiens
  misc_feature (156)..(156): n is a, c, g, or t
caaagagacgtagcactaccgatatccccaattagggctgacaggctgagagctacctatagtcatctaggagcgcaggtaagtgtgtaggctctgacggtatatcagataaagacaccacacgactggagaagctctcgatgttaatcaagctcnatggcagatatttccatgcccataggaggaccgtgaggaatacacgaatagactatagacttagggccgcatccattgtcagctcctccagataaaaccagcatgtaccttcatacagttcccattcggtttccaatatactgggccaagacggcagtatgtaggcatagtcgttgatgatcttcaccagctatccgggaaagtgatacccgtacccactcccagacacgcatagagcaggtattgatgtacttatcccagctaggtaccaggaagctaaatagaactggatgaatcatattagtccac

SEQ ID NO: 547500 - DNA, 747 bp, Homo sapiens
tcgtctagaggatcctctcggatgcaaggtcgatgaagaaagtgagaggaaattttaaaaaatatgtttaaacaaatgaaaatagaaatgcaacatacccacacctatgggatacagaaaagcaggctaaaagggaagtatatagcactaaatgcctatatcacaaaagcagaaatattttaaataaacagcctagtgatacacctcaaggaactagaaaaccaaggacaaaccaaacccaaaattagtagaaggaaaagtatagtaaatatcagaacaaaaacaaaatagagactaaaaaacaatacaaaggatcaagagacaaaaagtgcgtgttttaaaaaaaagatacacaaaatggataaacctcctagctagactaaccatgaaaaaaaggaagaagagtcaaataaaatcagaaatgagaaagaagatattataactgataccacagaaacacaaaggatcatcagagattactatgaacaactatagccaacaaaatggaaaacctagaggaaatgggtaaattcctggacacatacaaccttccaagatggaacctggaagaaatagaaaacctgaacagaccaataactggtaatgagatggaatcagtaataagtctcccaacaaagagaagccagtagtggatgattatgggtgaacctaacaaactatagagaaaataacacatcttccaactgttaaaacattgagaggggatctctaatatctaagcagaag

SEQ ID NO: 547501 - DNA, 699 bp, Homo sapiens
ggtgaagaggacaggagccatgtggacgtaccagttggtgaggagctgtgggtcgtgtagttgatgccctggtaatgctatgatggaaagggtccaatcggttccaagtacgcgtaggcgagtggtctgaaagcccccggtatcgaatttcagtgcgggaaccaatgcgaagactggcattaagggctgtggatagcttggtgccgaattggtcgtggtcagcgtgaactgattattggtgaccgacagactgggaaaacctcaattgctatgtgagcaaatcattaagcagaaacgtttcaatgatggatctgatgagaaagaagaagctgtactgtatttatgttgctatcggtcgaaagagatccactgtggccagtctggtgacagagacttacagatgcagatgccatgaagtacaccatcgtggtgtcggcgtacggcctcggatgctgcccacgttcagatacctggctccttactctggctgttccatgggacgagtatctctagagacgatggcaaacatgtcttagatcgatctatgaagactgtatccaaaaggctgtttggttaccgtcagatgtctgctgtggtcgccgacgcccctggtccgtgaggactatcctggtgatgtgtctagctacatcgcggttgctggagagagcacgtcaaaatgaacgatgctttgggtgggtc

SEQ ID NO: 547502 - DNA, 371 bp, Homo sapiens
agccctaaggatgttttgaattcagtggggccaaataaatgttgacattccccttttggttgatggaagtatcagtgtgggaactgtttgcttaatggccttttataaaataaaaagagcatattagcagggagggagattatggagggagggaaaagtccctttgttttatttatcccttttgtattaataaagaagcccttcccagtccctgggcaatgccctttataggaaaaaggttttgcattcctgctgctgccccggaggggttaactttttaatgaaaaaataaatgcttttcccctcagtagataaagtgaaatgtgaattgttaataactgggcccggtcaataaaacgatgttttaagga

SEQ ID NO: 547503 - DNA, 307 bp, Homo sapiens
cctcggtaccgtatctctaacattacaaaaatatatatatattatttgcttcctgttgaaatgcaatgtaaagtacacagcggccgggcgcagtggctcatgcctgtaatccttttcttttctttccttttctttttttgagacaaggtctggctctgtcgcaaaaacaaacaaacaaaaaagaaataaaaaaacagcccctccaaaaattgggcaaaggatatgaacaaacacttctcaaaggaagacatttatgcggccaaaaaaggtatgaaaaaagggctcaatatcactaatgttagagata

SEQ ID NO: 547504 - DNA, 347 bp, Homo sapiens
  misc_feature (183)..(183): n is a, c, g, or t
agtctttttttttgtttgttttagacggagtttcactcttgttgcccaggctggagtgaagtggggtgaccttggctcactgcaacctccaggccagcctcagcctccctagtagttgggactacaggccccccctaccacgcctggctaattttttgtatttttagtaaaaatggggtttgnccgtgttaaccaggatggtttcgatttcctgacctcgtgatccccccccctcggcctcccaaagtgttgggattataggtgtgagcccccgcgccgggccggttgttggcattttaatgttttgtaggtggaatatttccaataaacccaaggtgccgtattta

SEQ ID NO: 547505 - DNA, 267 bp, Homo sapiens
tcgaggcgcggctggtgcagcaggcggcggtacgagaagcctttgtcctggcccatgacagcgaaaacggccagcaactggtggcctatatcgtgccgagcgacgccgctatagcggtggcaggggaagcccaggccgccctgcgcgaaagcctcaagacggcactcaaggaacatgtgccggactacatggtgccggcctacctgctgttcctggaggcgctgccgctgacccccaacggcaagctcgatcgcaaggctctgcctg

SEQ ID NO: 547506 - DNA, 196 bp, Homo sapiens
tccatgttaagggtgtcggaatagagtcttgagaagcagaaggcggtctgggagtcatgcaggaatgaatactactggtccattatgggatctaggtttcttcaaactacctgtgtaggtgtcaactggccagactggtagcgcgcgctggcatcctagtgacccgagcccatccccagatgcctctccatggccc

SEQ ID NO: 547507 - DNA, 787 bp, Homo sapiens
  misc_feature (144)..(144): n is a, c, g, or t
  misc_feature (172)..(172): n is a, c, g, or t
  misc_feature (184)..(184): n is a, c, g, or t
  misc_feature (280)..(280): n is a, c, g, or t
  misc_feature (605)..(605): n is a, c, g, or t
  misc_feature (727)..(727): n is a, c, g, or t
  misc_feature (762)..(762): n is a, c, g, or t
gaaaatttaaaaagctgcaacgtttgttgcaaatcttcttggaatcaactgcaagacctgtgccgcctggccaaactctcctgccctgccctcggtatctctaaaaagaacctctataactttaaaatcgaataccttttcgantacaaaaaaatccgcaaacaagaatatnacctggtgaaanggcgtggatatccaaactcaaaaaacacctgggaaccacggcaaaatctcaaatgtgtgcgtatcctcaaacaattccacaaagacttaaaaaagnaactgctccggcggcaccaccggtcaaaaaccccccggcacctggacccaaacttggccaactacctggtgcaaaaagccaaacaaaggcgggcgctccgtcgctgggaacaggaactcaatgccaaacgcaccatctgggacgcatcactttaaaaaataaagtggacctggacggccctccgcgggccttcttttacatcaataaataccattgttgtttaaggcagtcaccctcaaccaatgtggctgtggggctgcgagtgccaggactgtctgtgggcacccactggaggctgctgcccgggggcgtcactgcacaagtntgcctacaatgaccagggccaggtgcggcttcgagccgggctgcccatctacgagtgcaactcccgctgccgctgcggctatgactgcccaaatcgtgtggtacagaagggtatccgatatnacctctgcatcttccgcacggataatgggcgtggntggggcgtccgcaccctggagaaga

SEQ ID NO: 547508 - DNA, 252 bp, Homo sapiens
cacgagggtatcctctgtatcttgaatgtcacctatgacatattataaagattttaatgcatgtttataggaataagcatttggctattctccacattacactaaatgttctctgctacctcattaattctcacaacagctctatgaagtcaggataattagtctcattttacaagtataatggtgtggctcataaagatttagtatactgctcatagcatctgatacataacctattatctgttatcatat

SEQ ID NO: 547509 - DNA, 140 bp, Homo sapiens
gcggagtgacggtggaggttcgcggctctaacggggctttctacaagggatttataaagacgttacgaagactccctacagtgttttgaaaacaattcgaacagaacgcaggttcatttaatgaagttagataccacaca

SEQ ID NO: 547510 - DNA, 156 bp, Homo sapiens
aaagaactcaaatatattcatctgaggagcccacagacttctgtactctggggtagatgagagcagtacctccacagcctgggtaactgcatctggtagagaacaaatgtgtcaaggttcccactgcttacagccccactggtcaccagctgccca

SEQ ID NO: 547511 - DNA, 163 bp, Homo sapiens
gctccgttgtggcggagtatctcatataggcgacactgtcacgcgatgcactgttcgtatctgatgccgatgttatcatgatccgatttgtcttctcctaggcgtagcagcccaatctttcatccttaacaagcgttcagtcagagtcttgatgtgactttcc

SEQ ID NO: 547512 - DNA, 625 bp, Homo sapiens
gtgattagcttagagtggtcagttcagacattgccaattgttcgaataacgggatgacaagcatatcatcacctatgttgcgccatatgttccatgggcagttccttattataccagacagagttgtactatacacatgacatgtgttggattagatccatgggtggacagctgttgtcagcatgcgttgaatcgggctgatgcctgaataccgtctcgtttgatattaacgacacgttaatggcatacaccatgctgcttgaatgtaagcaggatatcacatctgaagaaacggttcatactgactgatgctttgaacggaatgctgagggcgtactgatcgatacatagtatgttcacgtaatgactgggaactacttccgtgtgatatgagtgattgtcagcattatcatcttacatagtcagtagtatcactactgagtggctattgattgctagtagcagtgcatcagattcagacgctgctgctacttatggatcactttgttacaggtcatcagtagccacctgtagagcgcatagtatgatctctatatgatcctccctgtaattgagatacctactgaccctacctgaggagaatacggagctcttgtatttggcc

SEQ ID NO: 547513 - DNA, 506 bp, Homo sapiens
  misc_feature (27)..(27): n is a, c, g, or t
  misc_feature (254)..(254): n is a, c, g, or t
  misc_feature (267)..(267): n is a, c, g, or t
  misc_feature (273)..(274): n is a, c, g, or t
caccctctccttaaacgcacgctgcanagctgcctcttgatgtgacaatttattttcaagcccttttacctcctgaggggcccctcggtggcacaaccagccggaatcacgacttggtgacactaaggggtcaccttttgaccccagatacaatcatggtttgaggaacagacctgagcccgcaggtacacacggcggggcaccgcgctcacaccaggcttgggttcctgccaacgctctccaaccactgcgtnaatcaggggtccncagcgnnagccccggggtccctgctaaatgcagcggcttcaaatgacagttgaactcccggaatacgataccctagagaaaagctacggagggcaaattggaggagatgggggagtgggggcagcggcgtgccttttgacctctccaagccacttgccaaaccctcgcctaccccgccagaaaaattcttaaatgagctgggcggagcgctcggagccaagggaggggtggcgctcttc

SEQ ID NO: 547514 - DNA, 165 bp, Homo sapiens
gtatctaaggattcccgatgggtagggttgggtagtgggaggtcagacgtgattacgtggcgtggcatagtgacgagtttagcagttcgtgcgcttgtgcatgcttaactgctgggttggtgatgggtgtgttgacgcgtcaattggatggggttagcgatgggg

SEQ ID NO: 547515 - DNA, 687 bp, Homo sapiens
aaaaattagctgggcgtggtggcgcatgcctgtagtcccaactactagggaggctgaggcaggagaatcacttgaacccaggaggtggaggttgcagtgagccgagatcacgccactgcactccagcctggcgacagagcgagactccctctcaaaaaaaaaaaaatacaaaaaattagccgggcattgtggtgcatgcctgtaatctcagctatttgggaggccgaggcaggagaatcacttgaacccaggaggcagaggttgcagtgagtcgagatcgtgccactgcactccagcctgggtgacagagcaagactttgtctcaaaaataataatagtaaaatgttacatgtgcatgaacgttttaaattactcatttttattaactgaagaaaataaggtagtttagactttccaagagttaactatagtttacaaaatttttttaggcaaaaatatgcttgatatattaagcagcaaatgttgtatattaagcaaaagtgtaaattcagcaattactaactgttccttacagacagtgtacttgaagtctttgggttagttctgagcaatgtggtcattgaagttggatctaagaggaaagtgggtaatcggtagctttttatttataacaggatgccaaaattaaacttcagatttttggccagtccaaaaaaacaacaaagg

SEQ ID NO: 547516 - DNA, 634 bp, Homo sapiens
ggtcgtctaaaacaggctgatgcaggagaatcacttgtatcccgggaggtggaggttgcagtgagccgagtatcacgccgttgcactccagcgctgggcaataagagtgaaattccatctcaggaaaacaaaaaaaaatctataaggggaaacagccatggccaggttggggtaagatgtaatgttgcacgaggggttatccggtttactatcggaaagagtttctgaaaacagaagaaaacccacagccagcaggagatgtgaataccactcacaggacagtgacccacagggggaccttgaactgtgtgagagggtgccgccttcacttccgggcgacaggggtgtcgaggaaaatgtcacgtgaggtcccttctggctggcaaaaagtccttgggcattggctggtaggcatgcaagagggtagactctgtgaggaagggattgggcaacatctagcaaaccggtcttcactgacctgtgacccagcaaccccctccccagaacctacctgaaggcacgggcaaaggcaggagaagctgcgtgtgcagggctgcttgtgacagtactgttgggacaactgcaaatgcccatggtaggagactggttgattcggagatctgtggaatattat

SEQ ID NO: 547517 - DNA, 1149 bp, Homo sapiens
ggtatggccaggatcaggtgtggtcaggttctctgtggtcggacccgtggccacctgggttccctttatctcactcctgccctctctgtggcactcaagtccacatggtgatcgtggtggctgttggatagtcgagcggatggcgattaggatctacaaaatctcttcagtgtacccagcggggctcatggttcagtgcactggcatgtggcctagtgtccgctcctggcctggctaaaccgctcaaagtccctcgtggctcctgtccagattccagaagcctgtgctaggactcggccacttacccatgcgagctcttgagcttctagcctcgagaggattatcacatgtgccagctagtgtgccgaaggcaggctgtcgtggatcgacggctcgatctacaaaaggtcgagggaagaacttgtcccatgttggtcacatgacgactagtcgggggcatcaattgacgggaccccttgtagaagacttgctggtaagtttccatcgcagcattgattgggatggcacgccctgagcacgaccagtggcgtgcccggggactctgagcaaggtcatcacgtcttgactgggtgaccgttgagggaccaccccaaaaaattccccgtgggtaatctggaatccctactttcgcatttcgccctttgtcgcattggtcctacaccgtaggaaacatggggctcgaacttgtgccttgattgccactgtgtccatcccaaaagagataaacctttaacgtggaattcattcccttgtcctcccaaggtggaattggtgctcattgcatgagtgggcctcgttgggtgaaacctcagaaaagttccaagcgcgacagtgcggcgcttggggcttcacaggttgatcccctagggcggtgctccaattacaagcgaaaggctatgcctagctatgacaggcccgcctttggttggcgcaaactcctaatgttgtcgcaagtgggaagaccacccggattggctggagacattggcttgaagcgccccgggggacatggggggaacccccttgtgtaaaaaagtatttgtatgtggtgagaaaccccaattcacaatagctggcgtgttggtgaaagggcacttgataccacacaatgggcaatatacctccctg

SEQ ID NO: 547518 - DNA, 322 bp, Homo sapiens
cggtccatcgtgcagaatatcactcgaaagaagagcagatgaatttggaaatgaactgaaatttggaaataacaagaaaattttacaaaaatcccaattttctgttcttaatggcttcaaaaggacattggaaagattgttgcagattaaaaacatgatcactgcatcacaaactgccagtgaaggcagtgaacacaggtgagaaaaaaacaaaacaaaacaggaaaacaaagcagaagatgaaacagaaattctcccagaactgggcagaaaatggatcaaatttgaatgagaattcaaatgagaatgatgacagattcca

SEQ ID NO: 547519 - DNA, 733 bp, Homo sapiens
catggagcgatcccttttgtttttccggcactcacagaaggagatactcaagttgaatggaacatcggttctgttacctgtggccagaaggactttcacatcatgagaatctggtttccatgttttagaacactgtgggaccggacccaccaccgaccaagaatgggtcgtgtccccagccatatgtgtcacgcgccctattcccggtgaccaaggtaactgcccaccgtgtgacttttccctccgccccctcatgtggtctgtccgtgttatctattcaacctatataagaccctcttttggagcagccctttggttttgaatttgtatcatctcacataaattctagactccataaaccctgatcccctcatatctagaggcacatgcccagaaggataagtagacaaaaaatatctcccatccttgagtagattaaaaggcatgtcggctgggcgtggtggctcatgcctgtgatccccgcactttgggaggccgaggcaggtggatcacgaggtccagagttcgagacccagcctgacccacatggtgaaaccccctctctactaagaataccaaaattaccgggttggtggcgggcgcctgtagtccagctacgagggaggctgaggcacggagaattgcttgaacctgagagtcggaggttgctgtgaaccgagatcacacccctgcactccagcctgggtggcagagccagactccgtttcaccca

SEQ ID NO: 547520 - DNA, 206 bp, Homo sapiens
gcacgagaacattctcagtaaagttttgggaaagttacatgacatggggctcatgtcgtgagcattttaaaggaaaagaaaagatggtgggaacagaactggagaaaatataaaagatgagagtagaggctgggcatggtggtccacacctataattccagcaccttgggaggccgaggcaggcggatcacgagctcgggagctcg

SEQ ID NO: 547521 - DNA, 221 bp, Homo sapiens
agcaggagctatacacctatacacctatacacctattacactgatacaccctgtcatgtggtttagttgctttccctgatacgaatataccaataaggctaaacatctgtcatgtaatattaccagccattcatatgtcttctctttcccccaacatttttttttttttggggggggggaataggggtccggagctcggaattcggaaatcaatgggtcat

SEQ ID NO: 547522 - DNA, 162 bp, Homo sapiens
gcgttgtgttctcaacttctacaatatttggcatgtagtaacactttttaaacatatacggaatgaatgtatgagcgagtcactatgttctcatctttggattcttattaccttgcacatagtagttatcaggttattcaagtaaatgtaattagcttttaa

SEQ ID NO: 547523 - DNA, 153 bp, Homo sapiens
ttcctggacctcacggtgctggatgggttgaggccgtggaagggctctgagatgactgcaggcgtagagctgatagtgtacaccgtgcccggtcacactgtgcctatcctctcactgccggacccgtgtcctccccatcgccggccagggaac

SEQ ID NO: 547524 - DNA, 410 bp, Homo sapiens
tggagagtgtcgtcctatgctgttacctaggaagattgtacgtgatgaggctgtatagttataataatgtttgtgatattcgagtctatcagaatagggcgaagtaggcctgcgtcgtatgtcgatgtttcatagcctgagactagttcggactccccttcgccgaggtcgaaaggtgttcgattggtctctgctactgtgaagataaatcatataatggtcaaggctcatgatggcaggagtactcagaggtgttcttgtattgtgataagggtggagaggttaaaggagccacttatcactaatagtatgatagtagaatgatggctacggtgacttcatctgagatcgtcagggctcactgctcgcattgcgcctgatcagtggcgtagttctgagttcgatgctca

SEQ ID NO: 547525 - DNA, 408 bp, Homo sapiens
catcatggggttctggactaccctgctatttctcagacatgctttcattgtgtcccactgaattctctaaattcccagctcattttccacactctgttagggtcctgcctcaaccattaattctacttatccatttgtttaggaataattattttctttttttcccctctaaactgggtaatttatattacgagctatttttgtatgtttaaaggattaccatccctagcctgtattgttgttttactgtgagggaatggttaggacagaataagtgtttgtgttgctctgtaatcttcaactttctaggaatgctgcttctcactggggcttccttgcttgaagatcatgggcttttcccttccactgcagaccgaggcataattgacagttggatataggatctgg

SEQ ID NO: 547526 - DNA, 220 bp, Homo sapiens
cggacgttgtttgaccgctttggtaggcccaagccagggggcatcccccctctcccaggaaagcagggagggggccggggagtttttcctctcagccccaccctgggcccccggggggaaaggcttgccccctcctcccctccccaagtgaaggaacattttttggtaaaccttattttccatttttggaaaatatttatgaataaatagttttatatgt

SEQ ID NO: 547527 - DNA, 158 bp, Homo sapiens
  misc_feature (158)..(158): n is a, c, g, or t
atctcgaagtcctgagctcaagcgatccaacagcctcggcatcccaaagtgctgggattacaggtgtgagccaccatgcccggccgcaagtttttttttttaagtcttacgtatagtgacttattttagattttttggttacggtaacaatgtgtgtn

SEQ ID NO: 547528 - DNA, 804 bp, Homo sapiens
  misc_feature (33)..(33): n is a, c, g, or t
  misc_feature (84)..(85): n is a, c, g, or t
  misc_feature (96)..(96): n is a, c, g, or t
  misc_feature (109)..(109): n is a, c, g, or t
  misc_feature (123)..(123): n is a, c, g, or t
  misc_feature (135)..(135): n is a, c, g, or t
  misc_feature (156)..(156): n is a, c, g, or t
  misc_feature (162)..(162): n is a, c, g, or t
  misc_feature (164)..(164): n is a, c, g, or t
  misc_feature (168)..(168): n is a, c, g, or t
  misc_feature (181)..(182): n is a, c, g, or t
  misc_feature (192)..(192): n is a, c, g, or t
  misc_feature (201)..(201): n is a, c, g, or t
  misc_feature (222)..(222): n is a, c, g, or t
  misc_feature (269)..(269): n is a, c, g, or t
  misc_feature (274)..(274): n is a, c, g, or t
  misc_feature (281)..(281): n is a, c, g, or t
  misc_feature (290)..(290): n is a, c, g, or t
  misc_feature (325)..(325): n is a, c, g, or t
  misc_feature (335)..(335): n is a, c, g, or t
  misc_feature (346)..(346): n is a, c, g, or t
  misc_feature (350)..(350): n is a, c, g, or t
  misc_feature (357)..(357): n is a, c, g, or t
  misc_feature (363)..(363): n is a, c, g, or t
  misc_feature (367)..(367): n is a, c, g, or t
  misc_feature (369)..(369): n is a, c, g, or t
  misc_feature (372)..(372): n is a, c, g, or t
  misc_feature (380)..(380): n is a, c, g, or t
  misc_feature (388)..(388): n is a, c, g, or t
  misc_feature (405)..(405): n is a, c, g, or t
  misc_feature (407)..(408): n is a, c, g, or t
  misc_feature (410)..(410): n is a, c, g, or t
  misc_feature (416)..(416): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (430)..(430): n is a, c, g, or t
  misc_feature (434)..(434): n is a, c, g, or t
  misc_feature (437)..(437): n is a, c, g, or t
  misc_feature (442)..(443): n is a, c, g, or t
  misc_feature (457)..(458): n is a, c, g, or t
  misc_feature (464)..(464): n is a, c, g, or t
  misc_feature (476)..(477): n is a, c, g, or t
  misc_feature (495)..(496): n is a, c, g, or t
  misc_feature (500)..(500): n is a, c, g, or t
  misc_feature (518)..(518): n is a, c, g, or t
  misc_feature (524)..(524): n is a, c, g, or t
  misc_feature (558)..(558): n is a, c, g, or t
  misc_feature (572)..(572): n is a, c, g, or t
  misc_feature (578)..(579): n is a, c, g, or t
  misc_feature (800)..(800): n is a, c, g, or t
caaagggagtcttaaaaccaaattaagattgcnaggtaaaggctgcacaaggaaaatgccttacctctgaagcccagagctggnnggggagggcangacccaggtgagntccaccctcctgcnaagggaaagggnatgtctggtgaggtatggggntccgantncagnttactctgggtgnngggcggtagntttggaagnttggtggaggatttcctgctnaacttagagggtgggccaatggggccagggcgggggaaggtgagggntgganggcaganggaagtganaaaggccacctcagcacagcagtgagaggagctgnggccaagggngggagtgaganagcnctaggtngtgggnagangntcnaagatggnccgggggntgggagggggtgggagngnncnggggtntggntgntcnagcngtgntgnggtgnnataagtggctcttnnggctcnaggttccatatnnttggtggcgctcggctgnngcgntcgggactcttgagtgcnttggtngaggacttgtaacagatcagctcctgggctcttngagggttggagctnctgcgnnggtggggacagagaatccagcatagtcctgtcccctggagcagccttgccatacttctgcatggcttccaggccggcatccatggcagcagaccaggctgggaggctggtcttggccttcaggggctgtgcagccgcagtcaggaacaggccatagagcgccccagatgagcctcccatcttctccaggagcaggacagacaacttggagagcagctgggnaggg

SEQ ID NO: 547529 - DNA, 270 bp, Homo sapiens
tgggaagggaagggaatggggagaagggaaaagcaagcagggtttgagcctcgggggcttccccctccccctttgcctatcccctccccttgggttgggccttgagccttggctgggagctgaaaggggttgcagctggtgggatgagacctccttttccccgttttgggggggggggggccagcagataaatcccccccttccttgggcggtcgggggactttgaggttcagccaggtcagattttataaaaattaattaaaatctcca

SEQ ID NO: 547530 - DNA, 121 bp, Homo sapiens
gaaacaactttgtcattttattcaatagacatgaactgagcctcggtgctgggctaagctgtacggatacgaaaggtataaagctctgtctgtgctacacgggactccttttgtggggtgg

SEQ ID NO: 547531 - DNA, 342 bp, Homo sapiens
gaggccatggtaacgatggagctgtgcctgtggaggcggtggtgggggcagtaggctcatctgcggagatggccgtgacgtagggtatgggcctaaataggccatggtgagtcatgagctgggtctgtagaggctgatgggagaaagttcggggcctggagaggctgccgggaggtaggagcataaggtagaatcagggggcgtcttaagctggttttcctgcaacgggatggtcccacgtttcactgtcacccctcgggaatccacgtatacgaaaattccaaatattagtggggcataggggcaagcacctgtagtctcagccacgggggaggttgagag

SEQ ID NO: 547532 - DNA, 653 bp, Homo sapiens
gccatgctgtgtctggcagagctgtcagtctctgcacttgaggccctaggccgtcatagacgtgaaggctcttcagcgtcatcatgtggagacagacggtaggaatcctgcaaatgagcagaaaggatctgatgatgaaagtttgttctgaagctactacaaactcaagtcagtgagttgcttctgtaccagttttgtttttttttttttttttggaaatagaagtcttgtgcttcccacctttgaaggtgcagggggtggtgactcctccttcttcacgtgcaagccttccgccctccgtgggttctcaagcaatttctgcctcagccttcccaagttaccgtgggactacaagttgcgcgccaccacgccgtggctaatttgggtattttgggtagagacgggtttgccccattttgggccaggcgtggttctcgaacccccgacctcgaggtgattccacccgcctcggcctccaaaaggtgctggggattacagggctgtgagccacctggcccggtcaagactctctcgttctctaggaggagacggtctgggagcgcctccagggacgaaggctgtcgctctggccccaggaagccgccctgttagaggctgtccctccttttccccatctcctgcggggccctcca

SEQ ID NO: 547533 - DNA, 147 bp, Homo sapiens
cattccctacacagtttgaaaaaaaaaattaaaagataacacaaaatttaaaaagcaatacagtataacaactatttgcatagcatttacattgtattaggtattataagtaatctagagattatgtaaagtgtatggaaggatcgt

SEQ ID NO: 547534 - DNA, 386 bp, Homo sapiens
attgaaaatattacagacgcatcatggcacaatcactgccagctgcacactctaacattgtaacatatgatggagagaactgggcaggctatggattgtgtaagggagatgcacttaactgcactctagtctgtgtgatcatagcgagaccctatctcaaataatatataattatttttgacaagtttccagcatatttagtgcagaggtggacaattggttccatttccctagcccattatttcaagaaatgtaaatccccctgtatgctgacatttggaatgtgacctttgtgagttttccacgttaatgatggtattcttcatataccttaaatttccaccatttttcactgtgcttcgtccaacctatatcccgctcataag

SEQ ID NO: 547535 - DNA, 102 bp, Homo sapiens
tgtctcagtttcgggatgcaggtcacctacggccccacagagagagcgtcgctctctcggtggggcccttccagcctgcagtctcgtcccgaaactgagaca

SEQ ID NO: 547536 - DNA, 228 bp, Homo sapiens
aaaaaaaaacttttggggccaacgagccatcaatatttagggataatggaagacgttactgggggactgacaccactaaaatagaagattcaaaatcctataccataaaaattacaatcaaaagtggactaaagagaaaaggagcttaaagttatactgcaatagggctgatacatattcttcccccaaatcatactctggctcccaaaatttttttatactacagcc

SEQ ID NO: 547537 - DNA, 451 bp, Homo sapiens
atcatatcggtcataaccctgctggcttcccttgccataggtagaaactatagaggtaaacatttcttttatagtagcaggtgtgttgtaccaatagaacttgtcaacattgtaatctgcataaggaatatatatcgcacattctgtgacttaaaattacattataggaatggtcatgaagcctgatctccttcctcagccccactgtccagtagaaaaattgatccagatttagtcttcaatatgtaatccatcttcttcttggatgtgcagaatggtctggatcatattgtatttaaggcttaacatctcatgccaagtaattttttcttctgaatcacagtaaaactgtgttggaaatcagttcaagaaaattttgcttgattgtagtgcatgatggtaagtgttgcattgtgagttcatcccgagtaaggaagagagcctgtttctc

SEQ ID NO: 547538 - DNA, 291 bp, Homo sapiens
tttttgcacttccagcccaggcgctggcacgaggcagctgccgaaggctgtgcccacaggcactgagtgctcagatgactttgaggagcgagaccctgacctgagagacgggctggagaacatgctgccagccccttcgggaagtggacactgttcagcgcggctcagacccaccagctgcggcgactgcggggcccagccaagtgccgctgagtgcgaagccttcatggtcagcgggacggagagtgaggagtgctttctgacctgccacaagcgctgcctggagactct

SEQ ID NO: 547539 - DNA, 556 bp, Homo sapiens
agtttttctctgggcctatgaaagttctcaaaattctagatctacagtcttaagattatctttttatgacgtgtcatttaggtcatcattgcaggacattttcttcttcataaattatttcctaaggagtaaatcaaattaaataatgaatgtaggactgctttgtaagcagtgacacccttcatttaaaaaactagttgtcactcttcattcctagagtgttatttgtggcaaatagaaatgaagggtcaatgtaatgaccttaatgactatttcgtggtacacaattctccctggctttgcctttctttttctagtatctaaaatagccagtcagctatgtggaactcacttgctaatgcaagacccaagtttgagctttgggtcaatcacttgggtgaaaactcaccatatgacttttctcatttaaatgtttttgttgttgttgttgagacagagtctcaccctgtcacccgggttggagagtagtggtgcgatctcagctcactgaaacctctgcctcccaggttcaagagattcttcggcttcagcctcc

SEQ ID NO: 547540 - DNA, 318 bp, Homo sapiens
aaatcaaaacactactctgacatcagaacatatttatgaagaactctttctataaacttttgtcaattttccatattaaccataatgctgccagatgattacatctttcattgaaacataacaaaaactttacatttgggattcagggtggtattatttatttttggagggctttgtagagtcaggctatcaggtgccagttgacgttatttattaatctggatagcatgatattagttcagaaggcaatttccatttttaaggttatgtctcagaaaactgtgaaagggattttagcatgatgaaaactttgactat

SEQ ID NO: 547541 - DNA, 192 bp, Homo sapiens
  misc_feature (10)..(10): n is a, c, g, or t
  misc_feature (187)..(187): n is a, c, g, or t
gatggctccnggggacctggctgggcgaccgggaaagtgaccggatctctcaaggggagaccttcgtgacgttgacgtccctgggaagaaacggagataggtcgtccttcatcgatctcgtcagtagcgggttaagggtcgtcgtcaattttacacggcgaacttaagtcgaacctgaattggtccnacttg

SEQ ID NO: 547542 - DNA, 443 bp, Homo sapiens
acacatatatgatgtgtgaccaatgctatggtttgaatgtttgtcccttctaaaactcatgttgaaacttaaccccctgtgaggcagtgttgagaggtggggcttttaagaggtgattggtcatgcaggctctgccctcatgaatggattaatccatgagtaatcacaggagtgaggctggtggccttataagaaggggaagacagacctgagttagcatgctcagcctccttactatgtgtgccctgcaccatcttgagactctgcagagagtcccactagtaagcagactctcaccagaggcagccccttgacttggacttctgaaccaccataactgtaagaaataaattccttttctttataagttgcaaagtttcaagtattctgttataagccacagaaaatgaaaataagacaacctacttatatatttcctcgtg

SEQ ID NO: 547543 - DNA, 168 bp, Homo sapiens
  misc_feature (86)..(86): n is a, c, g, or t
  misc_feature (119)..(119): n is a, c, g, or t
  misc_feature (146)..(146): n is a, c, g, or t
gtcgcggttgcttctggaccgaacgaaggacgacgaatgcagaaatgagacagacaaaaggatctgtttgaaagaaggggtcaggnggctccttgatattagggaacagggacctgagncttttgcagcccagttcatatttattnaggtagaaagtgaatagggagg

SEQ ID NO: 547544 - DNA, 335 bp, Homo sapiens
cccccttttttgggggggccccttggggttttccccgcccccaaaaaagggcccctttttttctttttgggaaaggggggacccccaaaatttcccccgggaaaatttttttttgggttttttgggaacccccctcaaaagggaattccccccccccgggggggggaaaaggtttttgtttttttttcccccaaaccctcccccccttttaaattttttttaaaaaaagggggggggggggggggggtttttcccctttttttggggtttgggcccccaatttttttggttttgtttttttttttaaaaaaaaattttttttggtttttttccca

SEQ ID NO: 547545 - DNA, 1200 bp, Homo sapiens
agcgcgggcacaggcagggcccaaacacaccgggcgtggagcctcaggacccctaatccttcggaggcgcacacctctctcgcagcaagtgtcccacgacactccgctgtgcccgtggaggggactcaaccgatggcggcatagggaggcaccctctctagtgcgaacccaagggccgcggagacctccgggggcggataactcggctcgttacctacaagccagcgcgcccaggggtgtaccaaactcacccggcgtgagtgggaccagcggctggcacgacgccctccggccaggccggctaatgacctgcttgagcatggagggttctgcttctgccgctgggccagccaaagtggccttccctactctttctaagccctcgttgtgtactccgttcgagcaaggtaccctctcctacctatggtgtgattgatataggagtgggtgtgaatgtgggggtgtagcccgtgggtggcgttagtccctagcctgttgctggcccggcagttgggactagcctactgatcctgcgttgccgcacggtgccctcctcaggctgggtcacccagtgcttgttcacctgatctactccgtgagcgttctcccaaacagggagtcaggtttagaggggccagggcctcttggaggcccctcgtgtcttgcgatgggattctgcttcctgtgccttctgaggctggctcaggggcttctatgggatcctggaagttccttagggacttgcccagggtcccagggccacccacacttgcgatgctgctccctgataggcccgcaacctcctacgtcccggctgggctccagaccccagcttcctgccctccaccgggagtctgcatggttgggagtcactgggtggaggggcctattgatgaggctggacccggctcagggacaggtggaggagctgggcctcccacagggtgcccgggcagtgccattcctggatgggggatgggcagcgcttcaaagcgtgtggggtctacagtcctgcaggtctaggcagggctgaccggttcgtccacgctcgcccatcgcgccccaggccccctgcctgtgcctgccttgcaccccgtcttgcttgggccacggtgtctatgcattgccctgccttatttgccattcacctcttttcttccccgcccctgaaattaaggggtactggagccccagggaact

SEQ ID NO: 547546 - DNA, 442 bp, Homo sapiens
agtcttgctctgccacccaggctggagtacagtgagccaagatcgcgccattgcactccagcccaggctacagtgtgagactccgtctcaaaaaaaaaaaaaaaaaagaagagaaaagaaatatagcatctcttcaacaaacggttggggacaactggatttgcacatgcgaaagaatgaagttggattcctatccctcaccatgtaaaaaaaatcaactcaaaatggatcaacgacctaaatataaaagctgaaatcacacaactcttagaaaaaacataggagttaatcttcatgaccttggatttggcaatggattcttagataggacaccaaaaggaccagcaataaaagaaaaaacatataaattggattcgcaaaatttaaaacttcgtgcacaaaggacattataaataaagtaaaatgacaacctaaagaaaaa

SEQ ID NO: 547547 - DNA, 302 bp, Homo sapiens
cctttttaacccccgggccccctttgggcccccccccccttttccggggggcccccccccccggccccccccggccaaatttgggcccgggggttttaattcccctggcgcccccccccccgccgttgggctttttattttggggttttaaaccaaacgggatttccccccgggggggggtccccccccaaaaaaccccaaaattttttttttttggggcctttttcccgggggaagggtgggggaccccccccccgggggttttttttttttccccaaaaaaagtttttttttttctttta

SEQ ID NO: 547548 - DNA, 287 bp, Homo sapiens
ggaaaaaaaataaaataaataacagttttttttatttgaccattcctaaaagattaggtagtaatacttaaacacagtaataaggtcaaaaaagaacagaacattcaaattaaaaggcaatgtacttcactggtcatttttatgactcctagagtagtcatagcatctctacaaataagttgtcctatgataacaatacagatgcttcagattcctatagcactgcatgtgtctcacaccaatcctgctacgtaaatagaatcataacctccttttaaaattaagga

SEQ ID NO: 547549 - DNA, 260 bp, Homo sapiens
gtgattttaaggtttttctatggtgaaggttcaaactgtaataaccatgtttacaatttttcttggtcttaaataatttcttatattacttattaatagtcaagcttgggggttatttaagcttcttggacgagcctaaaactttgtatcctgaaggaaaatatttttttccaccagaggaaattgctttcaatttcttaaccttcaaaacaatgtcaagtgtttgtcaacctgtgcatttgatagccacagcacaggta

SEQ ID NO: 547550 - DNA, 716 bp, Homo sapiens
  misc_feature (428)..(428): n is a, c, g, or t
  misc_feature (659)..(659): n is a, c, g, or t
gaggcggagggacagaaacccctgtgggttgtgaggccgcccagcacggtggcagcacgaagaggaactacctgctgactgctggctcatcacacctcattatcaaggatcttggagaaattcattcatggcttttggatcacagaccagttattcaaagtgaaactcgttattttgtaaaagactttgaagacaaacgtgggctccgagaaatgcgagatctcgaaaatttgaagaacatgatccactgaaacatatgagcatactctgtccaaatgtagagacacactgcgggacactctcagccagattctccacagatagcaagcagctaatgactcagtctgtagactccaacacagggagcacgaacgaagattcatagtgaccactcagaagctagtgagaaacagcatatgctccagagngacaactttatgaatgagcaacccaacacaagggctgaagtgtatgaacagcacacgaaattttcatccttttaagaacttgaaccacaacactcacaaactaatgagaagatgtgcacctctctcctgagaactatatccaccagaccgcttagactctgcttcaagcttagcaatatattcagaggcactcttatatcacaagaaagaagattctactggcgttctganaggatatttgaagggtgccacaatttttccagctctgtgcctatatatgattatttg

SEQ ID NO: 547551 - DNA, 431 bp, Homo sapiens
  misc_feature (13)..(13): n is a, c, g, or t
  misc_feature (15)..(15): n is a, c, g, or t
  misc_feature (17)..(17): n is a, c, g, or t
  misc_feature (22)..(23): n is a, c, g, or t
  misc_feature (25)..(25): n is a, c, g, or t
  misc_feature (44)..(44): n is a, c, g, or t
  misc_feature (71)..(71): n is a, c, g, or t
  misc_feature (96)..(96): n is a, c, g, or t
  misc_feature (103)..(103): n is a, c, g, or t
  misc_feature (107)..(107): n is a, c, g, or t
  misc_feature (148)..(148): n is a, c, g, or t
  misc_feature (217)..(217): n is a, c, g, or t
  misc_feature (225)..(225): n is a, c, g, or t
  misc_feature (238)..(238): n is a, c, g, or t
  misc_feature (243)..(243): n is a, c, g, or t
  misc_feature (257)..(257): n is a, c, g, or t
  misc_feature (311)..(311): n is a, c, g, or t
  misc_feature (321)..(321): n is a, c, g, or t
  misc_feature (330)..(330): n is a, c, g, or t
  misc_feature (342)..(342): n is a, c, g, or t
  misc_feature (349)..(349): n is a, c, g, or t
  misc_feature (356)..(357): n is a, c, g, or t
  misc_feature (388)..(388): n is a, c, g, or t
  misc_feature (392)..(392): n is a, c, g, or t
  misc_feature (408)..(408): n is a, c, g, or t
  misc_feature (412)..(412): n is a, c, g, or t
catcatggcgcgntncntgganntnaaagtggtcttcaaaccantggcgtaccgaatttatgtttctacanatgcataattaagaggtctacatanttccatnatcnctcaaaggggaacgaattccattctgtcatgccaggtgttngtcagaaccttcaaaacgaaagtggttatcagtggagcttgtattacaaatagatcgtatttctacacnggctctgntcctctcatggtnctganatcctctggtgttntcaggacccctgggctacctcagtacccctacgggtagcccatctgcagtctgnctcttccggnatagccggngactcgtcccgnggctttnctcctgnntccccatctcggtttggcgacgcctcccgancccngggctgccagagtgantgangcttctctcataggaatag

SEQ ID NO: 547552 - DNA, 1524 bp, Homo sapiens
  misc_feature (906)..(906): n is a, c, g, or t
ctgccctctctgtgagactcatagtcagatagactaaggaggacacctgcagcaagagcagtctgctagtctgtcatcttgcgccgtttgctgatatctttctttttgctctgtttgtctgatgatgctagtttatttggtggacgttgtcttttcttactgggtttctttttgcgtttgtttgtggtcccattcgacgtctgtctgtctcgatcggattgttggttcaacagacgacctcttatgtcctccatgataggtccatcgttccgctcgctgaggtttgtgctccgtcttttagttggggttttgttgtttttggtcctttatgtggggacgccggtgcttgttcgtcgtgtgctctcccaatatttttgttgcagggttgtgctcccccctgggggggctcccccccttgctgcctctgtgtgccgaaatggctttggcccacccgtcgcctgtgtgcgcttgtgcccagtgtcgtgggagcaccccccctggggccctttgggtcctctcctttaaggccccctgtcccgggcttattgctcccactggctaccgggtggggagccccacgggattttccgcgtgatgtatactctctgggcccctttggcccatgcgaggagttcccccgttgtccgtacggggccagagttggtcccaactggccccggtttggatgaccttttatatggagcctatttggccacaaggtatcccccgcgtgtacacggatgaggccacagctatagccgcttagtccacgggaacaatctctgacgcgaccgggcgccaaaataccacacggttcggccaacccccaggatacttgcccgccataagcaggtaatactttggagacacacccattctgtccgccaactttggatcaccgggtanagctctggacaccggcgtttgacaccaatatgatacccgcggagacccggctttctccaaggcgccccgaccgggtgagcgccagaaccggagccctcggagaggtcacatgcgtccacaccacggctgaccacgaggcctgttatccgcggagcactgttgtctcacgcaccctctcgcgggaatgtaaatcacgcgccaccacgctatacttctcctgtagaagaggtatacccgcctgcacacacacggctgtccgaatgggaccactcttcctctgtgaccccgcggggagcccacgaatggaggccaccaggactgaagctggcccacagaaggggtggaaactgtctgaatgggagtttccttcacattcccttcttgatataaggtacatcccccacgcctggagtccccagaaagagagactgagattctcttagacccagaaagaagggatgaccaatggccaccagatgttttggaagattccccgagtgtgttcccaagaaggcttccccttgagggagggctggaatctgtcttccccgactcggctcctccggtctttagccccccccttgtctaagactttggtctattaagtgccctaccaga

SEQ ID NO: 547553 - DNA, 700 bp, Homo sapiens
taaaaaatcctccctcgccgggtggtctaacatttaggcaggcctataaaacatttctgtccacaagttagcctctaaaatcgtggaagctttcgtgtgctaatggcggagtggccaaacttcctctcaaatgttgagcccggccatgtgcccgcatctgcttctctagtataagcccaagatgtgaatcctgtgccatgggggcctcatattaagtcgtatcgacatctattagttttcagagaccttacggaagagtaagaggtcgtttattgcgttcacaatccagatagttgacaaggaatatcacagatactgttcagtagcagaatataacgaccattgcgatctggttccatcaatgtgcatccatctatatgtgataaggtatatccaaggaagacatccatttcatatagtcgattttaatccaaagctttatgggttgaacaaggacaggtttcgttcgtgaggagctcatttacatcggtcgcacggtcttattcatgagaggacacagtgcttcgggtctgacacctagtgggagctctaagtcctcttttcagaatcgaaagctataacagtcatagcaagattaccccggtttaagctcatcctgaatgtcacctaataaatgcttcgccatcagtatgccacgtgttaactgggctgccactattaaccgacgtttcgcccctct

SEQ ID NO: 547554 - DNA, 519 bp, Homo sapiens
gggcccactgaggcaggctccggctccgtctggttggggctgttgttttgatggatcgtgtgcttttcccttacctcttatcacttgctgtcatctgttgacttaggcccagtctgcagatgtagtgtagtagtttcctattgctgggttagcttatggcagtattagagtattacttgcctcctactttatagtggaagacagaccataatcccagatgtaagagtgaaattagatagtatcatattattaccgtattaggctgagaggtaaagttccgacacctaacacagaggaacgaagacaggaccagaacggcagtagtagaaacgaccaaggaaaaaaacaaaaaatagagaaggaatgcatggggaacccaggaaaagcagagaagaggacaaaaaaagaacacaagaccaaaagaccactcacacgacgcacgaaggagtactccaggaaaaaaacaaaaaacgcctaacaacatggcactggaagcacaaaacaaaacaattgataaca

SEQ ID NO: 547555 - DNA, 101 bp, Homo sapiens
ctctctatggctatgcggtgcagcggtgtcggctgtggcttaggcctgggtggaggtggcagtgtctcggctaaaccttgaggaacgaggacacggagatg

SEQ ID NO: 547556 - DNA, 160 bp, Homo sapiens
  misc_feature (37)..(37): n is a, c, g, or t
ttaacgtgtagacagtagtagtaggctggctatgccngatgtgtctacctttctctgataggaggcaggtacagcagcaaggctgaagagagccttatcagctcctcaattccagtgtccttaaccatagtccatctgtttgcaccctaggttggtgtcc

SEQ ID NO: 547557 - DNA, 443 bp, Homo sapiens
gcggcgcctactactactaaattcgcggccgcgtcgacgggtcaggacctcttttctctaagttgctttgttcagggtattttatcacagcaacagaaatgaaacaggcaggatctaagagggcatttctctataaacaaaaatatataaattgttactaaacaaatgcagtgatgctcagtatcattagccaagcctaaaacaggtatcatttctccccctttaggatagtcatcaacaaagagacaaataaaaacagatgctggtaaggctgtggacaaatcagaaactgctcacactgatgttagaatgtttgaagaaagtttagcagattttccaaatgtcaaacaaagatttctagaaatccagtgattctagttgtagatatataccaagggaataagaatacacagtgtacctccacctaaaaatacatgatccaa

SEQ ID NO: 547558 - DNA, 994 bp, Homo sapiens
gcggggttttgccatggtagtcaggctggtcttgaacctcctgagctcaagtgatccaccagctcgtgctcccaaagtgttgagatgacagggacgagccacaggcccagcctgagtggtatctgctttagggaccaggtagactttaaaaggagggttagagaaacgccagtgtcttgtgctgaggtaaatacatttactgctcaggaacacattgcccagatctccactccgagcagcgccccctgaatagaaaatcagtcgtgtccccagggactgctaatagcttggggctccaggaaatcatccagttagagttggagattcagagattacttgaagccaggacatgctccgtaactccttgcccgattaaaggtgtaatgaatagacgcagagggtgtaccctgttagccagcagatacatgggaatcggctggtgtgccgttcagggaggaagagggcacggtggtccaagctatgagtgacgtaggctatgaggatggtgctgactttgtccatccctcatccaagatgttctcaagctccatccatgcggtgttcagaaccttgttacgcggaaacgggctcaggagtgaccccaggattcagggtgtggagtcggcgtaaacacgacatgctagaagctgtacacatgctaactgcaggatagactcggaactcaggctcttccggtacctacgtggagggtataccgtgcggttcccaataatccataagcatgcccacgagggatccatcagggagccatgcgtgggccaacagcgccaggccatggcctgaaggctgactgggaagagccagagagaactcttgccctgccgggaccctaccggagcggtggagctcggagacgaacagagaatggtcccccgggctgggcactcatgcgggtcatttacttgcgaaccgggttcagacatggccggggacggcctcagcacgaggtaacccgccttgaattcgacataat

SEQ ID NO: 547559 - DNA, 134 bp, Homo sapiens
ctctcgaggacccccagttattagaaaaaaaagttatgttacagaggtatatttatgaacagtagatgtgctgttcaaaagaatttacaaaacagtacgtttccatgttttttaaaaaaatcaaatatgtcaat

SEQ ID NO: 547560 - DNA, 511 bp, Homo sapiens
tgttgctgagaggtgaatgtggacagtggagagcatttgccagcagagacaggaaggccatggtggtctgggctaacacaggtggtgctggacaggccatgtgccctggctggacactttctctgccccgtgaccacacgcagcctcagccaagccctggaccccacccttggactcagcctgtgcccaatcctgctctacacctagccctggccctggggactctgatcgtagtgtgtgacctggaggcccaccctcagaatggggactgatgtcctgctgctccagggctgcatgcaccggccacagacccagggcggtcccaggggcattcttagccagcatggcactgcccacattcaagacacctcacacaaccactgcccagctccgcagccagcaacatctccctcagcgcccaggctgccaggtgggcacgccatgtcctgccccggcgcagtgcacagagatgcacaaggggaggggggctgctcccggtgctgtgcggccg

SEQ ID NO: 547561 - DNA, 414 bp, Homo sapiens
tatgtatcgccaacacattatttattcattgtattaatggtatgtcacattttttactgtataaatacttatgtgcaaataagtgtaagagaatgattcttattggtagcacatgaattctgaatcaggaataatggtgatgccaaacaatcacagactgtacatgtgggtggctgggtgacatctttgctttctcatggttcaatgtatacaaactttgtttcatacacaaaataaataaaatcattgctataaaattaccttcaagccatgtgtaaggtaaatggatacaccataaatggatttcctgtttagacttgggtcttatccccaacatatctcattatgtgtatgcaaatactcaaatacaaaaaattagccgggatgtgtttactgtgttgggcgataacatca

SEQ ID NO: 547562 - DNA, 472 bp, Homo sapiens
gatctcgaggatcccatggcggggtcccagccatgtctggccatgtctccaagaagaaaacgagcctgattaagccttgattttgataacaaaagatgacaggaactccaaacaagctagcaatcagaatgttcaatatcattggactgattgttttagagaactaaaataaaatcttattcttattttttaaatgttttgattccagaccaagggtaaaaaacaaatacaacaaatatatagaccccacactccctctagtggaccttcactttcattaaccaaatgttttccaagaggctataagtcggcctggcactgtggctcgcacttataatcccagcactttgggaggccaaagtgttgaggtgttgacattacaggtgtgagacatcatgcctggtatatatatatactttttttttaattcttaccttggttgggagtacggcttcttttttttttttttttt

SEQ ID NO: 547563 - DNA, 129 bp, Homo sapiens
ctcgcgggtgcctgatcagctggttgtccaagcatcagcaatcttcagttccacactttcacacatttgccccaccagcacagtccttccggggtcacgcagctcgcacattcgtcacatccatgggtc

SEQ ID NO: 547564 - DNA, 153 bp, Homo sapiens
agtcgtccacaactgtcgtgactgtgataacctggcgggtggactgtgatgttccgcagcaacattgcaacagactggccttctgtatgttactttcaacaggcccacatgatacaattagcgaattcccaccgcacaaaacaagggcggccg

SEQ ID NO: 547565 - DNA, 93 bp, Homo sapiens
  misc_feature (48)..(48): n is a, c, g, or t
acggccgtgtattactgtgcgagagagacgtggtgggatattgtactnaagggccccctgaaagatgactggttcgacccctggggccaggga

SEQ ID NO: 547566 - DNA, 790 bp, Homo sapiens
gggctggtgtgcgtgcctcgtactgtgtgtgctgggcactgggtctaggccaggtatgacacccattctcctgatgagatcttcactgtcagatctgctataatggtccgtattactacaaacggatgagatgcgtagtctcatcttgagtacctacatattgtgtggtaaagacttgtcgttgacttcttctttgagcggatccttgaaacatgatgaagtctcggagtcacccatgataaagcggggcaactccatgtgtgcctctttcccacgtagtactgagagggcctgcttgttctgggagtggagcggagaggagcgaatacggagccaagcagggtgcatcatctatagtggccgtatgtcccttaaataattagagccttaaagggggcgaaaccaacattcgcatctcttgtgcaggaagtagaagtctcacagggaggacatatccgcgctgttagaaacacagtagtggtggcgcaacgcgccgtccgatggtcaaaaatgttgtcggtcgtcgagtacttcttgagtgtagttgatcggtgtggggactgatagatgaatcgtagagggtttgctttcttgttaggacacacgtggaaggaagttgggtgcgataactttctgcgactttgtgctgttagtgagttggaacccagtgcattaacagacgttttggaggggtaaacaaagggggggatggatgattgggaggacgcatgaaaaatgtgtgatatagaaagcgagtgttaatagagaaggaccacgttgacaatatgga

SEQ ID NO: 547567 - DNA, 179 bp, Homo sapiens
tcaagcttctaacgatgtacggggacatgttggtgttgtggtgcacgcctgtagtcccagctactcaggaagctgaggcaggaagatcacttgagctcaggaagtttgaggaggcaagtgaagctatggtctttgtcactgcggctccagcctaggaaatagagctagaccttacccca

SEQ ID NO: 547568 - DNA, 607 bp, Homo sapiens
  misc_feature (348)..(348): n is a, c, g, or t
tgcttgactgattcagaaaagtactgaagtgaaagattttagcatttatttctcctggctttcttccatctgccaggaataactcagttcactgaaggcttctgacaggtccctgaccttggcccctatctttgccatcagtgtttggggtgaggagagaatgggctttgaggatggttgcctctttttcactgctgcacctcctcattatctctccaggaagcaggttgattctggccggcaaagctccctgaggtgggatccattcagtccattcttacaggggtaatagggcttggggctcatttcagtcagccttcgttggaagagagaggtccctttcctttncttttgaagattgattagtttccaaagaaagacagataacaccactctcattctcactttctctcttttttctgttcttgaaaactcaatagttgtgtacaataagaagtcttgctagacaaattgtgcctatgctttatgttctgtaaacatgattcttgaagctgagaaacttttaatggaaccctttagctaagctgaaattacttacataatccaactctgtattagttttcctggtttttgaaatagtgtcacc

SEQ ID NO: 547569 - DNA, 150 bp, Homo sapiens
tatgcagcagtaatacagcagcaagaaaagactgcccttgacagtacccaatgttttcatcatacacagagtaggccttgcagattttatagagtgattcttgaccatctcctccagtatctttaaagtaatcatgtccggggtatgtac

SEQ ID NO: 547570 - DNA, 103 bp, Homo sapiens
gaccagatctggtagtcggcggtagtccttgccgttgccggcgcggcccaggtctttacctttggtctggttatagcccacgaacggacgcagaccgaagtcg

SEQ ID NO: 547571 - DNA, 307 bp, Homo sapiens
tggcgatctagaggatcccggaagcacactgcaacatcctttcatgataaaaacactctaacaatgaggaagtggaaaggaattaccttaacctgatgaagggtatctaccaaaaactcacaactaatatcatacttaatggtgaaagattaaaaacgttcccacgaagatcaggaacaagacaaggatgtctgctgttaccactctactcaatattatacttgagggtctatccacagcaggagaaagaaaaggcattcagatgggaaaggaaaaagcagaactacctctatttgtagatgacata

SEQ ID NO: 547572 - DNA, 436 bp, Homo sapiens
cgtcaggaagctaagtgtactgagtctaagtggggtcatgctgacggatgtaagtcccgagcccctaccaagctctgttggagagagcctctgacagcctccaggacctggtctaatgatgagtgtgggatcacggatgatcagctccttgccctcctgacttccctgagccactgctcccagcttacgagcttaagcttctacgggaattccatctccatatctgccctggaaaagtctcctgcgagtactcatacgggctgagcaatctgacccaagtgctgtatcctgtccccctggaagagttatgaggacctccataggtacccctccaactggagaggcttgcttatctgcatgccaggctcagggagttgctgtgtgcgttggggcgagccagcatggtctgggtagtgccaacccctgttctcactgt

SEQ ID NO: 547573 - DNA, 337 bp, Homo sapiens
tacaacggcgacgtcatgctcaacagattatttggaccgtatgtattacgggatatagtaacatcatttagtctccacccggcagggagtagggcttagatgtatacaacacctctgcttactgatgtcgccttaatattctgctattgcagcaattcaaaaatagtcttccagtaccatttggcacactaaccacgtgcatgtgcatcatcattcctcaaactatgaaacctttttcctcagtgtccgctcacatcatttgttctgggagtctaaagccaccccacgtacgttaataagcaaaatcctgactattatgctgtggggcatctctcac

SEQ ID NO: 547574 - DNA, 248 bp, Homo sapiens
aagcttttaccgcctagccaggaccagccagccggagaccggagtccgagagacgcagacagcaacagacgagagacagccaaggtacgatcagcagcaccaagccaagaagcctaaagagcagtcagacctgactgcagcagcacgctcgcactcgccagagcacagcagcactgacacaactacagccatagcgagtcatagacaacacccaacacactaatcctatctaatttggcccactcctc

SEQ ID NO: 547575 - DNA, 144 bp, Homo sapiens
tgctggtctcatacgtactacatggtggtctaggagcagctgggcggatagcaccgggcatattctggaatggatgaggtctgacacccgtgagcagtccagcgaggacttggtcttacgatgagcaatttggctaggaggata

SEQ ID NO: 547576 - DNA, 123 bp, Homo sapiens
gggtgctctagcaggatccttatccccgatctgggtatggggaggggggttcatagtagaagagcgatggtgagagctaaggtcggggcggaaactgggaggctgaggcaggagaattgcttg

SEQ ID NO: 547577 - DNA, 244 bp, Homo sapiens
tcttgctaagggcggttagcgatgccccaccatctgaagcacgtcatagctctgtcctgacacataggcgtggatcatgacaaatgtaatacagaggtatccatgatgattaccaggtggggagccacgttcatgccccagcagagactccgagaagccaacaccaactggatagcccctgagctgaagagctgctccaccaggcgtcgctccatggggctgagcccctcatgcaggtagccca

SEQ ID NO: 547578 - DNA, 613 bp, Homo sapiens
  misc_feature (200)..(200): n is a, c, g, or t
  misc_feature (203)..(203): n is a, c, g, or t
tcgatctagaggagcccctatgttctcgatcgttaaacccttccccagttttttttttatactttaaaccccggctcctcagggcctgggccctttctggaagctggcttcctcttataaaatagctttggccgaaacatagtttttttttagcagatcccaaaatataatgaaggggagggggggatattggggtcggngtncttataatatattattattcttcctgggttctagaaaaatagataaatatatttttttcaggaaatagtgtggtgtttccagttggatgtggcggggtggttgagtgagtgaattttcatgtggcggggtgggttttggcctttttctctggcccggttcctgggtgccttcggatggggcgggaatagtggagggggatggttctaccctttcggccttcggttggggacccagcgggtgtccttgggttggcttactacaggctctagggctgtgctatccaatacagtaaccacatgcggtggtttaaagttaagccaattaaaatcacttaagattaaaaattccttcctcagtggcactaaccacgttctagaggcgtcctgtgtgtgggtcatgcctactgtac

SEQ ID NO: 547579 - DNA, 110 bp, Homo sapiens
tctcgatatctgacctcaagtgatcgcccgcttgactcccaaagtgctgggattccatggcatgagccactgtgctgggtcatcttagggactttttattaacaaaccct

SEQ ID NO: 547580 - DNA, 823 bp, Homo sapiens
gtagggaccaatactttgggaggccctccttggcgggccccggtcccccagttctgcccacaccgcccgggggtttcccaccacggcggagttgtctgaacacacagcaccgggcgctttcgtccctcccagaggtacaccggggaaacaccttggcggttgccaagagaaccgtttcaccacgggttctgaccgcccccccgggggtctttaatatgttgtcctgccccccgacgtagagctttcaaccttaggtcctggtgcctatagggggcatgtgccccttcatttgggagtcttcaactgccccccctcttccacccccgggtcttcctagtagcttccacaacccgggtatccggcgtccactcctagccacctggtctgaaatctctccaactgtatcactaattctcaagtccattctccccccccctttaagtcttatcgtcgcacattctcacgcaataaacgactttcgtttgagtcagcccccctctcccaattcacgtcctcctacaaggcagatacaaaattctctttaacgcacggttcctgtctctcataaccagtcgaggagcacacagggcgtgcatcacccctaggattgttcgttaggagccacggggtgccccgatcagtaatagcgcacaccatcgacgggtgatcaaaccatttatccatctttgttggacaagttgcgctatgactttctccgtctctttgcgctgtcttgctattgcatctcaacccgtctgcacaagaaagggttttgtaatacgtgtagattaattaaaccccgttgggacaaccaaaaaaaaca

SEQ ID NO: 547581 - DNA, 373 bp, Homo sapiens
gtctgtaccggtgtttccctttgtctctataccccaggaaagaaaggggcagagacaggaagaaactagctgaagtcatcgtggctcatgcctgtgttcccagtcattttgagaggccgaggcaagcagatcacttgcaggtcaggagtttgagaccagcctggtcaacatggtgaaagcccatctctactaaaaatacaaaaattatccaggcgtcgtggtgcactcctgtagtcccagctactcaggaggctgagtcaggagaatcgctcgaacctgggaggcagaggttacagtgagccgagattgcaccactacacttcagcctgggtgacagagcaagactctgtctccaaaaagacaaagggaaaca

SEQ ID NO: 547582 - DNA, 1311 bp, Homo sapiens
cccggccaacagccgggggtggctagatgttcgcctcctgcggggatgtaccaccaatgtgtggccgacaaagggggtattatactccctcctctttcccgttttgtcgaccgttctcctcctcgtcagtgatatggaacgttgtgtaaactgccccattgtgtggagagctccctcttttgtgcctctcgtccgccctttttcccggggagctctcgttatcatatacctatgccctggctcttcttgtgtctttcctgcctagagggcctgggcgccgggaagccccctgggggacgccgggaggccaaacatccgggtgtgaaaaaccccgccgtgtggtcctcgaattcgtggtcccaggaccccccgtttctgtgggccccaaatgaggcccccccggtatgtcttatatgagcgccccccccttgttcaaggttcgcaggccgcctccacctctttagcgagtgtatagtctctttctttgggggagaccgtggaaatgagacaattgggccccctggatggccctttctgagctttggagctccggagtgtatacccactgggagatccctatgatgggatgtgtggctgtaagagaggcttccccacacaagggttgaaaggaggacagaatctcttctgactccccattctacaggcacgtgatccttgtagttgggattcacgcacccaccgtataaggggacccggcccttcctctggccctgagtcttctttcgagaggcccacttccgcggcgacccacgagggatcacgcccacgaattgtcccacgcctacgcctcccacgagctctccacgggcacccacgagcaccgccacaccggaggctctgggcgctccctgacttgtgaaaacgtcctgagacctcgtgagtcaccacacactgaccacgctgaggagaaccccagtgcacaactcctgggttttctttaagaattctggcctgaacaccggaaacacccacggttctgctcgtcttcttttgtgtgttataaaatttgccttaatttaaaggtacacttttctttgggttttctaagagacgcccctaagtcaccctgcttcacttagaccggtttccacggttttttcccacaggtgaccctgttagcgcctcacgctggcggtgaacacagccggcccacgcgtggcgccacccacacacccccccacgaagctgtccacggaccacgctccgtccccagcgctcatggtgttgaaactgtctgtcaagcaccccggtgtctgtgtccaccccagtaataaacggtttactgtccga

SEQ ID NO: 547583 - DNA, 130 bp, Homo sapiens
tctatccgcaaggtcctagtaggggcacaactccataggtagctttttctattttcgtcacttagttcatcttcccatgtaccgctgccttacatcaacttcctgcgcccttgcccatatgtcacggttt

SEQ ID NO: 547584 - DNA, 816 bp, Homo sapiens
  misc_feature (194)..(194): n is a, c, g, or t
  misc_feature (445)..(445): n is a, c, g, or t
  misc_feature (524)..(524): n is a, c, g, or t
  misc_feature (534)..(534): n is a, c, g, or t
  misc_feature (580)..(580): n is a, c, g, or t
  misc_feature (582)..(582): n is a, c, g, or t
  misc_feature (587)..(587): n is a, c, g, or t
  misc_feature (592)..(592): n is a, c, g, or t
  misc_feature (599)..(599): n is a, c, g, or t
  misc_feature (633)..(633): n is a, c, g, or t
  misc_feature (635)..(635): n is a, c, g, or t
  misc_feature (645)..(645): n is a, c, g, or t
  misc_feature (653)..(653): n is a, c, g, or t
  misc_feature (660)..(660): n is a, c, g, or t
  misc_feature (672)..(672): n is a, c, g, or t
  misc_feature (767)..(767): n is a, c, g, or t
gtgtatgcaagtgggaggtaactttatgcttggcaaagagtagatgtttcgttaagaaatcagtcaatatatttttttaagatggcttcacaggtagaagagtccagtaatgtccagagaagcagacactggttagcttaacaaatgaatctgatgaggcaaaggtctgtatcaacatgagttcattagtcggnaggaagtgagggtcttctccccaccctgtctacagggagtattttggagattgacttgacactgctgtgcacatcaactgagtctacatcaggaaacaaaggaagtgatattataggctttttcttaacattttaagaaaaaaatatttgtaaaaaagaatttagagtgcttgatgtctaaaactttgtatgtgaaaaaaaaatgtgaaagagcaaatatgctcttgttaagcattaaaaatacatatatngtaaaaataaggtagtatcacacggcatattacaaaattttatgtcatgaagcacatcaaatgactccgggtctctganggtgctaaanatgagacgtatattttcacatttcttttttgccttaaaaatttgcngnaaganatggnttccgantttaataaaacagtataatccagccccgccaacntntctccccttncccccgtngttcttncccttggttgcnttagggccttggcctgtcatgtgcccgggatattattttttaaaggaggtccctgggacagctggtcaccccactgcacaccagaattacttggnagcttcaaaaataatgatgtcccccaccacccgcaagactccactgtaa

SEQ ID NO: 547585 - DNA, 758 bp, Homo sapiens
  misc_feature (194)..(194): n is a, c, g, or t
  misc_feature (466)..(466): n is a, c, g, or t
  misc_feature (476)..(476): n is a, c, g, or t
  misc_feature (522)..(522): n is a, c, g, or t
  misc_feature (524)..(524): n is a, c, g, or t
  misc_feature (529)..(529): n is a, c, g, or t
  misc_feature (534)..(534): n is a, c, g, or t
  misc_feature (541)..(541): n is a, c, g, or t
  misc_feature (575)..(575): n is a, c, g, or t
  misc_feature (577)..(577): n is a, c, g, or t
  misc_feature (587)..(587): n is a, c, g, or t
  misc_feature (595)..(595): n is a, c, g, or t
  misc_feature (602)..(602): n is a, c, g, or t
  misc_feature (614)..(614): n is a, c, g, or t
  misc_feature (709)..(709): n is a, c, g, or t
gtgtatgcaagtgggaggtaactttatgcttggcaaagagtagatgtttcgttaagaaatcagtcaatatatttttttaagatggcttcacaggtagaagagtccagtaatgtccagagaagcagacactggttagcttaacaaatgaatctgatgaggcaaaggtctgtatcaacatgagttcattagtcggnaggaagtgagggtcttctccccaccctgtctacagggagtattttggagattgacttgacactgctgtgcacatcaactgagtctacatcaggaaacaaaggaagtgatattataggctttttcttaacattttaagaaaaaaatatttgtaaaaaagaatttagagtgcttgatgtctaaaactttgtatgtgaaaaaataaggtagtatcacacggcatattacaaaattttatgtcatgaagcacatcaaatgactccgggtctctganggtgctaaanatgagacgtatattttcacatttcttttttgccttaaaaatttgcngnaaganatggnttccgantttaataaaacagtataatccagccccgccaacntntctccccttncccccgtngttcttncccttggttgcnttagggccttggcctgtcatgtgcccgggatattattttttaaaggaggtccctgggacagctggtcaccccactgcacaccagaattacttggnagcttcaaaaataatgatgtcccccaccacccgcaagactccactgtaa

SEQ ID NO: 547586 - DNA, 542 bp, Homo sapiens
  misc_feature (46)..(46): n is a, c, g, or t
  misc_feature (49)..(49): n is a, c, g, or t
  misc_feature (82)..(82): n is a, c, g, or t
  misc_feature (84)..(84): n is a, c, g, or t
  misc_feature (89)..(89): n is a, c, g, or t
  misc_feature (94)..(94): n is a, c, g, or t
  misc_feature (99)..(99): n is a, c, g, or t
  misc_feature (101)..(102): n is a, c, g, or t
  misc_feature (105)..(107): n is a, c, g, or t
  misc_feature (111)..(111): n is a, c, g, or t
  misc_feature (115)..(115): n is a, c, g, or t
  misc_feature (119)..(121): n is a, c, g, or t
  misc_feature (123)..(123): n is a, c, g, or t
  misc_feature (144)..(145): n is a, c, g, or t
  misc_feature (150)..(150): n is a, c, g, or t
  misc_feature (158)..(158): n is a, c, g, or t
  misc_feature (160)..(160): n is a, c, g, or t
  misc_feature (184)..(184): n is a, c, g, or t
  misc_feature (191)..(191): n is a, c, g, or t
  misc_feature (195)..(195): n is a, c, g, or t
  misc_feature (205)..(205): n is a, c, g, or t
  misc_feature (218)..(218): n is a, c, g, or t
  misc_feature (229)..(229): n is a, c, g, or t
  misc_feature (239)..(239): n is a, c, g, or t
  misc_feature (259)..(259): n is a, c, g, or t
  misc_feature (276)..(276): n is a, c, g, or t
  misc_feature (278)..(278): n is a, c, g, or t
  misc_feature (333)..(333): n is a, c, g, or t
tccaggctctctacctaccttgactccccaggttttcttagtccanttntttaaactaccctgtacctgctgataactcctntnaattntaganggganannaannncctnttantatnnncngagtataaaataggaaccccnnatttnacataccncnaacctgagattcctctttcctgcnaatcctnaccntactctgtgnaagctagtttccnagatgtcctcnatgatccccncttcctagtattcacacccntatgtagtcctctcccncnatgagtaaggctgacctgtgtaagcactagtatattgcagaaatgatggtgtacnacttctgaggctgggtcataaaaaagggtacacgtttttttgttgttgttgttgagaccgagtttcactcttgttgccccagctggagtgccgtggcgcgacctcggccccctgccaccccagcctgggcgaccaagtgagactctgtctccagatagaccgatagatagatagatagatagatagatagatagtagagagcctggcca

SEQ ID NO: 547587 - DNA, 246 bp, Homo sapiens
aagcaagggggcagcagcaagtctgtgtgtcagcatctccttaaagaggctcatgtgtgccgggcgcagtggctcacgcctgtaatcccagcactttgggaggctgcggcagaaggatcagttgaacccaggagttcaagaccagcctagccatcatagtgagacaccatctctacaaaaactttcaaaacattcagccaggcatcagtggcaccactcctatggctgcacagcaggagaacgcgg

SEQ ID NO: 547588 - DNA, 941 bp, Homo sapiens
gctaggtcggctggtgtcatcggcgagggacgcccgcgggaaaacgtgtctattagccatggtcaccccaccgtgtcttcgacttgccgtcgactgcgagcccttgggccgcgtctcctttgagctgttcgccgacatggtccccaagacagcagaaaaattttcgtgctctgagcactggcatgaggcaaaccaggatttggttcatgagggttcctgctcttcacagaattattccaggtttatgtgtcagggtggtgactttcacacgccataatggcacatggtggcaattccatctatggcggagaaatttgcaccagatgtagaacttctatcctatacatgcatacgcggtcctggccatcttgtcctatgtgctaaatgctggacccaacacagaatggttcccagtctttcatcctgcactgccaagtactgagtggttggatggcaagcatgtggtgtttggcacacgtgatagagatcgggcatgaagttattgtgcggaggccttggttgcgctttgcgcgtcctggattgcgcgagaccatctacgacatatcaccatttgcttgatctgtggacatactcggaagtcacgtgtgacttgtgttcaatcttaaccaccagatcatgccttctgtagctcatggagagcgcccctccagcccatttgctcgctgtcatactacaatctttctgctctcgctgcagttccctttgcggttccatgtttgccttgttcccctcccattgcctagctgggatcgccgagttaagtctatgattatcgaaactaaaaggtacctaccagatggatgaaatgcaaggcgggcatatccgtcgggccggagacaggattctctaactgggatggcctaagggccgcgaccaggttctttggcaaggggtaaattgccggaccgcaatggatcctg

SEQ ID NO: 547589 - DNA, 184 bp, Homo sapiens
tattacgtacacagggggaggaatggggtgggttttgtatgttctaactgtcatttgatttttacgttgttagcattgggagtaatgtgattcgaggttggagtagcattcaggcgtaggtagacatgtagaggttaacggacggcgtgattggtggcctatgattggtgcggcgactgactca

SEQ ID NO: 547590 - DNA, 147 bp, Homo sapiens
ggacacatgcttttcaacgatgatgtcggcaccttgcgcgacgtttcccgcttctttcagcagcttggcggcacgcaccgccagatcgtcggcctcggccacgcccgccaggccctcgccctgccggcgcacctggccgtcttcacg

SEQ ID NO: 547591 - DNA, 396 bp, Homo sapiens
ggcatattttggtcttatacactgtgttccaccggcaatgaaaagagttcttgtttttcctccagcaatttgtcatttgttaaagagtttagcagttctaagagatatagaccagctgtgctatctttttgtggttttcagttctctagtatgttgagcatctttttgtaagtgtacttgccatctgtagatcttctttggtgaggcgtctgttcagatctgtgtgcatttttaattgggctgtttaacttattgtttagttttaacaattttttatgtattttgaatacaaattctcagatctgtattttgcaaatattttcttcaatatgtggcttgtcttttggttctcttaacaaggtctcttccagagtataaactgtaaatattaagaaa

SEQ ID NO: 547592 - DNA, 956 bp, Homo sapiens
catggtggctcgcgcctgtggtcccagcgctttgggaggctgaggcgggcagatcacggggtcaggagatcaaaaccatcctggctagcgcagtgaaaccctgtctccactaaaaatacaaaaaaaaaaaaaattaagccgggcgtgggtggcgcggatacctggtgggccccagctaatccgggaggctcgaggcaggagaaggggcatgaacccaggaggcgggagctggtagcagagcccagatcgcaccactggcacagtagccggggcaacagagttgagactctggtctcagttaaaaaaaaaaaaaacgacaaacttgggggacgcctttctatcccccatggtgggtgaccatccccttaagaaaggaaatttttcaagaatcttgcaaccccctatcttttattaatatgcgcttaccgaaaaagaatataaagtggccttacaacaatttaattttgtacccaacatgtgggttaaaaaaagtcttttcacaagggaaaccttttaacacactggtgttgacaaacatttggacggggggactcttcaaattcggtggggaacaggatattacgggcgcatatgggcgtcgagaaggaacttaccactgtggtggccacgagcatgtggggggcgttacccacgttgtgagaactcccccccgccacttggggacaggggtcgtaacacgagccacgaaacacactttgaggggccggaggattccgggacacccaaggtggggccaacagtgggggaacaccagacctcctcataaaagaagtgcgagaaactacgccagggtcagcggggcagtgccgtgaaaccaacactacctggggaggcgaggacaaaagaaattgctgcacgggggcgccaaggctggcacgctcagaatggtccagtgaccggtggaataacagacacacgcccagagaagagcaaga

SEQ ID NO: 547593 - DNA, 99 bp, Homo sapiens
cacgccggagggtcgcacgcgggttccagtgtgattgctggagtgtgtatgccaggaggctctccgagatggggtcgggtcactgcctcatccaccgga

SEQ ID NO: 547594 - DNA, 285 bp, Homo sapiens
  misc_feature (37)..(37): n is a, c, g, or t
  misc_feature (65)..(65): n is a, c, g, or t
  misc_feature (81)..(81): n is a, c, g, or t
  misc_feature (83)..(83): n is a, c, g, or t
  misc_feature (98)..(98): n is a, c, g, or t
  misc_feature (143)..(143): n is a, c, g, or t
  misc_feature (168)..(168): n is a, c, g, or t
  misc_feature (170)..(171): n is a, c, g, or t
  misc_feature (200)..(201): n is a, c, g, or t
  misc_feature (265)..(265): n is a, c, g, or t
  misc_feature (268)..(268): n is a, c, g, or t
tccccatggcgctgtggcgcggctccgcgtacgcggncttcctggcgctggccgtgggctgcgtnttcctgctggagccananctgccaggctcggcnctgcgctctctctggagctcgctgtgtctggggcccgcgcctgcncccccgggacccgtctcccccgagngnnggttggtcggcagcttgggacgcgtcttnntctgtgctgccaatccggtgctggcgccgcgtggcagtgggagtcaaatgcatgtgttgatgtngtnctctcaaggggtgaagc

SEQ ID NO: 547595 - DNA, 953 bp, Homo sapiens
attaaaccgtctatatgtcagattgatgagtgtagttatacaagtatatgctatgatacaacagagtgtagtatgattagctgtagatatacttaactcatgatatcgatagggcgatataacgggtctgtccatagacttctcctaggtctcgtagacttcccccactagctgatgcgactagaagtacgtgtctttgtacctgagtgggaccccactagttggaggcagtagtaactactactgtaaccctctctttaggcccttgtagcatacaaccataaatagagcgttcatatgctcacagacattatctagcaaatagagatacaaaaaacattattggatagacacgtgcacattcgtcaactcagtggaatcattgtactaactcagagtaaatagcagtcgttatgtactgtgtacacatgcgaaattatcctccatcacagattcttctcatgagtcgagaagtttcaatgactagatactggtagtaatgtgaaggatgaccggatatctcatcccatcgggctgaatgacgatcataaagcaacaagcagcagagcccgaggaaacacgatggactccaatctggggaaggttcttaggtgagttctgtggtcccgggaacatgtggagtgacgatgtgttcgatctagtgtaccatacggcgtgtaaactggcatggtagttgagggagacgtggcactggggagcctgggtgggccctccttgtcttcatgggatctgcaggatacccctagcccaggggcaccgcgttaacaataaatgcagttgctgcccctaacatttagggaccagcgaggaactgtgcctaaccttgacggttatcacaggggcaactcgaggataaaatcaggagaaaactgtactcgtgctccgggaacacaggcgcggtttaccattccatcgacaaagtaccctactag

SEQ ID NO: 547596 - DNA, 199 bp, Homo sapiens
tcaggctgcaaacagcagcgagtgtattagaattccagcctagggctggttgcggtggctcaggctgtcatcccattactttgggaggccgaatgggagggatggcttgaggcaggagttccagaacagcctgagcaacatagcgagaccctgtctctgttttgtgtgtgtagtggttgggccctcatgccaagggggt

SEQ ID NO: 547597 - DNA, 136 bp, Homo sapiens
ctctgtgatgccaagtgtcactatatcaagcttgtctttattgacagtgcaatgcactagttctgtggtcgttagatctgggagtgatctctagtctaacacttgtttccagagctcagattaggcaggattgttt

SEQ ID NO: 547598 - DNA, 135 bp, Homo sapiens
ccttcccccacatgagtcacattgggcgtgggcactttaatgcttttaaatcaactgccagaactttagtccatctacaaattcagtgaaagagtgtaatcgctcaaatccctcttctccgtgtgacaaagctta

SEQ ID NO: 547599 - DNA, 945 bp, Homo sapiens
cttttgttttcagcctgtacttgtagtgactgctttgggtgggtggtcccgtgtcgggtctagcgggtcgatggctcctgtggcgtttttgcggtccctcgcagttttcctatgaggtactgtcgtcctgcgtttcgctagatactcgtggcgtggtctgtgggctgtaggtacctgtgagaccctgtttagtgcttgtgctctgggtactatcacctcttcttgcggtcaagctttttgcgcagtccctgattccctttgccatgtgccgggacagcatgtggctcatcgccttctgcctgcccacgggtttctggcgattatcatggttaaggccagtcacaccctggccatagtgacaggtttttaattgggtactcttcagaccgatctaagtagaagtcactgctgcatagtatctcatcagattctctaattgctgggcaaatgtaggtttctacaacatattgtttcagtgttcaaataaactgaaggactcaacagtacaatttgagactatatccttcctagtgggttagtgtgaaaatagagtttggctgattcgtcaaatctctgccagccctgcagtaatctccagggcctcgttgtatcgtatcagacattccatggatgattcctggggaaggaagacgttgcgctgctgtagtatcctgagtctggggctgagataatgtttcatgggaagggaacatctgttctttggatgtaatctctcattcggtgagatctgctctgtacatcagactatactctgcacttgctaccaacgttttctatactcagaatatatctgacaaggatggtattgaatctaaaacccaatattagtttttattaaactcatgggaaggctaatatattccgacgtaaattattacatatggttaagttaatcgcatgtaattatattcatcgtaatatgat

SEQ ID NO: 547600 - DNA, 674 bp, Homo sapiens
cgaagtagtaaaggggacaattggtcaggaggaggcaaacagagatttagggtacaaaggcacagagtaaaagagcaaaaaggacaggaaaaaggatatagcagctgacgaaaagtatatatatatatatatagacatatatatatatatacatatatagcgtgagatcgaacagagagtcacctatgcagaaagacagataaatacatatgcatatagatatatacataaggtcgagaagccactatcagccagaggcacaaatcagaagacagagagtagagtacgagaatatgcgaaaacaccaagtagacaagccaatgattgcaaagggaacgcaagagacagatcagacaagagttgcatcatacacgacatgacaaggtagaggtacacatgcaatggaagaaataggggacagaagtaaagccgtgtatagaatcagtcaaagaaatcacagggacagagatacacacgacggagcaacaagagggcagacatatagatcagcaaaaaacaaagaaagagtaaacaaatacgaacagtctctctctgtctctgtctctcgctcgctctcacactctctctctctctctctctctctctctctctctctctctctctctctctctctctctctctctctctctctctctctctctctctctctctct

SEQ ID NO: 547601 - DNA, 375 bp, Homo sapiens
tggtattcagatgcttaaagaaagcattgctgctacaaatatttttatttttaaaaagggtttttatggaccaatgccccagttgtcagtcaaagccgttggggtttttcattgtttaaaaagtcccctgtaaaaggggcattatttaggtttttttttttgcattcccgaaaattgtatgtattgtataaaaaacgtttggcccttgggttatacccctggtatatttaaacttacggggttttttgtaatgtaaacccccattttaatggacggtaattaacagggttataaaagggacaatccttccctcatcccatcccccaactttttttgggggtgataaactgattttggtttgcaataaacccttga

SEQ ID NO: 547602 - DNA, 905 bp, Homo sapiens
gaaaggggtccacaaccgccgtggcagggagaaacatatagggcggtctcaagaaaggtgccggggctccccccgcgactccgcggtgtctcacgtgaagacgttgacgacaacggggggggaggaaaaatcccgggacaaaaaagggccacaacagggcgtaaacacaggggaccccccctgccctcccggacggtgagcgcccgctgcgcctctcgggcaaaggaaggacgccttaattattatagaaatccgttaggcaaaccgtgcttccgcgcgaggggagaaacacgccccgttggagagcagcgacgtctccccacaaaccatggccgggggagggaagcttttgtgggaaggccggtgtgagcagcaaaggaggttttatgttttccccttgagacatccctgtgaaactttgtcactccgtagattgccccgcgtataacatattcctggaacagcgcactcctgtgcaatgtcagtctgtgagcaaaagcagtcttacaaaaggccagacgtgcgcatagacacgccaccctcctgttgtgggaggtaacgagttatttggcagaccccctccccgccccgccccgtcccccaactggtcagacaacgggtatcaatatgactaaagatgtgcacctcttatttatccagggagaagaataaagtcaccccgctcttagtgttggcaacaagcgacaagtagatacataaatagtgaggcattgaaggtgctgcgtggcgacctttacaatagttgcgaaggaagtgacaggtactgatgtcgcctggatgacgccgccgagatctaggatgcttattaccggacttgggcaacaacttttcagagacgacttacacgagtctttgaacaggcattgataaacccgcacaacatg

SEQ ID NO: 547603 - DNA, 749 bp, Homo sapiens
  misc_feature (64)..(64): n is a, c, g, or t
  misc_feature (541)..(541): n is a, c, g, or t
cgacccacgcgtccgatcgcgagtggccgcccttttgtttgttttttggtccgacatcttgacnaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagagactgaagattcgaggcttccctggccagggcagccctttcaggagctccttagtaaaggacttatcaaactggtttcaaagcacagagctcaagtaatttacaccagaaataccaagggtggagatgctcccagctgctggtgaagatgcatgaataggtccaaccagctgtacatttggaaaaataaaactttattaaatcaaaaaaacnaacaaacacgaaaacacactacagaggccataaaaaattagtacgggatatgcagagacaaagcaaggaaacagaagcatgggccaattggaccattagctagaatccttagcccaaagatttctatgtccaacagttgaacaatcatgcggagaccccctattaagagaggcggataaattcaagaaagcaggttaaccttggataa

SEQ ID NO: 547604 - DNA, 1051 bp, Homo sapiens
gagagaactagtctcgagtttttttttatttatttttaaaaggtttcatctttaatgaaatgacttgggaaataccgtacattcccatgacaccaatactacagtttccggagtcacagtaagatacccagaatttacattccggtaacttaatatgaatgtgccaacatgtgttcaagcagtaatttggttacagtggcaaacaaaactcaaataagcaaccattcaaacaaaagagacccatagcttcagacaaggcaaatcccgagggatagcattatgagaacagcgtgcggcttcagcgaagggtttctgggctatacccaatgataagggtctgccaaagatctggtcccaataccagcaccaaaaccagccatctcctactggttggcagcaccttgcaccaataatattgggcagcagttatcaatggtctctggctgattggcgactgggtctggaaactcccttgggattagctggagaacacaccattctgggcgccccattaaatcaccggtagagccctctccatgtcctattagcctcggtgtcgagataccactgattgcagaaatgggtctgtatgcaactcgggatccagttcggatcaaagagggggtgcaggcagagctgtggcgcaggaaaacatcttacactcttcggaactgcgcggctggaaatctggggtgacaggcgacgtgggctcctcatcccggtatccaccatctatcccaggaggcggcggcggccacgggcctgcggcaaaggtcgaagtctggacggagcagtgaaacaccttgcacaacgcgtgaccaggccagtgcgtgtcccgaggctgctaacccaaaacctaggggtgaacccaactgcggatgaacgaacttgacgcgaaataacgtgcaaaaactgtaccctaatccccaagaagatactgacacattgaagagaatgaggcccacgatgtaggacccacaaaacgaaggcgttcccgcgccccccggcaagacaaagggccccacggagaaagctcatgcgcaacaaaccg

SEQ ID NO: 547605 - DNA, 375 bp, Homo sapiens
tagaggatcccgtattgatctggatactatgatgtagcaacttcaacagacagttttgtttcaaagaaacatgttggaagatcaaggcacaggttgcaaggaaagtgtactgcagttttaccgaaagctaatatcgttggctaccatgacagcatcatgaaccctgactataatgtggaatttttccgacagtttatactggttatgaatgctttagataacagagctggccgaaacccagttaatagaatggtggctggcagctgatgttcctcttattgaaagtggaacagctgggtatcttggacaagtaactactatcaaaaagggtgtgaccgagtgttatgagtgtcatcctaagccgacccagagaaa

SEQ ID NO: 547606 - DNA, 412 bp, Homo sapiens
  misc_feature (64)..(64): n is a, c, g, or t
  misc_feature (358)..(358): n is a, c, g, or t
  misc_feature (368)..(368): n is a, c, g, or t
  misc_feature (376)..(376): n is a, c, g, or t
cgacccacgcgtccgatcgcgagtggccgcccttttgtttgttttttggtccgacatcttgacnaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataacttatacccagctgtgtcttctgagagacttaagattcgaggctcctggccaggcagccntcagagctcntagtaagnctatcaactgttcaagccaagctcagtattcaccga

SEQ ID NO: 547607 - DNA, 709 bp, Homo sapiens
  misc_feature (501)..(501): n is a, c, g, or t
tattttaaacctgcgggttcaggtgcaatgacatatcatccgtggcccggttggcttctaccaataacgaatgacaaagcaagcaagcatggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagagactgaagattcgaggcttccctggccagggcagccctttcaggagctccttagtaaaggacttatcaaactggtttcaaagcacagagctcaagtaatttacaccagaaataccaagggtggagatgctcccagctgctggtgaagatgcatgaataggtccaaccagctgtacatttggaaaaataaaactttattaaatcaaaaaaacnaacaaacacgaaaacacactacagaggccataaaaaattagtacgggatatgcagagacaaagcaaggaaacagaagcatgggccaattggaccattagctagaatccttagcccaaagatttctatgtccaacagttgaacaatcatgcggagaccccctattaagagaggcggataaattcaagaaagcaggttaaccttggataa

SEQ ID NO: 547608 - DNA, 326 bp, Homo sapiens
ctacctattgagttggacgagagaaaggatggtgcatgtgaaagatttaagatacgccaccattttagtaacccactcttagtacatcttcagttttcagtatgctgagaacctcacaaaatggaagtggcccagggtttttctagacctttagcagatcctgatctcttgttctctatttgtttggacacccaaaggcttgactactagggtggaaaacactagaatcagcgaatgtatcactgatctgaaaagccctcttgccaccgggaaggggaagaaaggcagggtttggtgtttgcatgagttagtatcgtccaaccaat

SEQ ID NO: 547609 - DNA, 238 bp, Homo sapiens
  misc_feature (104)..(104): n is a, c, g, or t
tttttttttcattgttcttgttcaattttattggcattgcgttcatctctttacagaagaactcagcccacaccctagaatgtagaccttggaaaaggagaggngctcgtaaggcaagctacatgcagggcagatcctaggaggagcagactgcaggtcacaagaagagtatatatgccaattgggaggggaaggaagtcctactagatacacacctgagagcgctctagacagtatc

SEQ ID NO: 547610 - DNA, 626 bp, Homo sapiens
acccggaaattcgcccatttatggccggggcctctttttccgtaatcttcgacgaggctgttgagattgctggggatctattagctttcgaatgccgcctatcgacgacaagtataagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagagactgaagattcgaggcttccctggccagggcagccctttcaggagctccttagtaaaggacttatcaaactggtttcaaagcacagagctcaagtaatttacaccagaaataccaagggtggagatgctcccagctgctggtgaagatgcatgaataggtccaaccagctgtacatttggcgttgtttggacgtcttggaaccagtccaaatatggattcgacacaggtatatagcatgcctcccgcaaattaggggcaactctgtgccatatttagcccttttaaggaggtcctggttacacctc

SEQ ID NO: 547611 - DNA, 326 bp, Homo sapiens
ggctgatctagaggatcccttcatgtccaggcccttcatgcgtctttgcacggttagatgtgcgactgtaaactttgtgacattcttcacatttataagccttctctccagtgtgagttcttatatgttcaagtgagtgtgaagatgtagcaaaggctttcccacagtccttacattcatagggcttctctccagtatggatttttacatggttatgtaagcttgaggaaacagtgaatgctttcccacactccttacatttatagggttttattccagtgtgaattctaaagtgattcttaaggcatgaaggccctcgatatgaa

SEQ ID NO: 547612 - DNA, 506 bp, Homo sapiens
cacgagggatgttggagcgctttcaggactattgtggaaaaggaaatatcttcaaataaaaactaaacagaagcattctgagaaacttgcttgagatgtgttcattcatctcacagaggtgaacatttcttttgattgagctgttggaaacactctttttgtagaatctgcaagtggacatttggagtgctttgtagcctatggtagaaaaggtaacatcttcacataaaatatagacagaagcaatctgagaaattttttgcgatgtgtgcactcagctcagagagataaacctttcttttgattaagcagttttgaaactgtctttttgtaaaatctgcaagtgcacatttggagcgctttcaggcctattttggaaaaggaaatatcttcgcataaaaactagacagaataattctaagaaacttctttgtgatgtgtgggtttcatctcagagagttgaccctttcttttgattgagcagtttggaaacactctttttgtac

SEQ ID NO: 547613 - DNA, 965 bp, Homo sapiens
cggatgtatggcatacgtcgacccacgcgctctgctcttaccctgcgccggctccagctgaccaggaacggggtgggctgaactgaggcgggggcgaggtgagtgcccgacatcttgtccgactcctgcgggtgacacgagccgtgttctctctgtgactggtggcagcgctgcggtgcccgaaccgcgccccaggcctggcatggctgtgcggaatgtgagcctggtgggggtagtgggtgtgcggtggtggtggtgggtgaccctccggctcttgtggggtcccagtccccgcctggctgctgagcgggtggggtggtggaggagctgcagagatgtcctggccagatgcctgactggaccgaatcactgccgcccagcacagtgtcaccggctctgcgcgtatccaagacagtatgcaatggccacgacccacgagatcatggggcccaaggaaacaatgcaccctggactacttaattcagttgcacaaatgagatgacatgttgaacatcccacagttggcagacagtttactttgaaagaactactaatagtagcttgggtggtggtcttcacaatctctcattacaactcatcatttgatggtgtatggccaactgagcgtttcactccagctatttggccttcaagaaaccacgttgtataacttaagcaaattctttggattccacgtggcattgcagaggatatgacatgttctaccatttattagggcggtataggtacgatatttcaaatgagaaaggcaggtttcgtacccgaccgacgttgcgctttgcattgtcacccgacacgctgacacacgagggtgcttgactgggagctcatgcaaacccatggagaccacagcaacaaacctcctagagcaactgtcggccaatattcctcgaactccactgtggtcacctccttgacatgcatggtaatcgcctggacttaca

SEQ ID NO: 547614 - DNA, 595 bp, Homo sapiens
ggacttcatgctcggcgccaaatctgatggtgagaccattctaagaaggcctccagtccatttgccaggagcaggggaatggctggagtcggttgcactaccgtggcaggaccatggcgtatttagcaagctacagcaaaacaatgaacggcgagctatgtccagtttcgagaagtttagccacatggattggtggttgctggaccttcagagttatgatggtgatgcgcaaggcagagaagagatcgacagtattttcgaacaaagtagaggaaagaactgaatagaagtgacgtcatggacagatactggtgcggcgtgaaaccgaattaccagccatagtgcgaggaggagccatcgacagatactggcccaccgccgacgggcgcctggttgaatattgacatagatgaagtggtatatgacgaagattcaccttatcaaaatataaaattctacactcgaagcagtttggaaatattctcatccttagtggggatgtcaattggcagagagtgatttggcatatacccgggccatcatgggcagtggcaaagaagattacactggcaaagatgtactcattctgggaggg

SEQ ID NO: 547615 - DNA, 426 bp, Homo sapiens
  misc_feature (44)..(44): n is a, c, g, or t
  misc_feature (91)..(91): n is a, c, g, or t
  misc_feature (173)..(173): n is a, c, g, or t
aacttaaccaaaaatgtgtaacattgagacttccatttaatccncctgtttaaccaatccctccatctgtccagaactttgcctaagaaanaataaaaatataagccagtccaaagtaccatattttgaaggccaagcactttatatagaagagaatctctatggcttttacncagtctgtatgccttttataattccagcactttgggaggccgaggcagtctgatcacctgaggtccaggagtttcagaaccagcctggctgacatggtgaaaccccatctctgctaaaaatacaggaattagctgggtgtgatggccggcgcctgtaatccaagctacttgggaggctgaagcaggagaatcgcttgagcccaggaggcggaggttgcagtgagccgagattgtgccactgcgctccagcctg

SEQ ID NO: 547616 - DNA, 339 bp, Homo sapiens
  misc_feature (288)..(288): n is a, c, g, or t
cttcatctcccttgaataatacatgcggtccacttcagttaggcctagtttctgggcacagcggcttccttctcagagtctaccagcccgaagccaacaccctggtcttctaggactggggctgctaactccaggatcagctcctccatctcaaatggtcttggtgaggcctggtcatcctcggggggttcagggcagaggagtgccagcacctcatacttctggaacacattctggtagttcttggcatggacatggatcacagggtccacaccatcgtactcaggnaagtccagcccttccggcccctgtacccctgaagggagcccaaagggtacc

SEQ ID NO: 547617 - DNA, 1493 bp, Homo sapiens
tctttgtccgtctctgcgttcctctttttcttgctctttgttttctctctgctttttcttcttttgttttcttcttctttttcttcctctcctttgtgtttcttgtcttctctgttctttttttttcttgttttgcttttgtctctctcttcttctctttgctgttccttctttccttttttgtcttctgtgtcttcttttctttttcttttcctgtcgttgttgctctttctctcttttttctcttggtttttctgtgttgtggttccttttttgtgttgtgtatctcagttgttttcctttgtgttctttgtctgttgccttttttttctttcgttagtgtcgtttgtgtttttttgtttcctttttttgttttcttttgcctttgtctggtttctgttgtgtggtctctctttgttcctttgtgtttttgtgtttgttgtgtatgtttattggtgtgctgttccgcttctcgtttaattgttgtgccgtcgttttctgtctatgtttcttttgtttaggtctcttgtccttgtatttttgtactcccctatctccctctgccatgtgtgccctcttggtggtctttagatgcttttcttggcagtacgggctcgtttttccccgtgtttgctcttcctttggtcctctgtccttttattatgtaatgtgtctacgtgttctgctctttgtttgggttcttctgtcttgtcgtcttcctggctgtctgtgctgcctgctcttggtgttgtgtatctggctatgttccttcattgcttgcctatatcttttcttggactgtgtgtgttgcttgtttgtggattggtcctttgcttgccagacggttttctccacgtgtccctttgttgttgctgggtatccttgtgttgcccttctttcccttgcaccgttattcttgttctgcttttccatatgtggccactcctgcttcctaatgttcatgtggatcttgcatgtaatgcccacatggtgtgatgatgttctaatatatgtggcataagagtcactttcttaaatatattatgaacatcagggtcttttgggacctgcaggtttcggcacttgatgtttgcaagcagtgcgataataacctgaatggatcggtgccccctatgggttctgaccctagtatgtagaatttcctttatctagtatctttttgtgtctgtgtcttccctttctggcttctagcgacatccatgtccaggtgtatggtgcctgggttcctctgttatcaagtcatggagccctgtagggagacccactccttttgtaccaagtacctgaatgctgcgacaatgtcagatgttttgttacaacattttatattagtttttaatgtcagtggcgatctcggttcctggggctgacagccagcctgggactttatgtaagaatttttgggtgactcacattcgatgtcgtttccgtctgccccctcttaaacctctgtatctacggccttacgctgc

SEQ ID NO: 547618 - DNA, 576 bp, Homo sapiens
  misc_feature (537)..(537): n is a, c, g, or t
  misc_feature (559)..(559): n is a, c, g, or t
cattcgatccggtaccctatgcgtgtacaacatttattttcttcctcattctcactaggaataccttcatcttcatctctgtacagggttgttgattgtgtcctgaatgatctgaatccagctggtttcgttcccccttggaggctggcttggacttctaccatctctggatctgtcatccccatgctgatcaggaataaacctttctcctcatgtgccacttctctcgcaatcagcttctttaaagagatcactgttgacttctggtccaatgatgcaaagatgtacttctggtctttttcttgaaggaaaactaaaatgtcagtgagaagaactgcttgaacctctttcaaccttcctgctgcattcttcagaaacacactcccaacacgtacaagcttcttccgtttcaaatcttccttggcaaacatctgaccactcttcatcctcatgattgacttgctatctgtctttgtataaatctcattgagacgcactttcttttcataacttgccactttgctgtctacagctccnatcacatccttcaccaggctcnaggactgtgctagatct

SEQ ID NO: 547619 - DNA, 904 bp, Homo sapiens
tgagaagtgaagttcattttatgtgatctacatgcgtcggtaatctactttggtagataattaagattattaaaccctcatttaaatgtgacataaaatacagctttaagcacataaatataaagcagcttccatcaggaacatggagcaggcagggactccagttttacagaattactgagatttctcagttgtaaaacatgatgtcatcctgcatgcctcctggaattctccaatggggtcgccaaacaacaaatggagaaaagaaagttttacttcctgggcattcattctaccgtttaaactagcaaagtaccactacgcaacacacacgcgtcttgaccccgcgttcccgtctttgtcttacaacttctggcagtttcagagcgtcagcaggctacccctggtttcctaggagagctcggcgctaggcctgaagctccccactcacaccacgtctgctaggcacgcccaggcctggaccgggagacagcccctcacccatgcctgggctcccggccaacgcggaccatggcatgcgctgaacgtcagcaccgcgtgccgctcagaggtgaacctcactccagggccccccagagcgacagcccctacaccccctgaccctccccaaccaaacaaccgccggccacccccaaggccaagactacccgcagccaacctgtgccctcgcccacctgccgcgcactgcctccccgtcactgcgacacgctgcgcacacgccccacacacgtgcccaagggacgggcacaccccccgcacgacgcccacggagagctgcccactaccgcacacacgccgcgcccgcgccctgccaccagcctaccaggggtcacccacgcacgcccaacccgcacacacggcccaccgcagcacggccccacca

SEQ ID NO: 547620 - DNA, 431 bp, Homo sapiens
gagagccaggagattcaggatcagctaagctacataatagggagcacatctctaccaaagaacaacaacaacaacaacgacaaaaagccaggaatgggtgatgatagacacctagtgtcccactactggaagacgataagatatgggagaattgcttgagccacaggggttagaggtgcagtgaactatgaccacgctccagcccagggcaatagagcaagacctatgtctcaaaaaataaaaaataaaaaaaatacctataatagaataaaatgataaagggagaaattttaacatacaggaagcccccaacttaaaatcgtttagacttaaaatattagacttaataacagatatatcaagatgtaaccccatcataaatcgaggagcatactatatatataatctaagtttcaaatggcaatatcgaa

SEQ ID NO: 547621 - DNA, 347 bp, Homo sapiens
gttccttgacaacctgacagaatggagctagaacatgaaaaagcagtacacgcggaaaacacttcagctctttactagataataacataagagaaatgtcaagtcagaaaacatttatgacaagaatcaaaattactctcatcctaaagaaagttctcatatttgactagattatacttcctgcataaagccccatctattagaaaaagtaatacacacagaatgcagaatatgaggtttactttgaactttgcaaatccttgtgaaatgttgtctacaaatttctatgtaaatacatataatggggagacactggaatgaactagatcttttcaattccaaaggga

SEQ ID NO: 547622 - DNA, 355 bp, Homo sapiens
ccacttgggccagtgtctccctttggtccaggttttccaacaaagccattgtcccctttggggccaaatgggccagcttgtccagggatccctgcttgccctgcaggtcctggcaaacctgtagcagcaaaaaaaatgggcaaagacctggccctagacccagaaagggccagcctcctgcagggtcagcccctagcattcctttaggattttgcagagcatgagacttcccccgtcccccccccagggccagtgggggtccaggaaatggggatcaacatcccccttttataaatgaggaaaaagccttccagagttgggggggggttaaagccaagacctgcctgcccttcca

SEQ ID NO: 547623 - DNA, 399 bp, Homo sapiens
cccatgagcacatttttgcaatggtccttatgaacgactgtagtgcacgagacattcagatgtggtagtatgtccctctcgcaccattccttgggacgagttctgggaccactgtctttccgtgggtggtgcccatggatgctctcatgcccttggctgtgtccaacccgaagcatgaccccacgccactgccgtatctgtgccatgacgagccctacacattagacatctacctctctgataacctgggagaaggaatgagccaggcgtttaccatatgcatgtccaattttaagtacatgtactggacgatgctgcagcagctcactcaccactctgtcaacggctgccctgcggccggtggacctactggcttctgggaccatcagcgggcccggc

SEQ ID NO: 547624 - DNA, 112 bp, Homo sapiens
gggtggttcaagtctttgctatagtgaatgtattttagtggagatgggttcactgtgttagcaggatggtctctatctcctgactcgtgatcgccgctcggctggattacag

SEQ ID NO: 547625 - DNA, 538 bp, Homo sapiens
ggtgttgctggcagaaatggtgttctagacgggcggcatttgatctctgtccttgtatgtttatgtactataaggtttaggaaaaacacacatagaaaaactatatccggccaagtgctgtggctcagtcctgtaatctcagcactttgggaagctgaggcaggaggatcacttgggcccaggagtttgagaccagcctgggcaacatagtgagacccccatctctacaaaaaaaacaaaaaaattagtcgggcatggtggcatgcgcgtgtggtcccagctacttgggaggctgcaataggaggatctcttgggcccgggaggttgaggctgcagtgagttatgatcgaaccattgcactttggcctgggtgacagagtgagaccccatcattaaaaaaaaaaagactatggtaaatatcaggggaataagggatggcctttatagtgctgtgactggccaatcatcttaaaattaaggccggacgtgggggctcatacctgtcatccaccattctgggaggccaggcaaacttcag

SEQ ID NO: 547626 - DNA, 141 bp, Homo sapiens
tggcttctacgaccatgtttcctaaagcaccctggcctgagcggtgagtcccaccacctcgaactctgggaattcgagccacagcttctgccatgtaccccctgactcagcactagctctgagtataggccaccggtctgt

SEQ ID NO: 547627 - DNA, 119 bp, Homo sapiens
  misc_feature (88)..(88): n is a, c, g, or t
gaggacttgcagatcacttgcccaagtggctccctagctcctggctcctggcccgggtcctgaaactaaaaaaaaaatagagctcccnctgggtgtgtccgactggaggcagggacctc

SEQ ID NO: 547628 - DNA, 339 bp, Homo sapiens
ccaagataaattatgggtcatgttaaagtaatattacacaaattctatactatacatccattacctctaccaatttggctctgagtcctctttgaagattcagaaaccctaaaaaaacactcatcttcattgctgaaaataacattgtaacaaagtcctaaagcaagctgtgatggtgtaggttgtcaacaagagcttatgaggactgagatgagcaatccactgtaattttatactggtcaagctgttgtcgcttttacaattcatcccttgcatgtgtggaagaagaaagagcagaagataaaatcacttccacctggaccactgctttactttatc

SEQ ID NO: 547629 - DNA, 229 bp, Homo sapiens
cgtgtacactgatcggaggtgtgtacgagtccgacgatcagacgcggaacgtgtcgcgggcacatcctgcagatagacccgatcatcgactccatgaagtcggcgcggaccaagcgcgtactcgacactgctggacaacacgctggcggagaaccgacgcctgacgcactacaagagcttctggaaaaaccttcggccatgggcccgagacgtacgggtacccgacgct

SEQ ID NO: 547630 - DNA, 144 bp, Homo sapiens
cccctcagttcctgcttcttgaaaggactctcgttggggagatagagattcagaaggcaccttgtgaaaaggacctgaacgcacgattcttgagtggagaagaggcccgccgagcataaggtagtggtagacgtgcaggcgagg

SEQ ID NO: 547631 - DNA, 176 bp, Homo sapiens
tcgccccaacaaaattgtaaacgttgttaggttttcgtgtaagactcttgctgtatcgtgacagctgtgattggtgagttgaccgtcctggctgccagttacactgcgattgtaacaacatttttactttctgtacaacaaggaaaagctttgtaaataaaatcttaacattttga

SEQ ID NO: 547632 - DNA, 208 bp, Homo sapiens
aggatatccctccccaactcccgacactcagcagactggtttttaaatttttttctttctggttcattcttacaaggtattttttgacttaagaatgacatttttagaggcatttcagagccaatgatgaaatttgctttagataattattatattattataaaaaaagccatattattttgaattcaaataaatttttatactggta

SEQ ID NO: 547633 - DNA, 259 bp, Homo sapiens
ggaccggtatgagtggcatgtgaacataaagtgagcaggcgaataccatgaggccctactttcaacgtttgaaatgattgaaggaataaaccaacataggtctagctgttcatagtgcctgggattttacttctgtaatggtactaaaatatatactagtatcgtgctgggtatttgggcacctaatcttcctaaatttcttatgtcttgatcagattctggcctggaaatcgatttcacaagtcatacctctcggcgg

SEQ ID NO: 547634 - DNA, 166 bp, Homo sapiens
cggtgaggttgtctagtccacgctcgggagccatgccgtccaagggcccgctgcagtctgtgcaggtcttcggacgcaagaagacagccacagttgggcgcactacaaacgcggcaatggtctcatcaaggtacacgggcgcccctagagatgatgacgccgcaga

SEQ ID NO: 547635 - DNA, 293 bp, Homo sapiens
tctagaggttccaggcaaagctcctacagtatagtatagtgtctcacttctcacaactaactttaaaaagcttaacttacctaaaggatttaatgacaatataaactagaatgacaaacatggagaaatattcttggcatcaggagctagcaccttggagttttccaaaaaagccgtctccccagtgtgttcactgtgactggtggggtaaaagattccacatttaacatacttaaaactacttaaaacttagataaacatcacttctgaagtaatactaccagaaatgttaa

SEQ ID NO: 547636 - DNA, 115 bp, Homo sapiens
tgtatgactagggggacctgggacctcaccatgctagccaggatgtctcgatctcctgacctcagaatccgcccgcctcggcctcccaaatgtgcctggcctgacataatatttt

SEQ ID NO: 547637 - DNA, 160 bp, Homo sapiens
acgtacccacctgtgaaaggaaagttgaactgggggttggtctggcctactgggctgacattaactacaattatgggaaatgcacaagttgttgggcctcgtaccggggtggtcaggtgtggctactgtcggtgtaccagatgctcgacattctgtaatc

SEQ ID NO: 547638 - DNA, 299 bp, Homo sapiens
ccgctcgacccccttgtcatttcgaacatgtaatccggaacagaggcgagtgagagagatcgccatggcggaattggagctgcccctcgcctgatggtttgttaaaagcctaatctgtcgatttgttcgtctgatttgcaacagcatgtggagcctacgcctgatatgccaaactacatggaatggcagagcactgttcaggtcatgtctggtgtgttaggaagtagtttcagtgcaattattttttagtgcagtgaattttatggattacagtggaattaatagctaatggaatttcg

SEQ ID NO: 547639 - DNA, 1458 bp, Homo sapiens
tttgctcccccccctaagggggtgccccacgcccctggtgttgttagctcacctcttcgttcactcacccctccctcgtgttcctgtagtgtgcttcctccccgctgccgtaggtagctaacgtagccgtgcgcttgctagcttagtttgctactcactactctccgccctcccccttgcttctactactgcgggcgcagccatctggtctactgtcgggggcgccccctctgtttgtgttctcttcctctccgtctgtgggggtgggctcctacactattgcacacagaccatggtgtgttgtgcgctagcaacactatgtgtggcggtaggtcccaacctatcctctccttgtggtggtctttttttactacgccgctggttgttttccaacctgtgtgggtgttgctattctctcttctggctcagagggttgccctccctcgcttggggttcctcctccccccccggaggtggttgctcccccgacgagtcgctcctctttttctttggtgtgttccgcgccccgatttttaatactgtcctgctccggggtctcacccgtgtgtcctcctgtgtgtggtagttatgtgtctcaacactcctttgtggtgtggaggcctactaacggtggttggtggcccacccctttcttttggggccccccccacatgtggttgtgttcttttgctcttcttgtgccacagagtggtgttccctcccctgtgttttctctttttgtcccctcaatagaaaagttgtgtgtcgcgcctcctccctcgtcgtcgctccctatccgcggtgggtgaatacacccccgtgggtcccacatttgctgttcgattttgtctccctcgcgcccactaaggagctcgcggggccgctctgggaattctgatgacacacacccccctgcggtttccgtgcgtgggtcaccgatgtgctcttgctccccgccctcgtcgcctgccccccccctccctctcaattattgggtgttctttggtggcgttcttgtgatcgctggtgtctcccccagggtgtttccttccccagctcccctaagtggcggctggcgcctccccgctgtcctcccctgtgtggcgcccccccgtgtggtctgttcaccccgcaggtcttgttttctctcccacaggggcactcacccccctctggtcccttctgtggggaatgtgcaccaccattgtcgagaacatgtttttctgacaatgttgcaaagattccgccctcccttgtttcctcagggacgtcacacaaaaacatagtgtaacgcctccaccaaggagggctctacaaattcttgagggtgcggacaatatttctgcttcccttactacgcgggtgaaaaaacatatgcgccccccccccccccccccttttttttttttaaacccacggcggatttttttgaaaaaaccacccccttgtggtgcccca

SEQ ID NO: 547640 - DNA, 717 bp, Homo sapiens
cccagacgcggtacggcatcatcacgaactgggacgacatggagaagatctggcatcacaccttctacaacgagctgcgcgtggcccccgaggagcatccagtattattgaccgaggctccactgaaccccaaggccaatcgcgagaagatgacccagatcatgttcgagaccttcaactcgccggccatgtacgtggccatccaggccgtgctctccctgtacgcctccggtcgtaccaccggtattgtgctggactccggcgatggtgtctcccacaccgtgcccatctatgagggcttcgccctgccccacgccattctgcgtctggatctggctggtcgcgatctgaccgattacctgatgaagatcctgacggagcgcggctacagcttcaccaccaccgccgagcgtgagatcgtgcgcgacatcaaggagaagctgtgctacgtggctctggacttcgagcaggagatggccaccgctgccgcctccacctcgctggagaagtcgtacgagttgcctgacggccaggtgatcaccattggcaacgagcgcttccgctgccccgaggccctgttccagccctcgttcctgggcatggagtcgtgcggcatccacgagaccgtctacaactcgatcatgaagtgcgacgtggacatccgcaaggatctgttgcgaccgcgcggtacgagctcgatcgatatgccgataatag

SEQ ID NO: 547641 - DNA, 160 bp, Homo sapiens
tgtatcggtgtagtatgtagtagtgtgtgcatagtggtagtagtgtagtagtagtgtgtagtggtagctgtgtagtagtgtgtaatggtgtgtgtgtaatgtgtagcatagtggtgtgtttgtggaggtagcattcctgtctgtggaggtagcactagaa

SEQ ID NO: 547642 - DNA, 139 bp, Homo sapiens
atcagcgcccagatctcccgtaaagtggctctgtgacgtcatttctctggtgcttcagttttctcttcgtgtaaaaaccagttagttagatcagttggtctctgaacttccggcaaactaagaatcactaacgtggatg

SEQ ID NO: 547643 - DNA, 240 bp, Homo sapiens
caaaaagtgtgtctcaaacctgctccatccaaaggaatgttcagctctgtgagttaaactcaatcatcacaaagtattttctgagaatgcttctgtctagtttttctatgaagctattccctttactaccataggcctcaaagcgctccaaatctccacttgcacattccacaacaagagtgtttccaaactgctctatcaataggaatgttcaactctgtgaggggaatgcaatcatca

SEQ ID NO: 547644 - DNA, 857 bp, Homo sapiens
agcggagggtgtggtcaggcggctcggactgagcgggagttgccgtatcccagtcgattgtgctgaagtggactgccgtgtcgcttgtgcttctattcagcgcatgggcttcttcgtgatatcgcaggtgatacgaactggcagaactgcgtgaacctctaggccgaggccatttgagaagcgtggattcgtcaggccgcgtcgaggtcgaagagatgacattcgtgcttgcgcagatagttgccgcacgcgttgtcgccgctccgagaagacagaaggtgactccttgtcgcctgcgtagggaacacgtgcaggaacgaagactgtcagacaggctgccaggagagaaacgcacgcgcaaggtcccagatgagagctgaagggtcctgtgaaggcgagcgtggacgtgacgacaacgaggagccacgcaggaatagcaacgtgccttcagcggaagcgcagatcatgagagatgaacgaagaacgttcgagtgaagacatggcgagcagtgcagaaacgtggagcctacaataagtggagagctaggtagaatgacgaaccgaggaggcgagcaatatggctgcgcaacactgggaacgtttggcgagaggaaggtgtatgcgacattggagatgaacgtgctggttgagaaccgacacgaatccgaagagaaccctgcatgtacgagacgtgaacgctgacgtaactttgttcctgagaacctgagaagtgtcaatagctcgttttgactaacagtgttgagtcatttctaactgtaggctagtttattcgttgttgcaatcttgttctacttcaggtacacttggtgtacatggggttaactgggctattactg

SEQ ID NO: 547645 - DNA, 803 bp, Homo sapiens
gctcaaaataaaaagattattcagactctgaaaaaacaaaaagaagtagcaatatttcaaacaacaaaagccatacaaattatttcagtcttccattagttcatttcagtccatgtaatcaactcctgctctacttcatattcatctttatgaacacatcagcctttcaattagtgccttggaagttttctgtctaatccaatggcacactctccaaagttaccagaaacctgcattcaagagttcttttcatgaactccaaagaagtaagccttggactgtagctgattataagtcactttttttttttggagaaggatcagagcaaaacatcaattatggatgacaaaagtcttaagacagccataaagacacagttgacaaatgtggctatttctgtggcttacaacaatttaacataatcattacaacatattttaagacatatcagaattttagaactctcatacaatcctggaacacattttaacaacaaatctctatcagtataacccaaaggaagctaaaaccacctcacacttgacaatgtttcctgtataattcaaacattacaaataagcctaatataagcctaatattgtcactcttgaacttcaggaagcctaatatccaaaaagttagtttaaggtcaaacagtttcgaacttaactttttttccattagtatggtcatatctttcttactaattgtacgttatgtaatctatcacattttttgtggtctgtttcccaacctctatggtcagataagattccacaggcagaaacaatggctcactgctg

SEQ ID NO: 547646 - DNA, 1184 bp, Homo sapiens
taatgtttggtcgtagggcagatggagctttgtataatacgcctcaaactcattctcaacccccgtgaaaaacaatagcctaccccttcctgggtactatccctagtgaggcataattataacaagctccatcggcctacgacaaacagacctaaaatcgctcatggcatactcttcaatcagccacatagccctcgatagtaacaggccatttctcatccaaaccccctggaagcttacaccgggggcagtcatttctcataaatcgcccaggggcttacatcctacattgactatagctggcgcaagcaaatctcaaatctagagaacgcactccaaagtgcggctatcatagtatactcctcttctccaaagggagctttcaagaatctgtctaatctgcccccactaatataagagcttatttaggagtgagacatgttctatagcgaagcgctctcgggtaagactctgcggctctataacacgcacccccatatatttgtaacacctctaatctgtgtggagagaaacatctctctctgggtggctaaaagtaaccaccaaggtgactcctctgggagtccaatattatgcacatgtctccctaaaatgtaacagcggagcctcaaaactatactcagtagcaccagggcccctaaaggacttccctcctaaacattatttgacccagcaaacgaacaaatgggggggcatacacgttacagcccccagcccaagaagtatagacgagagatttataaaagcgcgctcaagtttcacacgcgacgtagaaaacagccgctccaagtggtttcaataccagccagtattcaccgccatttgtctcgtccaaataatacccttaagaccgcggaaattcaataaccggggggggttgccccctcctgttaaacaagaaaaaaacaaaaaaagaagaaaaaccacaacaaggacgcacagaacaaagaaaaagagagaaaaacaagagaccacaacaaccaaaaccaagcacacagaaggcgagaacaaacaaatagggtcagcgcgacaaaacaggaggaaaacaagcaagaaagcaagcagaaaaatagcgacaagagagacggatagtaaaacaagggagaaaaacagggaacgcaccaaaagaaggaggaaaaaaataaaaaacgagggcacctatc

SEQ ID NO: 547647 - DNA, 564 bp, Homo sapiens
tcggggagtgctgctgtggaaggataactgggtgagcttcatggacaccatgctgcagatgtccatcctgggctcgcgcaagcacgggctgtacctgcccacccgtgtcaccgccatccacatcgaccctgccaaccacaggcagaagctgtacacactgcaggacaaggcccaagtggctgaccgtggtggtgagcaggtggctgaggagtcacagctggccggaggcgtccacatctccgggctccacactgagtcggcccgcaggggcagcagggagcatgcaggtgcccatcctggagaagttttgcttcactccccacacggaggaggggtgcctgtctgagcgcgctgccctgcaggaggagctgcaactgtgcaaggggcctggtgcaggcacttgcagaccacaggtgacccacgcaggggctgaagaatggctggtgcaccggactggatgtgtgcccagatcccccgggaaccctcacagaaggaactgccccggacctgtgtcggctgcctgacaggcttcagctcaactgggaacctgacagccatggagct

SEQ ID NO: 547648 - DNA, 176 bp, Homo sapiens
gtactagcttgtgaccggtgttccagtcatgtgagctggtctccatatcatcgtgcaagcgaaccacactgactgtgtagtcagaacccggtctgaggccttcgaggctctgaggtgtctctcttcaccgatcaggtgccggggaatacgctcactggattccatcctacagggct

SEQ ID NO: 547649 - DNA, 948 bp, Homo sapiens
agcgggtgcgtctcgtgccggcggcgtccgccgcgtgacaggacgggctcctggcatgtcgctccggctacgacgtcattcggggtcccctccccccgggatgcttgcggaagcgatacagtcgcgcgacagtacgtgacaaacatgtcaggtgctcggtgacctgtgccccggggggacgcggtggacgaccggagcgaacgccacgctgcttggatttcccaatgttatgaagctggtaagcacgcgtacgaccgctgagagagctccatggagacttatggtacacctggaagtacagtgattccaggaatgccgtcacgagtgtgattccccctggaagcttacttcctaggaacataccgagaaaggagcttaatattacgtggcaacctggccaagtacttgtaaagaaccttggatctaccgatatacaaacctcgacgacagctaggtgacggacgcgtgttgccaatcctccgcacatgataccacgcttgaaggagcaccaaggataccccccgtttccacactctatgcaggcacccaactcgttagcgacattgaggcagtatgggcggtagacgcccgcccgttttaaaccaacccacggaacgaagtttacacgagctatctccccggtcatatatatatagcgtcgagccaaggaaaggggagggctgtgtcaaacccaggcccgttcaagtcgcaaccaaggaccaatagtggtgcttttggcgaacatcttccttcgccgtcatctttgtcgattagatctcccacaccctcccttctgttatctatagagccaccatatccccatcaccaaggttgggatagcgggcaagtttgactagaaaggggttgattgtacagaccgttctactagtaggtttcccaaggcagatcgtattgcaaggttaacctcataggacatattcttcaact

SEQ ID NO: 547650 - DNA, 481 bp, Homo sapiens
ataccggcttactcttagcctcagtaatggcagacgccccaccccccatcaagctccaatgtacccaggtcaactacagactgtagtagctaggcagcgagaatatcaagtcagtggatacttagctatgactatggctctataggggttggaatctgcttaacaagaccacttggctacctggcttcagccccctttccaggggagtgagtggttctgtctcacttgcgttccaggcaccacacaattcgaaatgtagaaattacctgccttctgcgttggtctccctgggcgctgcagactggggctgttcctacttcagaccatcttgcagggaatcacaataaagaatttttaaaaggaagagaaaagcaatcatcactattttggtttagtatagttttaggagtaactgactactgaacagtactgcatgtttctgaggttcctctgtatatctcctgtagttcactacctctgc

SEQ ID NO: 547651 - DNA, 605 bp, Homo sapiens
  misc_feature (476)..(476): n is a, c, g, or t
acgacaactactcaactctgactgcagattgcctcttcaaagttgtatttcggagtaccttttatacctgccttgctctcgatacacacaatctatatatccttgcaacgctcaccacaattgagatgcttatggccacgatacttatcatcacagacagcattgaacacgcatcctaagcggtcctactgagcatcgtaagggtgaccaacatataggactacctacatgttcaccatacgcagttctaccaatgattactcatcagagataatcattacatcccttgtgagagccttagccatatgtcctcctgctgtcaatgacaacaaactgtcaccagctactcattctggccaccggcatagtcctccggatcctctacatgctggccgctatgtacttctatgccatatatctgactgagtagcgttagcccttagccactgtcttatcctgtccatcatagccgcggntaggttgtcataaatatacctagcttctcaatcctaccataagaattgtaatttaggattcaaagttaactgactactccgcgattctaattcccacccttttttggcaaccacgctaatctttttttc

SEQ ID NO: 547652 - DNA, 899 bp, Homo sapiens
gcggattgtgcgtggtcgatttggtcgcgggttcacgttttgcttccccggatgtcgtgctggtgcgccgtcaccccgcccctctggttgtggcaggacccgattgtgtgcccccccctcgggggtgttttgcattgtccccggttgtggtgttgcccagttcccctgggcgcacgaattggggtgcataagccccacacccctttgggggcccgcacacgtccttagtcgtgccaagatgttgtacgttggtcttttgccgggaccgcgtccccctgccccgtttttcaacactgcgagcgcttttctaatggggaccctctgggcctcgcctcccggcccagcttcttggggagagatccgcttataacgagctcggttctttgagactgggtcaaggcctcgtccggggccctgtgcaatgcctgcgggccccttctcgcccgcgtttggtatgtcgggggccccctcccccccgcggggtgccgcaatcgtacgtctacgactctccacactcccccgtgtctaagcaaggacgcgcgcacgtcgttcgggggaagatcttgttattacctttatagaagattattataaaaacctcctttcaccaacatccttttaaaaattcaccactttggacatctatctccattccagtccaagctccagctatatatataaatggtgtttggcacccctgttatgccatgagcccacaaccccaaaacttcttataaaacctggggcaagagatgtacacatgcctaatattaatttgctcagcgttaaatgtcatcactcttccaatggcacacaaacaagactccctcggcactacacacaaatggccctaaaaagtatttctaacctttataaacatttaaatttcccaacataac

SEQ ID NO: 547653 - DNA, 312 bp, Homo sapiens
  misc_feature (24)..(24): n is a, c, g, or t
  misc_feature (38)..(38): n is a, c, g, or t
  misc_feature (70)..(70): n is a, c, g, or t
  misc_feature (263)..(263): n is a, c, g, or t
accaaggtttgtcctccttataangaattattcattgntgggcacagtggttaacatctgtaatcccaancaatttgggagccaaggcaggaggatcacttgagcccaggagctcaagaccagccacagcaacatgacgattccctctctctacaaaaaatacaaaaaattagctggatgtggtggcacataccatatccaggaggctgaggcagaaggagaaccaaagcctgggaggttgatgctgcagtgagctgtgattngcccctgcactccagcctgggtaattgagtgagggcctttgttaaaaaa

SEQ ID NO: 547654 - DNA, 782 bp, Homo sapiens
  misc_feature (278)..(278): n is a, c, g, or t
gaaaacaaaaacaatcggccgcgccgtcgcaggcacccgaacgtcgcgagcggggcctggggacgcggggccgagtgcagcgagcgaacgggagcagcggcgactcgccagtggggctagggcgccatggtggcatggctggggctcctgtgctgcgctgtggtgctccccctgtgctgcctgcggctagtgcgccctgcctgcctctgtgcctgcctcatgcctccctgctgcctgccctgctttggtgtgaactgatgggagcagtgacgctggcnctcggctggtggccctgtggcctgaactggcttgcgggacaccttgggcggcctgagtgatgccgagctgccgccgcctccgtgcatggatcagtgcgtgacggtggagctgcgagctggagaagtgtgctgcacaagttctcgggctactggggcagctgtgcgagcgcggcctggaggagctcatcgactacaccggctggtctcaagcacgagatcctgcaagagccacggccaagatgctgaattatcagggacactttcacttgttttgacacagtgcttgtaacagaatcaaggatactgttcaaaaattgggctccgaccacaaagacattccacagcagttgtttctcgggttggacaagccatttgatacggattcacttttacgagacttggaactcttcccttttggattgcttcttccatcagagatgccatttatcccttgcgtggaaagctgctccaattggcagaagcggtggccctggatgacgtagg

SEQ ID NO: 547655 - DNA, 196 bp, Homo sapiens
  misc_feature (40)..(41): n is a, c, g, or t
tttacatcggggtgtctaccaggcaagatagtgttacagnncaaccagctggcagcctgactcaagccaagaatgcccaaggtgcagcctgccaaggtagtaactatccagctgcaggtgcagcagccacagcaaaaaaatccagattgtaccacaaccaccatcatcgcagccacagccccagcagccaccctcc

SEQ ID NO: 547656 - DNA, 201 bp, Homo sapiens
  misc_feature (153)..(153): n is a, c, g, or t
accatagaggatcccgagactctatcttctctctgcagtacaccggattgtccgcaccgggcgttcgggaaacacaggcatcgacattacttcatcaacaaagcgtgtgatgagtcagtgctgatggaccctcaaagcgctgttgtagaaacnccagagcagaaggtcgacgcgggtaccgaggctccgaatttcggtaat

SEQ ID NO: 547657 - DNA, 515 bp, Homo sapiens
  misc_feature (388)..(388): n is a, c, g, or t
acacgcttttaggagatccagaggtagaactgcaggtttgatgacgctggagcccttgttcttccctgctctgccttgactgagtttccttgtcaggcagaaaacaaatgccccaagagcagaggccagggaagccaaaaccactcatcttaccactctcagaaatttacaggatattggtgggggacatgattttagtgaccaattgcaagtctgtggtgtgggcacatggagaaactttctctttagggcatgcacactgatgactgttcctgggaccccaaagcatgtgaacaccagggcagctctgtgccctcatttccatgaaggaggcaagtattagcagaaagagagagcaacctacttgtccacatgccagccactccancatctcctagcagacctacatccatccacagcctgctatgcaaccttcaaatccccgtcctccaggcagtcttcccagaggggctataaaggagatattcagtttcctttcccatcctacaaaaacc

SEQ ID NO: 547658 - DNA, 1035 bp, Homo sapiens
  misc_feature (161)..(161): n is a, c, g, or t
ctcgtcgagaggtcacgccggcaagtcggcatcgggcgggattggaatccgagtctgcttttgcccccaagagacccagaatcctggcagctcggtttcagaagctgttgtcccttcgccggctcccgtcggggcctccacgtgcagcgcgagcgtgcccnatagctctgtatacagtcccatggtttcccattgtcctacgcggaaccccggcatgatggccctacgcaaggcgtctggtgcccgtttgaggaccttgttgtgggcgaggcgcctggatggggaaacgggcacaaggtcgagctttcctagcatagccgggtgcaccgaaagatttagcggagagcagcaagcggtgctgtaacgcgagggccaccattggagcttcactcgtagccgtgggcccgtgcgcagagagatgccgggaggtatggggtgtcgaccgcgaggaccgttggtctcgtgtaacagagcacaggattggctctaaactatcgttgcacccaagaggtagcgtctttcgcggcgcgtctgcaagcaagtcaatcgctagcggcaagtcttcggtccatttacccgtcgggcagtcgaggaagtgttgggattaggctgtccgtggagcagatggggggaaacccgaagggtagttcgatgggccccaagaccaagggagcaccggatgttccatgcgttggagttccagaatctatctggcgacgctaaaaagcttaccccctattgcctccaatgttaggttgctgcctgggaaagctgtgtgcgttccccatccggaattccattgacacgggtgcaattgcccgtttgcgcaaggttggcgccccggggaaccatgaccctcaggggagacccttgtgagaagactgcgccagaatggtttgggcgcccttggcggggcatctattggaaggcactggaccttaattgtggccaagggttcagcgcaattctaatccaagggtttccctttttgggccaagaagaacttcacaaagggtggcaggcatgattcccccg

SEQ ID NO: 547659 - DNA, 105 bp, Homo sapiens
ggggctggagcaacgataatgtggcgcacagggaggggtggatgctgtcaccatccagccttctctttattttcagtgctttttgtattgtggccccgagcagag

SEQ ID NO: 547660 - DNA, 155 bp, Homo sapiens
  misc_feature (7)..(7): n is a, c, g, or t
  misc_feature (15)..(15): n is a, c, g, or t
  misc_feature (17)..(18): n is a, c, g, or t
  misc_feature (37)..(37): n is a, c, g, or t
  misc_feature (54)..(54): n is a, c, g, or t
  misc_feature (69)..(69): n is a, c, g, or t
  misc_feature (103)..(103): n is a, c, g, or t
  misc_feature (113)..(113): n is a, c, g, or t
  misc_feature (129)..(129): n is a, c, g, or t
  misc_feature (131)..(131): n is a, c, g, or t
acttgtnagcctcanannatttaaggaaaggggacangtaaaattatcctcttngtaatttaatgaaanggtacaacagatataatgcatgatgaactcaccnaattatgagntgggaggagcgaaatntnaatttcttttgctatagttataca

SEQ ID NO: 547661 - DNA, 693 bp, Homo sapiens
  misc_feature (22)..(22): n is a, c, g, or t
  misc_feature (24)..(25): n is a, c, g, or t
  misc_feature (57)..(57): n is a, c, g, or t
  misc_feature (91)..(91): n is a, c, g, or t
  misc_feature (109)..(109): n is a, c, g, or t
  misc_feature (291)..(291): n is a, c, g, or t
  misc_feature (351)..(351): n is a, c, g, or t
  misc_feature (353)..(353): n is a, c, g, or t
  misc_feature (364)..(364): n is a, c, g, or t
  misc_feature (435)..(435): n is a, c, g, or t
  misc_feature (463)..(463): n is a, c, g, or t
  misc_feature (496)..(496): n is a, c, g, or t
  misc_feature (501)..(501): n is a, c, g, or t
  misc_feature (504)..(504): n is a, c, g, or t
  misc_feature (544)..(544): n is a, c, g, or t
  misc_feature (554)..(554): n is a, c, g, or t
  misc_feature (586)..(586): n is a, c, g, or t
  misc_feature (591)..(591): n is a, c, g, or t
  misc_feature (594)..(594): n is a, c, g, or t
  misc_feature (597)..(597): n is a, c, g, or t
  misc_feature (600)..(600): n is a, c, g, or t
  misc_feature (608)..(608): n is a, c, g, or t
ctgtggtcgtctatctccctgngnngcttcccatcggcgaagatggccctggagacngtgccgaaggacctgcggcatctgcgggcctgtntgctgtgttcgctggtcnagactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcacgtaactttaagccagngtgtatatgcggtgtcagtcactggtcgcctgccccaaggaatcgtgcgggacgctgaanangtcgaggagtngcctacaaatccagagacgcagctatagacgacctagccacgatgcaaaggctgccagcatctttgctctncacctcctgcctctgcttatttcttgtnctggaactcaatgaacagaacttcaaatacttnctacnctncaattcagactcagctgactgttgagagagcagcacatcnttttatcatnttatcttctttggactacaggtggggtggganggatntgngtnggnggataacnagatggcaacttgatggagagagtaggatgctgatttcctacccgtggcccacgtctgtgccttccccatgccaaggcactctag

SEQ ID NO: 547662 - DNA, 675 bp, Homo sapiens
  misc_feature (22)..(22): n is a, c, g, or t
  misc_feature (24)..(25): n is a, c, g, or t
  misc_feature (57)..(57): n is a, c, g, or t
  misc_feature (91)..(91): n is a, c, g, or t
  misc_feature (109)..(109): n is a, c, g, or t
  misc_feature (291)..(291): n is a, c, g, or t
  misc_feature (378)..(378): n is a, c, g, or t
  misc_feature (406)..(406): n is a, c, g, or t
  misc_feature (439)..(439): n is a, c, g, or t
  misc_feature (444)..(444): n is a, c, g, or t
  misc_feature (447)..(447): n is a, c, g, or t
  misc_feature (487)..(487): n is a, c, g, or t
  misc_feature (497)..(497): n is a, c, g, or t
  misc_feature (529)..(529): n is a, c, g, or t
  misc_feature (534)..(534): n is a, c, g, or t
  misc_feature (537)..(537): n is a, c, g, or t
  misc_feature (540)..(540): n is a, c, g, or t
  misc_feature (543)..(543): n is a, c, g, or t
  misc_feature (551)..(551): n is a, c, g, or t
ctgtggtcgtctatctccctgngnngcttcccatcggcgaagatggccctggagacngtgccgaaggacctgcggcatctgcgggcctgtntgctgtgttcgctggtcnagactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcacgtaactttaagccagngtgtatatgcggtgtcagtcactggtcgcctgccccaaggaatcgtgcgggacgctggatgcaaaggctgccagcatctttgctctncacctcctgcctctgcttatttcttgtnctggaactcaatgaacagaacttcaaatacttnctacnctncaattcagactcagctgactgttgagagagcagcacatcnttttatcatnttatcttctttggactacaggtggggtggganggatntgngtnggnggataacnagatgtattgcgagaaattggatgcttatttcatagcccgggaacaaatttgtgctttcccatgccaagagtctagggcaaatggtccctcatttgaacatttgaaagtttttaaagcccttag

SEQ ID NO: 547663 - DNA, 255 bp, Homo sapiens
tcgacccagcttaatgtcacataccctctgaggtcttccccactactccatttttttacttttattgaggtagagtctgactctgttgcccaggttgaagcgcagtggcatgatctcagctcactgcagccttgacctcccgggctcatgcaattctccccacctcaacctcctaagtagctgggactacaggcgcacaccaccacacccatctaatttttgtattttctgtacagatggggtctccctatgttg

SEQ ID NO: 547664 - DNA, 1100 bp, Homo sapiens
ggctccccgcggtgagtctaatgtgacctttactgtgatgctgtgagaagtgtggttctgagtcctttttcttttcctgtagcacagtctggtgtgcctagtgtgtttgggctggggagtccttggtgtggcgctgaatgatgtgagtggatgtggcttgtggacctgcactcattccctcttgtcccatacttggagttttggtggagccactttccctgtccctccactgtggagctgcgttcctgtgagggaggaggccctactgtggtggcgaggacatacgactaaacagattctggacggagtttggacgacacgagtgtattcatgcccccaaatcacgacgatcaacaaacgaaattgcacaacttttgacggaacgagttaaccttgtcccatattgttatagtattttttgaacgatcctcgttgtacttgccatgctctcatacatttgtgtaaaaatatgtattggacaaacatttcttcagtgcatctggtaacttttatatatggagacctttacgaattacactcaagttgcctaattgcagaagtatcactgaaattgctccaacttggcattgcatctttaccgtgttcattttgactcaaaggcgtatattgaacagtaccagcaagacagacatccagatcattggtcacctttgccctggaacaatttctgggcaaccctttaaatggctcaccggtgcacttagactaaacacactaaatggtgggcaatggctgtccataagtccacccacatgggtactccatataatagcactcaaacggcatattggcgaaacagcacacccctacacattgctggcactcgttggagacacaagtctaagaatattcaacatatttcaaacgtagcaaacaaaactatttctacaaattcatgatcgaaacgactcacacaataacggcgtacattatcaaaacaaacagtatcaactattttgacactcaaaatcattcacaaagaattacaccttgatagaacaccactaccacatactaaacatcctactctcccaacttatcccacctcttcctatatatgattacaacaacacacatcc

SEQ ID NO: 547665 - DNA, 129 bp, Homo sapiens
tcagaggatcccgtactcgacatcgtgactcgaatcgcagttacattcaagaataattttaagactataaacatgccattctctttcagctgctcatgttcttaaaattattcttgaatgtactgcgat

SEQ ID NO: 547666 - DNA, 459 bp, Homo sapiens
ttgaagcacactgtgaactacaaacatattttcattcatcatggcagatgctctttgagacttgcattgtgaggacagaagttcaattaatgtgtttcccatttgttcttctgacagatagaggccaaatgacacaatgggaagatcttcaactaagtgtcaagaaaaaaaactagtgttctagtgttctagagtcctctttgccacttaaaatagccttgtgactataagtgtgtcatccatcatcttggaggttcagaaatggaaaggaaagacattttgtaagtggcatagcataaatgtcgatagaatcctggctttgtcactccaacttaggtgaccactaaaccatctgtttccattttctctttcacttatttaatatacatttagtggttagcataaactgacactgtattaaataagtaaaaaatgaaataaatggttgttgtctagaga

SEQ ID NO: 547667 - DNA, 181 bp, Homo sapiens
acattcctgggctcagatgatgctccccctcagacttcctgagatagctgtgactgcggggatatgtcactacacttgtgacaatattcgtattgttatgttgagacgggatcttgccatgtagctcaagctggaactcaaactcctagactcaagcattcccagctgccttggcgtcccc

SEQ ID NO: 547668 - DNA, 603 bp, Homo sapiens
  misc_feature (467)..(467): n is a, c, g, or t
gatgaagcatatccaggcaagaagctgttgccggatgagccctatgagagagcttgtcagaagatgatcttagagttgttaactaaggtgccatccttggtgaggaagcttgattaggaagccacagataaagaagactatgctggcctactgaagtaatactcggtaaaagagagtttaccaagcgtagaggaggttctgactgataagaagacgaactgctttggttgtgcagattctatctctcatgattgatatacctctagtctggtccctggctttgaagcaggctgtgtaggcggactgacagttaaagttgaggtgtgtagactcatagtcctaatagtgaaagctggtggtatgggacagccatgtagatggaagagtccccacaggtcttcagcccctgcgttactgacgtcgaggaataagactaggccagggtttccataggaagctcgtacttntacagatcgagcccttgaagagcctgttgacttatgaggagctctgaaaagtggggccagggagtcaagcaattaaatgctgatcgtctatgatatctttcgcttcagcttaaataaattctaaaatcaacaaggg

SEQ ID NO: 547669 - DNA, 571 bp, Homo sapiens
cgatgtcggggtggaaagcttcctgtgattagctgggagtcaatatttttattttaggctatgtaggctgtatggacttgatagcccctgcacagctttgccatgtggtgtgaaagtagccacagacgaaatgagtggtgtggctgtgtggcaatatgtttatttactaaagcaggtggtgggccaggtttggtccttgggccatcgtgtgctgacccctggaataaaataactagagtaggcttcactgaaaaacttgaagaggagttgactgcttatgaaaacatttatttttgtatttatgtaaataagaaaagtttatcatgctttagccatgtttttagggtttgtttgcttgttaatttagttttgttttgctataaaatctagtatttcttgaaccaatgccactcccatagcttcagatcatcatctatatgcagataactccctaatgtgtatctctagctctgtcctttctccctaactccagactgctgtgtcgagctgcctaccacccgacaggcctagttggattatacccacatctcaatcttcactgaatgtttga

SEQ ID NO: 547670 - DNA, 129 bp, Homo sapiens
atgactctgacactttctttaccaaggaattagattattaggaaaataaaaataaatgcagtcaggaagttcttgcttgtgttacttgttttctaattttaaatcttattcttttaaagtgataataaa

SEQ ID NO: 547671 - DNA, 375 bp, Homo sapiens
ctagcctgggcacagcagtgagaccatgtctcaaagtaaaataagacaaagaaaagaaaatattctggaatatatcatggtggtggttgcacaacttggtgaatgactaaaagccactgcatttactactttaaaatggcgacttttcagccaggcgcggtgtctcgtgcctgtaatcctagcactttgggaggttgaggcggaaagattgcctgtgttcaagagttgaagaccagcctgggcaatatggtgaaatttcatctctactataatacaaaacattggccaggcatggcagcctacatctatagacccagctactcagcaggctgaggcagaattgcttaaaccagggaggtggaggttgcagcgagc

SEQ ID NO: 547672 - DNA, 645 bp, Homo sapiens
agtggttcaatttagaaagggtttcaggccaggcacggtgactcaggcctgtaatcccagcactttgggaggccgagacaggcagatcacttgagaccagtagtttgagaatcagcctggccaacgtggtgaaacctcatctctactaaaaatacaaaatttagctgggtgtggttgcgcgtgcctttagtcccagctactcgggaggctgaggcaggagaatcgcttgaacccaggaggtggaagttggcagtgagccaagatcacgccactgtactccagcctggccgacagagcgagactctgtctcaaaaaaagaaaggttttctaaactaatggttaaaacagaattttcttgtaaatagggaagttggagcattctggttaattgagattttgctctgtattgacacagctcgcaccagtttggttcaggagctacctccttgtcattgaattgacgagttacaatgtttggtattcggatacattcagcaagaacacttgaaaactcctcaccaactatttttaaaggcttactttgtttttgtttttattttttcactggctattttggataagaggatgtttacatcttaatgtaaaaaaatgaaaacaggtataaatgttttatgtaaaaaaaaa

SEQ ID NO: 547673 - DNA, 259 bp, Homo sapiens
aaggtaactccggtgagaagggcgaccccgctgaaggtgaaaagagcaggtcactgacctgccacctgtcttcctctctcccaggtttctcttaaggttctgcagggcaaggctgtctgggacaggctttgcatggcatccgctctcagagctgcaggcatgcatctgcaccttggcatgcacacacagacgcaggctctgcacaccagactgcacagactgtgcgctgcgcatacgcatgcagcaaagcaaactgtgt

SEQ ID NO: 547674 - DNA, 654 bp, Homo sapiens
ggactttgggtcctgcatgacagaacagctgtattagactaatcttcccatagaaaacagctctctctctcctctccatatatatacacatatatatatatatgtgtatatatatacacatatatatgtgtgtatatatgtgtgtgtatatgcatatgtgtgtgtgtatatatatgtgtgtatatatatatacacacacacacacatacatgtttttttggaaagggattcgttcttgtgcccaggctggattgcagtggcaaaatctttagttcaccgcaacctccgcctcccaggtttgagcaattcttctctctcagccaatccagattagctggggatacaggcatgcgccaccaggcccagcaaactaggtatttcgcaactacaatatggtgattcctccatgtatggatcaggttgaagaatcatatcccccgacccaagtgtaatccccctgcatgcggtactactaaagtgcacggccagtacacaggcagttgagcatacgaacacccaggagaacattacctgatatagacacagctacgcaagatttataaaaaccatgttccatagccactggagaagatatacaccgatcgaggagaaaatcaccgaggataagcaagccttgccttgttaactaaacag

SEQ ID NO: 547675 - DNA, 899 bp, Homo sapiens
ccagccgagaggtgggaattcatgcactcccagctgaaaggtctctcaagcagcatgcagtgccctgtggctcgaggcagcagaccccggatccctcaagtccgagccggggcttccctggttgcatccagcctggtagtcctccacttcgagccagcttcactgacctcgttactatgaccccttggagcagctggactcagaagctgcagagcaaggtggagttcctgctcctggagggggccacggtgccggccctcaggctgatcaccaccatccacgaggatgaggtggccaagacccagaaggcgtgagggaggtggccgccgtgcaggctctgggtcccctgtctggcaccccaaagtccatgaccgtccctatccccacgtgcctctctctccgtccccgctcgccccagcgtgttcccctctcatggttgacccccgtccgtggtgggtgatggccgttcctcacttcctgtggcagtcgaagacccgggtagctgaggtgccccgcttggttgacctagagttgtggaaccacggcgccacggagggatcccggcttggggcagcgcaggaccggagggaaatgcagcggggccaggcgtgagaactagggccaggggggtgccctgaaaagagggcgtgtgtccaaaggcgccggaatcggacgcacgtccgtggcgcgaacgacacgcggtgtagacagaggcatcggagcagccccggggtcctcacacaggccgcgccttagagcaggaccacaccgacaatggtgcaaccccgagcaccaagggcccggactacttcgcccgacacaacagggccaataccacacacggaacaccccggccttgagcggccaaccaccacaaatacccggggcacacacaaacc

SEQ ID NO: 547676 - DNA, 488 bp, Homo sapiens
ggctttcctgaagcttaggctttatccccctctgctggctaaaagaagtaggaatcacgcactgggtgagaccccgtctggcttattctcatctattttcattcttttggaaagtggacccaaagcatagagttaaaagagcctttttttttttttttttttttttttttttttcccctcactgtggtgataaaaaccacagtgcaggggctgggcgtggtggctcacgcctgtaatcccaccactttgggaggccaaggcaggcggatcacctgaggtggggagttcgagaccagcctgatcaacatggagaaaacctgtctctcctaaaaatacaaaattaaccgagcatgttggcgcatgcctgtagtctcagctacttggaaggctgaggcaggagaattgcttcaaactgggcagaggttgcagtgagccaaggttgacccactgcactccagcctgggcaccaagagcaaaactccatctca

SEQ ID NO: 547677 - DNA, 1386 bp, Homo sapiens
  misc_feature (426)..(426): n is a, c, g, or t
  misc_feature (1186)..(1186): n is a, c, g, or t
  misc_feature (1213)..(1213): n is a, c, g, or t
  misc_feature (1275)..(1275): n is a, c, g, or t
  misc_feature (1290)..(1290): n is a, c, g, or t
  misc_feature (1350)..(1350): n is a, c, g, or t
cgccaccccccggtggtggatataacaccctcggcgcaacaacgaccgaacgacccaccgtggggcggggcacacaacaacgcataaaaggagcgagagagaacaccccttcacaaggttgctgtccccccccacaatataatcaggtgtctatacctccgcctggatgacaaaccccaccacagatataaaaatacgggcgggaaaaattagaagaaggggttgtctctccggttaaagggaggagaagttgggccccgcctccgtggttgcaaccacccgtttggaaggggggaaggtgttgatatccttcccaaccagggtttttttacaacgagattttcctgttgccccctataggacttctcgcggggggcctcttcttttaaaaaaagattttttgtggagaaaaagtgtcgttgtagnaacgccaactttgccgtgtgttgcgcgcgccaccacccaacactgccccctccttgttgtgttggaacaactccgtctttgggtaggcaccccctcctggggatttgtttttgccgtcagctctggtcgtaaaaaaagagattttttcctggggtgcacccttcatctggacttttctcccctctatactcgtgtgtgttttctcccctctcttttggcaaaattgtcctaaatgtctcttttatgatcctggtgtgtctctgttgggtgtaccacacctctgtttgtacagatgcgcataaataaaaaatgggggacagagggtctgtgagagagagacacactgtattctggtgagacacacacctctgggggtgggagacacacagagccctgtgggctcttatttaagagaattgtggagagaagaagagagctcttctgggccacaccacgagaacaccgctgtgttgttgccctctcacgggtgtctgtgcacacacacacgcgcgtgtgttgtgcattcttctacgcgtcacatataccgcggagaatctgtgtaaactctacacaaatagagtatattgtttataaatatataccacatgagatgtgtcttcccgctgtgtgatcttgaggggcttaagaccctcgagtacacacggtcttttttgtggccctctgtgtcacaccacaggtgtctctcccacacagtggcacactctcacttccacaggtgtcacagtggcgtccacagaangtgtttaaaggaggaaccctataattnacgggaaagttgcgtgaacactgcagtggggagaattgagaatagtcaggcctatcagtttnacaggatcacccctntacctttgatattccacttagctgtagagtccatctgtttgtccatctgctgaaatgagnaaagaaaaatttatgccctgattttaaaccaaccca

SEQ ID NO: 547678 - DNA, 333 bp, Homo sapiens
  misc_feature (133)..(133): n is a, c, g, or t
  misc_feature (160)..(160): n is a, c, g, or t
  misc_feature (222)..(222): n is a, c, g, or t
  misc_feature (237)..(237): n is a, c, g, or t
  misc_feature (297)..(297): n is a, c, g, or t
ggagtccaaaagtaatttttaaaatatccactgagtttctccccgtattgaggctatgccctgagtcaaagctttttgtgcctgtcaccacggtctccccagtgcacctcatccacggtcacgtgctcagaangtgtttaaaggaggaaccctataattnacgggaaagttgcgtgaacactgcagtggggagaattgagaatagtcaggcctatcagtttnacaggatcacccctntacctttgatattccacttagctgtagagtccatctgtttgtccatctgctgaaatgagnaaagaaaaatttatgccctgattttaaaccaaccca

SEQ ID NO: 547679 - DNA, 146 bp, Homo sapiens
gtgatggcaggtagaggcttactagagtgtgaaaacgtaggctggattaaggcgacaggattctaggatagtcagtagaattagaatgtgaagatgataagtgtagagggaagaaagttagatttacgccgatgaatatgacgacc

SEQ ID NO: 547680 - DNA, 160 bp, Homo sapiens
cggagctggagaagaagtcaggaagaagagtcaccagaggagccgcagggacatgccacagaaagaactgcgtagatccagggattgtggatttccgagcggatccggcatgaggacccaagcccaacctggcacctacgctgacgcacaccccccaaaa

SEQ ID NO: 547681 - DNA, 930 bp, Homo sapiens
  misc_feature (76)..(77): n is a, c, g, or t
  misc_feature (173)..(173): n is a, c, g, or t
  misc_feature (201)..(201): n is a, c, g, or t
  misc_feature (208)..(208): n is a, c, g, or t
  misc_feature (222)..(222): n is a, c, g, or t
  misc_feature (238)..(238): n is a, c, g, or t
  misc_feature (471)..(471): n is a, c, g, or t
  misc_feature (477)..(477): n is a, c, g, or t
  misc_feature (479)..(479): n is a, c, g, or t
  misc_feature (481)..(481): n is a, c, g, or t
  misc_feature (487)..(487): n is a, c, g, or t
  misc_feature (500)..(501): n is a, c, g, or t
  misc_feature (505)..(505): n is a, c, g, or t
  misc_feature (510)..(510): n is a, c, g, or t
  misc_feature (531)..(531): n is a, c, g, or t
aacgggcaatagtagtaacaggctggtttaatcggcacgaaggcgaactgttgtggtgcggagcgttcgggggcgnnggcgggcggccaggggctgccgcgggactcggggcgcagcgagtggctgcaggggtggagtgggccggacgagccgggggcccgggtgccgcggtncgaggccgggccccgcgcgaggaggcgngccaccnggggagctgccggnagcgagtttgccccgntgcgaaagaaggcgggagcggcaggggccttcgaaaccccctggcaacccaggcccggagtcttggggagcggtgtttcctgggacgccctcggcggacaccccgatgcagggttacggttctgggcccccggcagaaggctcctcggggtgacccccgcgggggcctgcagagcggcggagagccgacccgggggcctcgagccgggagggaaggggggctccggaggcgangggccngngngccagngggagcgggcctnntcgnaccgngggacagggcagcgccagggntggaaacggggacttcgtggacccttcggtgggggggccacaagaaacttgcccggcgggaaggctggggccggagggagtggcatagcgggaaccttccccaaggaggaacggcccggggcgggagaaatgaacgggttcacgagggagagtgaagcgaaagggccccggcagcaaggtggtgccgacggggatagggaacgtgtcgccctcgagggaggagacgtggtcagaccggggaacgctctcagaagggggcaaaaagctccagagaaccaggtggcttcgaaagaggagcgcattttggtccagagttccgcggcagtagggagacacgggtggagttccgaacacgtattcgggtgtcacggacaacgttagaaggacgcgagcggaaga

SEQ ID NO: 547682 - DNA, 215 bp, Homo sapiens
  misc_feature (208)..(208): n is a, c, g, or t
gtagctgggactacaggcacccgccacgacgcccggctaatttttgtgtttttagtagagacggggtttcaccatgatggccaggctgatctggaactcctgacctcaggtgatctgccctcctcggtctcccaaagtactgggattacaggtgtgagtcgccgcactggtccaacttttccttttcaccttagaaagattgtcaggnggtaccg

SEQ ID NO: 547683 - DNA, 194 bp, Homo sapiens
aaggacgcagctcttctatttgtggactctgatcacagtggaaccctctcccgaccgggcctcagaatctgatcacagggaaccctttcccgccttgggctcagaatctgatcacagggaacgctctcccgcccgaggctcagaatctgatcacagggacacctctcccacctggagctcaagctggtttcctg

SEQ ID NO: 547684 - DNA, 358 bp, Homo sapiens
gggaagtccgtagatgtctcatcgcagataattaaagcttagggcctggtggctaggtcggttctctcctatcaccagtcggagaccttccgccgcaaaccaagccaccgacagaaacaatacggaacaagaccaagaagcataccacgagacaagaaacccaccacacgagaatacaataggacaaaggaagcatcacaggagagcaacccacatgacttctcacatagcagatcatacggccatagcaaacaccaagatagaaacgaagagaacaacaaaaacaaccaaagacccaaggaacaaaaaggcgaccaactgacacacaaacaaaaactaatcaagaccgaggatacag

SEQ ID NO: 547685 - DNA, 218 bp, Homo sapiens
agatttcacggcagccggaacagtagctgggactacaggcgcccgccaccacgccgggctaattttttgtatttttagtagagacggggtttcaccgtgttagccagagatggtctcagtctcctgacctcgtgatccgtccgcctcggcttcccaaagtgctgggattacaggcatgagccagcgtgcccggcatgaaggagttttttaaaagaaca

SEQ ID NO: 547686 - DNA, 529 bp, Homo sapiens
  misc_feature (5)..(5): n is a, c, g, or t
  misc_feature (16)..(16): n is a, c, g, or t
  misc_feature (48)..(48): n is a, c, g, or t
  misc_feature (76)..(76): n is a, c, g, or t
  misc_feature (93)..(93): n is a, c, g, or t
  misc_feature (120)..(120): n is a, c, g, or t
  misc_feature (135)..(135): n is a, c, g, or t
  misc_feature (243)..(243): n is a, c, g, or t
ggccncatttccccanttgccaaatttgtggaacccaacccccaattnccccatccattcaatgaatggattaaangaaaccttatatatatntgatggattactacacagccacaaaanggattgaattaaccnccattttcagtgacctgaatgagattggagactattattctaagtgaagtgactcaggaatggaaaaccaaacatcgtatgttctcactgatatgtgggggctaagcntatgagaatgcaaaggcataagaatgataaaatggactttggggacttggggggaagagtgggagaggggcaagagataaaagactacaaatatggtgcagtttatacataggtgatggggtgcaccaaaatctcacagatcaccactaaagaatttactcatgtaaccaaataccaccggtaccccaacaacttatggacaaataaaataaataaataaaaatatctaaaagggcataattgaattgtttgtaacacaaagaataaatgcttgaggtgatggata

SEQ ID NO: 547687 - DNA, 199 bp, Homo sapiens
  misc_feature (34)..(34): n is a, c, g, or t
  misc_feature (69)..(69): n is a, c, g, or t
  misc_feature (76)..(76): n is a, c, g, or t
  misc_feature (145)..(146): n is a, c, g, or t
  misc_feature (160)..(160): n is a, c, g, or t
  misc_feature (184)..(184): n is a, c, g, or t
  misc_feature (190)..(190): n is a, c, g, or t
cggcagggccctacttctgctcccgcctccagangatgaccatgccgctggcgtcactgggggccagtnggctctngtcgcagttgatgctgacatcaagcacaggtgcactgtggccctgctgcttgttgacagcagccttggnngcccgctccacatnaaagatgtgcacgctcatgttctnactgcncgttaccac

SEQ ID NO: 547688 - DNA, 823 bp, Homo sapiens
ctccatcaagttactgtccccagaggatctctccataagatgtcgtttccatgctatcagttcagagaagttggaataaaatggttggttcatctcaattgatgaatttaaaatgcccaaatcttgttttgtattaagggtgttgtataagacatttccttttgattctgagattttcaggcaggatcgtggactcactaaaattatttcttttttccttggaagaaattaaaagggcagagtgggagggtatctttcgaggaatgctgtttttcacatgtcagttttagctattttggaggtacatgagttgctttattccaaggatcctggcatttgaagtcacacaaaagaaaataatttcaaactccaagaatataccaaaggtagaaaagtgagcctgagcagcttgccataatttcagcagaaggcaaatctggtcccaatcgaaccaatctgttggtttatttgtattattacaacaaagcccaagattgaattcctcacctgaatcacttccttattgactgaatctatttagactcccctctaatttagcagagtatttttttattaaatccaggcatacaaacataaattatccaagctgcatctcatttccttcaccatttattttccttcgttggctgccagtggattcagaagacctgattcagaatttcatcagggacaattaaaaaccaacaataaagaaaaacagtttccacaaaacgatgcttaaaacaagagcgacaacattcagaaattaaataactgtgattttttctcacaaacaagtccttaacttgggtcatataaaccg

SEQ ID NO: 547689 - DNA, 530 bp, Homo sapiens
  misc_feature (466)..(466): n is a, c, g, or t
tggggtggtaaaaatggttgtttatactgatagaataaagcaaataagaaagtttataaaagctcagtgaaaattcaagagcactctaaatataagcttatatttctcgtatcatgtgttgtacaaaatttaggcttatgtgcaaaaataaaagatctgattaaaatgtttacttaaatgcataaatgaatacagtggactggtttaagccatgtcaagaaaatttggtgttaatctatttaaattttttggtaagcataaaaatcactttttctagtgtactggaagaaaagttatttactgactcagcactttgggaggccaaggcaggtggattgccgagcccaggagtttgagactagcctgagcaacatggtgaaaccctgtttctaccaaaaatacaaaaattagccaggtgtggtaggtcgtgcttgtaatcccagcactttgggaggctgaggtgggntgattgcttaaagccaagagtttaatactcgcctgagcaatatagtgagactgtgtttcttcaa

SEQ ID NO: 547690 - DNA, 351 bp, Homo sapiens
ttcatttaggcaatataaagttgaactaagcattctatcttgtacaggccgggctatcaccaggctcgtgtaagtttgtcgcctctacctataaatcttcccactattttgctacttatacaggtgtgctcttttagctgttcttgaagatagctcgtctggtttcgggggtcttaactatggctctcctagcaaagttattatctacgttcattcattatgcagaatatataggggttagtcctggctatattatgctaggttataatttttcatctttccctttcggtactatatctattgcgccaggtttcatttgctatcgcctatactttatttgccttaatgaag

SEQ ID NO: 547691 - DNA, 81 bp, Homo sapiens
taccagccaggctttcaacaaagttccttttacctagtttttcagcatgattctcaaaagcctcagcatcctcggtcgacg

SEQ ID NO: 547692 - DNA, 351 bp, Homo sapiens
  misc_feature (287)..(287): n is a, c, g, or t
tgcttaatagaggaagttaagactttaaataagtgagctacagtaatttagattatcttccaaatctattctaaacttttatagtcttttaatgcatgcatcataacgttctggagagaaaaatctgcagaatgcagcatgcaaacagctgtaaagtaaaccgtaaattttgttcatttatatgttgtctctaacatatttttaagtgtttgttaaaaatctggaatctttgctgggtgtggtaggtcgtgcttgtaatcccagcactttgggaggctgaggtgggntgattgcttaaagccaagagtttaatactcgcctgagcaatatagtgagactgtgtttcttcaa

SEQ ID NO: 547693 - DNA, 886 bp, Homo sapiens
gttcggccctgggatccgtcgccacctccgtgatcagaccgctctgtgcctgagagccgccgtgagcactcgcgattcaagccgaggcagtccaaacgacgtccagggggcatcagcccgctagcgtgccaaagactcatgtgcctgcgctgagcctgggacgccgactccagtctcagtcgagccggccgcacgtcggacgtgccgtcctccatccctctgtccggtgggtgggcaccgggcccagcataacgccatggtctggaatgactgctgggtacgggcgtcctgcgcgtcggatgcacgtgaccgatgaagtggacgtgtcgtcgcggagctgagtcccgcggtcgccgtgcccgaggcgtccgccggcgctgggccccggcggctctgatgttgctcgagcagccctcgcgctgatcgtcttgtgatcggagatgaagaagatctaagacaggctactcgtgtcgatagacaacatctcgacgagttgtgccggatgtgcaattagtacaaagacctatgcgttgcccctgaagcatatatcgcctggatgagacgatggagggtggaggctgcggggagcactgtggcacaagtgcgccccggggtgtgtgagcccccgcaagtaggggaacgtgtcagtgcgacgtgttccctgacatcgagacgaccagctccgcatttataatagttgcctggggtaggcatcgtccgactcccactgtcctgtcctgatcctcgccgggaggagcccctccagacccgcggaacggcaggttcttcacatgacatgtcgccttccccccaaaatgaaaggcctttccggagcgccctgccaaccacccaagaaacgggacatacctcttggcggacgattgcc

SEQ ID NO: 547694 - DNA, 161 bp, Homo sapiens
ctggagcggttttctctgcactgatagcgggggccattagctaaattcttttgctttgtttgtccactgatgagaggctgccttctcaatatttcacttcatcacctgtaaagttagggcctggaatcacacctttcattttctttttgtctccttttgac

SEQ ID NO: 547695 - DNA, 485 bp, Homo sapiens
  misc_feature (12)..(12): n is a, c, g, or t
  misc_feature (57)..(57): n is a, c, g, or t
tgttttttgtgntcccccggggggtggaggggccccccggggggtgagagatataanagagcccccttggtggtgccccccccccctcgcccagagtttggtgtgggaaggaattccccccagttggggtgtgtgggcccccccccctgggggcggggccgggggggggttttttttggggccaaagggtttttttggggtgtgttccccccgtttttttttctccccccaaaagggggggggggggccgggggggcctcctcttccgggtgtgtttccccccccgggggggccccccccctttggggtgtctcctccccccggggggggggcccccaaagaggggggggttttttcccccccccccttttttttttgggggggaagggggccccccccttttgggggggggggggccctttgggggaaaaatttttttttttttccccccgcccggtttttttttccccaataaaaaaccctgt

SEQ ID NO: 547696 - DNA, 340 bp, Homo sapiens
ggggggggggggggccccctttttccccccaaagccccgggggggattttttttttttcccctttccccccccccccccttttttttgggggggggggggggggcccccccccttttttttccctggccccctttttttttgggggaaaaaggggggtttttttccccccccccgggtaccccccccaggggggggggggggttttttgggccccccctggtttttttttttggggggggggggttttgggtttttttttttttacccgggcctttttttgggggcccccccccccccaattttttcccccgttttttggcccccctttaaaggtttttt

SEQ ID NO: 547697 - DNA, 204 bp, Homo sapiens
  misc_feature (12)..(12): n is a, c, g, or t
  misc_feature (90)..(90): n is a, c, g, or t
  misc_feature (105)..(105): n is a, c, g, or t
  misc_feature (133)..(133): n is a, c, g, or t
  misc_feature (157)..(157): n is a, c, g, or t
  misc_feature (170)..(170): n is a, c, g, or t
cccacggtaatntcctgcacgacaatggcgggggctgcatcgatggcggcgaacagccgtggcaggttgaatcaggctctcgatacgctnggcgcgccataaatngagagccggttggaatccatgccgatgnttgaacaaggcagctgcccataangtgttcttccttngaaattgaacagtgcccagaccggtccctcatcg

SEQ ID NO: 547698 - DNA, 188 bp, Homo sapiens
gtacacattgtgtccagtctttgctattgtgaatagatgccgcaataaacatacgtgtgcatgtagtctactatagacagcatgatttatacgtccttatgggtatataacccgagtaatagggataggctgaggtacaaataggtattatctagttactagcatccctagagcgaatacgccactta

SEQ ID NO: 547699 - DNA, 252 bp, Homo sapiens
tctcgtttcccttgtgctcatctcccgatgatcttttcactcctgccccgcatctgttcatgtggttaatttggagcagtagccagtggttcactggtttctgccatgtgtgcatggagttccctcagtctgtatctcgtagcctgtcggcctcgatagaactgataaaataagtcaagacagatttacagccatgatacgtgcccctttagttggagacacagaacttaaattcctgaaatattgaaatca

SEQ ID NO: 547700 - DNA, 110 bp, Homo sapiens
cagaatgccactccggttgcttttattgattgcacttcgtgattacgtgcaccgcgtcattttgccatccgaattccttggtccgcccgcaactcttcgatgcacagtcg

SEQ ID NO: 547701 - DNA, 644 bp, Homo sapiens
gtggatttgttttccaatagaaaaacatgctcttattcattattaggccaaaattataaagattaaatgccatttctcctctcatatttatgaaaataaaagagatgatgtattctatgatggcttggtgtatagaaacaggacctgataatcttgtggagggaatgtaaatgttcctatactcatcacaatttaaaatgtacacataccatttgacctagcagttctacttatagaaatttcatcctcgaaatatacatatataagctcaaagacagaaacaacaatatacattacaaatggtttatagaagcaaaaaactggaaatattcagaatgtctaccatagggtactaggtaaattaaatatatccatacaatgaaatataatacaaatattaacggaacattagtgagaatatagctacatctatatgaattaaaaaattccaagatatattgttaagcaaagacccagagatatatattcattacattatctttgtgtaaatgggaatggaggtgaggggtcagggggtgggggaacatatataccaatacataaagtttatacattgtcagactatctagcaggatatccaacaaagcaactgactctgcaaagggtaaataagaactaggggt

SEQ ID NO: 547702 - DNA, 185 bp, Homo sapiens
cctagtgcttacagcagtggcttactggcagagcgctcgcccggcctgccagggtcgtgatctcctgacagaatagtcatcttctggaagaggctggcccagtcagaatcaggagctgccttcctgctcttctaggtagccacacttcactaaagtgtcatccaccagtgtgttgaatgcgaagt

SEQ ID NO: 547703 - DNA, 269 bp, Homo sapiens
ccacgcagataacagcaccagcacggatatacgagtcataagagaagtatacggtgagctgtgctacctcggagcaccatctgcggcgctttgatatggatataccaggcaatgggcctgagtcaactgacaataaatagtccgggtcaagcacttcatcgcgatacgtcctgcctccataccagactgaaatgctttctggagaccttcttgtgccctcaacgcgggccgttaccctgactactccatctccaatgcagcgcaagctg

SEQ ID NO: 547704 - DNA, 223 bp, Homo sapiens
agtatacataccacataatcaggatcacccaaccgttacaacaagtatacacccccaacctggctagagttactgcctatcagcctatacctgccagctggcacaccagtccaacatgcatctcctgctttgtgaaatgtggtgatcctactagcagtctgaccctgcagtgctatgcaatgcttgtgcactaggcctgtacgttattaccaactgtacgtga

SEQ ID NO: 547705 - DNA, 135 bp, Homo sapiens
cccaaagaaatatcccactgtgctaacctgaatatatctgcaatgaactacaatccagaaacagcgtgcatgcctgtcagagattttctgcttcgtttgatattggtgaatccatgtcttggccagacaaaggag

SEQ ID NO: 547706 - DNA, 168 bp, Homo sapiens
tcctgcacagatcacaagctttttatctcaggctgcagcttggtagcactcatgtccgttgagagatcatccgatgaatgccttcccccggccatggtactatgtagtgtggctgctgtcctcctctgtgcatggaatggtagcgcactcacggtgggtacgtggtac

SEQ ID NO: 547707 - DNA, 1166 bp, Homo sapiens
aagcagtaaaaggagcagctctggtagaagctggcctggagggagaagctagagactcctctggcaatcccccataccccttggggcagactgccctgaatgatgtgatggctgaatgacagtggagtgccctggagaggacatgagaaacactggtgtgctgaaaaccagcagttcccattcctgaagcctgtgggactttttggatgcatgatgcatggccatagtatgtgtagcagctgagcaggccaaccaagatgtcccctcagaagtggccagaggcaagtccaatctttgccagcatgcgcccagcggtgctcccactgtctccccagcactctcttgatcaagtgaccacttgcccacaggttcctcgcatcaaggaaccccagtgggcaaggcagcacaagccctgagcgcacagagcgcgagtcttgctgcacagcagcgcagtggcaggttacacaacagttcctcccttatcacaaccaatcaacgtcactgtggcaagatggttaggtccccagcctggtggcacgcgcagcgacgtggacgattgaaggaaaagcttgccaaaactgcaaacagcacacgctaccacctatgaaaccattcctcactataccttgcgccctatgtccatccgcaatgcgaatcccaccaagccaccacgcccactcatagtcgcctagtcctataagcaccccaacgtcgggcgaagcgcacacgcgacggaaacgtaccagaagccacaacctgggaaagcgaaatcacgcacacgcacaccgacggacagaggcacacgctcacaacgggcagcccccacgggcaacaggaacccatacacaggctggtcccccaccccaccaccaactcgctcaccaccgcctccaccggaacccccaccaaggcgaatcccactgagggccacgccctctccgcgcatcaagcggcaagcacaggaggcggctcccaggacggccacacacaacgcgacgcggcaccgaagccggccaccaacccgcacacgacaccacacgatgggcggcaaacacggggacgcacacgcccatggcccccccagccggaccacgcggacaatccccctccgcacccccccatggcctccagccagggccgcccagaaacgccaggctccctgcgag

SEQ ID NO: 547708 - DNA, 364 bp, Homo sapiens
  misc_feature (3)..(3): n is a, c, g, or t
ttnatatgctgtctcaaaaaaagcaagaaggtaccaggcacggtggctcatgcctgtaatcccagcactttgggaggccaaggcaggcggattacttgaggtcaagagttcgaaaccagcctgactgaccaacatggtgaaacccatctctactgaaaatacaaaacattagctgggtgtggtggcacgtgcctgtaatcccagctactggggaggttgaggcaggagaatcgcttgaacccaggaggcggaggttgcggtgagccgagatcacgctgctgcactccagcttgggtgacagagcgagactccacctaaaaaataaataaatgagggaataaaagtatagtaatcaacagcaacg

SEQ ID NO: 547709 - DNA, 144 bp, Homo sapiens
caccaagtcctgcacacgcatgcgtcaaacagagaagctcaagcatgagaagaagaaagcaggctgtagaaattaggagaagaagcccacaattattcccaggagcaaaacagggaaaaaacaggctgatctccttgagtaggg

SEQ ID NO: 547710 - DNA, 524 bp, Homo sapiens
taaaaaagttgttggtgggactccataagtgaatttcaagcagtgaggatttggtggtgcctgaaatggccgagggcacgggagtgacctgtatgtgtgaggaattgggtgaccgaaataaaagtccacggtgtcaacccctaaaacatgtgggtgaccgtacattttttatacattctccactctagcggcctttatacaggctttccgattttacaggcctttccaagtttccattctccttagagagagaactgtgcttccaaacagaaatcaggagtgaccacaaagcctgaaaacatcttggccacccagcaaagaacgggccacaatgggattggggctctgcatggccatagttgcccgagtttaaaactgcaggccactctgccttgcaaacctcagggtggcctcgtgattccatggggggtgcactccacaggttggcccgagcgtgttcttatcagctgctccaaggattgagacccaagtcatcatgaaaagggcccaagtacagtctaaag

SEQ ID NO: 547711 - DNA, 938 bp, Homo sapiens
acggtggttcacgcctgtaatgccagcacttgtgggaagccaagccaagcggatcacctgaggtcaggagttcgagacagcccggcaacgtgcaaaacccatctctactaaaaatacaaaaaatcagccgggcgtggaggcgtgcgccaggtcacggtgataaccaagggtgcttgggagctgatgtgcaggaagcaaaacctttctccaacagatcccaattgccgcgggacacaccttcctgcaggacggggaaaggctctagtggaggccataattccttttcttttcaaggatcccatgagaatgttaggatttaaaatcttaaagaaaataggctggtatggggtgggtgatcacacattgtaatcccaactctttgtggaaggctgaggtcgaaggatcaacctgaggtccgaagaaatcattacaccgtgggaggcgaggtctggcgttgagccaaagatcacacagtgacattcaagcctgggagaaaaaaggcaaagactccatctcaaaaaaacacacacataaagcaagaacagaaaggaaaaccacacatgcggcgggacacggtggctatagcatgaattccacagcttttgggagggtgcacagaggacaactcaggaattaaaaaacgtgctgttacaactaaggggaaacacgagtttatattagcaataaacaattagacgggcgtgcgggcgacgtgatgtaatcaagaaataaggaaggtaagaggaatgtgagacggagtatgtgctagttggtctggacagataggacgatacttttcttcaagcaaacacacatgtgggtccgcaaaataataaattggtgggcaagatagtaagtaaactgacgtgtgctcaaagggcgtaccaaggcgtaagaccaccgacgtacatggtcgcattgttatgtattttactggt

SEQ ID NO: 547712 - DNA, 364 bp, Homo sapiens
ggaggctggcgaggctgcgagatccctatcgacaatagccgcctctgccgccggggagctccccgagtctcttgagccgcccgtaaccgctcccggtatccgcgggacgtagaggatggaagcgcacacgggagagcctcggaagtcgcgagcacaccgagcctccggccaggcctgcacttggctggaaagggcgctcaccaaggtcagcgcacaatggtagaaaccgagtgaccgattgcacctcaggtcatggccaccatgaggagggccacagaagggaaagacgcacaaggaggcgggtgaagggacgcggcgcgccatctaggacgcaactccgaaaagcacattaacagcgctggac

SEQ ID NO: 547713 - DNA, 442 bp, Homo sapiens
  misc_feature (317)..(317): n is a, c, g, or t
  misc_feature (329)..(329): n is a, c, g, or t
tctaacttaagcatgcatggctttaaaccatgtaaaggtttgcccaaaatgagaagaaaaattcgttttttagaacttattaccagtcattaaacgcactgaggctggtactgctgtctcagccgtggctccccagagtggagggatgaagactagtttctttctggttcctttcccagcctcttttcctgtaacttctctgtctggaatgctgatgggaaatgttattttgtttttgtttgcagcaggtctgttgttttgattttgtctgagtggtatggaaaacagtacgtcacttagagtgggtgtttgtgtancgccatttggcnttgcacatatatttctcatgcttattacatgatgacaagggaaccaaagagacacaagtttccagccgatttttttttctttccagtttaataatagtgagaaaaaaaaaaaa

SEQ ID NO: 547714 - DNA, 379 bp, Homo sapiens
ttgaagcatcctaacaggctcagcaccaacttaaaaaagactggcaaacttttaacacttttccttctcagaattcaggcctgtctcagaatgctacaaggtacaggccaatttgaagctctgtatagacgctcctttttattagggcccagtctcattccaggacaccagaacaacttggactgtggcccaaaaaacttgtcatacctactattttctgtctagtcgtactcctattcaccattctcaactactcatacatgccctgctcttgtttacactggcagtttacactgtttctccaagccatcacagctgatatctcctggtgctatccccaaaacggcactctgaactcttaaatacataatctttcctg

SEQ ID NO: 547715 - DNA, 116 bp, Homo sapiens
  misc_feature (22)..(22): n is a, c, g, or t
acagggacggggtagaaccagngctgtgggaactccctaagtgtcaaatggaattttcaagagatgaccctaatctttttccaattgttttatcaaggtgtctgtactaggataag

SEQ ID NO: 547716 - DNA, 334 bp, Homo sapiens
agacctataaggaaagtttgagagagcctgtgaatgtctcaaatccattcacaagtagatgtataaaatgtcactgaaaaggtaaaatgccaaacgtcgtttccaacggttcctctgaacttcttcccacataccacaccacaccccatatgcacagagcccaaaggccacacttttgaaaaaagaaaaccaagaataagccctgtgtgctctttaagagagaaaggaagaatctagagtctgctgggccctttcacatgtggcctgtggtgtgtaaagcatcttcacaacaacgagcgcggctctgttataggagagtgtctcaccttgtgtc

SEQ ID NO: 547717 - DNA, 325 bp, Homo sapiens
atactggagagaaaccctataaatgtgaagaatgtggcaaagcttttaaccaatcctcaaaccttactacacataagaaaattcatacttcagagaaaccctacaaatgtgaagaatgtggcaaatcctttaaccagttctcatctcttaatatacataagataattcatactggagagaaaccctacaaatgtggagattatggcagagctttcaacctatcctcaaatcttactacacataagaaaattcatactggagagaaaccctacaaatgtggatatggcaaaacttaatttgatcctacaggttaattacacttagg

SEQ ID NO: 547718 - DNA, 1211 bp, Homo sapiens
  misc_feature (331)..(331): n is a, c, g, or t
agtgggcaggtcctgggggaccagacggtctcagacaatgtagctccaggaaaggtccaatcagggaagtaaggtagcgtcaatcaaggaaagttcaaatgtgctgtctagacggggtggaaacatgattatacagagcatctcactagtaacaatagcgaagaccgaacgaggcgcacagacactgctcgagcaacctagaagaagccgaacgaagacgaacatgaggatgccctacagtgaggaccagggcaatcagagacatgagctgaatggagctccgcaggaggtgtgcaagtggagaccactgagtggcccgtcctgggaagangtgtaaggcctgtgctgaacacagacctgcagtgacgtttctacgcatggcgtctgcagatagtgcgctcaggcctggcttggccgccggcttgaggagttcctgagaccagagcgtcggccttctacttgctggatgacagtggtgaccgcactcgagctcccgtgcgtggaggaacgaccggcagcgagagcgcacatgtgctggactgtcatgcaggaccatttcagacgtgcgtccagcagtcatagacgagctcttccaggacaggttcttcacccgggagcccgaggatacgctaggcactagctgcccttcagtcgtggcccaggggaggcctcgactgtcttctttcgcaagttcccgcaatcggtccgggcgttgatgcgcttctctccgtgcgatcgcactggaacctgccacgccagtgttccagtgctgtcctcggagatagatacaaggagagctcaagaaggccatgggacttccacttccacaggcccggccttcaagaaccgacaacagattcctacgaaaagggacgaggaccggactgtggtggcgggagaactcggcacaaactcagggcggccagtggatgaaggacccaagtgacaagggcgggagaaaattggatttgtgaagttgctcccgaaaagccccccaggggaaagagtggggggaagccaaaaataccgcgggaggagaaagaagcaaaaaaaaaaaaagggtatgaaccaccagagagaaggaacacactatctggaaacaggacaatggtcggcagacatacgtaaacaaagacaaaggagcgcgacacgaaagcagcacaggagagagacaaagagacgacaaacaagacgaacaaacgcacacacaa

SEQ ID NO: 547719 - DNA, 482 bp, Homo sapiens
  misc_feature (112)..(112): n is a, c, g, or t
gaaatatgtaatttttatctaatatgattcactcttccttaagtctgaatataactcctctaattgcagaaatgttgtcatatggtcaccacatacaactttcgggcctgtncagtggttcctggctcctatagtcattagttagaagcctagtaatgctgaagtcctatttttctgaactccctttagggaaggagttgggtcatgtaggacaaggtaatgtttgacattatttttgtcaatcagttgtggaactgaagtgactcccctcaggcagggtttgtggctgaatatttagtgtctgaggcagttaactagatgcaagagtggaggccattgtagacataaacccttgtgtgactttgggtaagtctgtggctacctctcaagaatgttgtggagaattatggaaaactggatacgtttctgtgaagatattaagcactgcaaaatgttaagtgtgaatctggctgggatccaga

SEQ ID NO: 547720 - DNA, 111 bp, Homo sapiens
ggatttgctggtgcagtacaactaggcttaatagggaatatcaggccaaacacagaaacagacaaactagacatccaacataaaatgcccacccagctcacgtcctgacca

SEQ ID NO: 547721 - DNA, 819 bp, Homo sapiens
ataagaaagttgatttatattatatttacatgcatcttctaagattgcctttacagtagccaatcagaactttaaagaaaaagaaaggctaacaacatagatcctatgtgtggcccttaagactaaaatactttgcacgcgtgattgaatggcttcacttaagttgtcgaattctccttatacatttaaagtgtacttccgttaagaattattccattttaaatgggtaacttgcagcttccgaagtattttccgttaaacattccagttgtgtattactaaaacgatcaaaatatctctaggtggtagtacaagttccatttataacgtggacacagttaggctgtaaggtttaagacagttacgtattagtggtttgtgcaagttgctcatagaaaagaacagtgaatactggttttcatacaatttttgtaaagacattcttctcccagttggattccaaatgcttttccccaaatggtctaatatatcataagctagtgtttcctgtgtatttaatttttccttccaacacaatatttcaggaaaagtatgagtaacctttgtgagtaggggagacaacagaataagaaatcttttcaattgttgtggagggggtagcgggtcaatgtggattgaatgccgttcctgggggtgtgtttaattcctgctaattttctccaaacaagaacagggttttccttaaatacttaatttcgcaatgttggcaaagaatggctggtaaatagactcctaatatttagaatactgccttctcacagttgctgcaaggtaaaaatctttccaaattaattctaa

SEQ ID NO: 547722 - DNA, 1041 bp, Homo sapiens
  misc_feature (1041)..(1041): n is a, c, g, or t
cggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgcagttccatgaaggagaacaaagtggcatcatttggaaaagattcatacccccgatggaagtataaaggggggggagctaggcctcctaatgatattgcgggttgagggcgtaacgttggacttatttttgcccaacggtaagtccattttgaaagtcacacttccctggggttatatgaactcgggcaccaacaatctagaccctggttgattcattcgaagagcaagacagaagggggagtacagcttctcctggaacatgcacaagtgcacacgggctgtgattgacgtgtccgaacgatttgtcaccacgagccaagtctcagcggatttgcaacagttcgcctttgactatgccacccaagaaaggggcggggcaaaggtccatttgctgtccacaaggcccaacatcatgacacttggggatggttgtcctgcaggctgtgaagggaagttgctgagcggtaccccaaaatccattgggcacatggatcttgacgcctggcgctgcactggttccgaaatcttacccgttgttgtctctgtgttgcccccttttggcactttttcgacctgtgctcgcggtggggcatgggtgtgccggggagaacaagagaagcagcgttgagggggcgcccatccgagggggaatacacccagcccggcaggcggcaagggacccgaacggcaaaaggggcagcgagccgcccacaggcgcaccggcgtgctcggcccggcggn

SEQ ID NO: 547723 - DNA, 225 bp, Homo sapiens
  misc_feature (7)..(7): n is a, c, g, or t
  misc_feature (10)..(10): n is a, c, g, or t
  misc_feature (23)..(23): n is a, c, g, or t
  misc_feature (67)..(67): n is a, c, g, or t
  misc_feature (118)..(118): n is a, c, g, or t
  misc_feature (132)..(132): n is a, c, g, or t
  misc_feature (141)..(141): n is a, c, g, or t
  misc_feature (145)..(145): n is a, c, g, or t
  misc_feature (147)..(147): n is a, c, g, or t
  misc_feature (152)..(152): n is a, c, g, or t
  misc_feature (161)..(161): n is a, c, g, or t
  misc_feature (170)..(170): n is a, c, g, or t
  misc_feature (184)..(184): n is a, c, g, or t
  misc_feature (193)..(193): n is a, c, g, or t
  misc_feature (205)..(205): n is a, c, g, or t
  misc_feature (222)..(222): n is a, c, g, or t
  misc_feature (225)..(225): n is a, c, g, or t
ggggcgngcnggggaggggaaancgtaatttgcgttgaaccgtgttgtgagggggagggccgtgtangttggggtggggtgtgggggccgggggccgccccgggtacccgaggcagtncgcgacccacgagncacataggnaacngnaccgncaaacgccngaagagtancgtgttataagtgncacatgggnaacacagcaagnaaagacgggaacggccnccn

SEQ ID NO: 547724 - DNA, 301 bp, Homo sapiens
ccctgtcatcacgcatgtacatcaggaggcacttagtgcagagcagccacacacttgtacaagcaaactggcagcccccgtgtgggcctcatcgggggcagaagacaaagatgagggccctgttgctgaacaagtaaagaaatcaacgttgaaccctaatgctaaggagttcaatcctacaaagcctctgctgtctgtgaataaatccaccagtaccccaacttctccggggccctggagtcatgcaattccctcgataccgctgctgacagcaggccagagtgggctatacagcccccag

SEQ ID NO: 547725 - DNA, 152 bp, Homo sapiens
tcgagctcggtaccgtctgagcagctgggaaggtggggaacggaatgctgacagaggcaggtgaggcagacccagcctgtggagagttttgctgcctcgaaaggagttcggctattgatatctaagtggtgataggaacaccatgtgaagcc

SEQ ID NO: 547726 - DNA, 137 bp, Homo sapiens
cacggatccccgtcactggcattcactgtggtcatagggtcatagaattcttgaacgattctattgccagtaccagtgctgtggaatctaacaatagccagacctgccagatagaaatatcgcgcccccaagtgact

SEQ ID NO: 547727 - DNA, 376 bp, Homo sapiens
gatctctcgcatcgacggttctctgggatcgagagtgtacaggaagaccccaaacaagaaaccaggaggagaggttctttctagcggagacactaaaggattgcttggcttttcatgaattgggaatattctccaagggattgggaacgaagggcccatcttcggggcaggaccccaggcagatgtgtcggacaagcaacttcttttcctctggtgaggagacaagacttggagactcagcgatggcagggcagggccaatggcacactgggcccacacattcctttctacagagaatttctatgaatgccactcacttgccattccagggccaaaggacaggaggtttgcatatccgccccttgtatttgatttg

SEQ ID NO: 547728 - DNA, 762 bp, Homo sapiens
  misc_feature (210)..(211): n is a, c, g, or t
aacgaggtattatagtcgtccctggtttatttcgttacccttgctggcgttacgttgtactgaagtgtgccgtcgtttccactttccggctgtgaccctcctcgccgccgccgcttcgctgcgtcctccgactccccgcgccgccgagaccagtgctcccgctccggttgcggccgcaccgccctccgcggccgccccactggggtatanncagcgagctgcgtgtcgttaccttgggtggacaggaaccattgaatctggcatttcccccatcttcctctttggcctctgtgacgcttgccttccatctgctcccacttcaatccatctgtctctcgaggaactaggctccaacacggggatccaggttttcaatcatgattgtgaaggtcgaggcctcatgacaacattcgtgatctctccccatgggaattgcgtcggtcctggggatgcttcagctgggggcggactgtgcaggaccaagaagcagcttcgcccattggtgatgagataacggcgtaaattggagttggtaaacatattaacagaagatcaacaaggccatcgtctccagaagaataaagacttgtgacagtggctaacgccgtgttgtaagaatgcctctgaaattgaagttgccttttgttccagggaacaaagatgtgttccagtgtgaggtccggaatgtgaactttgaggatcagcctctgcttgtgatccctcagtgctgggttacaattaacccggtatttttgacacttc

SEQ ID NO: 547729 - DNA, 225 bp, Homo sapiens
  misc_feature (48)..(48): n is a, c, g, or t
  misc_feature (151)..(151): n is a, c, g, or t
  misc_feature (200)..(200): n is a, c, g, or t
tggtactatttcctgtaagaattgactcatctggagcctatgatagtnaaaaaactcaccttaccgaaagatttcttatggggcggcgcagttgccgctcatcaggtcgaaggcggctggaacaaaggcggaaaagggccgagcatttgtnacgttctgaccggtggcgcacacggcgtgccgcgcgaaatcaccaaagnagtcttgccaggaaaatactatcca

SEQ ID NO: 547730 - DNA, 324 bp, Homo sapiens
gccttagcctcatacgcatgagaagtcatttccacatttaaatctttctttggcagggcgcggttgctgatgcctgtaatcccagcattttgggaggccaaggcgggtggatcacctgaggtcaggagttcgagaccatcctggctaacagggtgaaaccccgtctctgctaaagatacaaaaaattagccaggcgcggtggcgggcgcctgtggtcccggctactcgggaggctgaggcaggagaatggcgtgaacccgggaggcggagcttgcggtgagccgagattgcgccactgcagtccgcagtccggcctgggcgaca

SEQ ID NO: 547731 - DNA, 211 bp, Homo sapiens
tgacctacggagttatatgtggcgttacgtagtcggattcgtataccactgcgccacgacgggcactcctagtcacataatatcataactaacttaaaatttttactattcggagttcccactagtggcacaacaggatcagcagcatagctgcaactgccaaggttctatcctccacccagcatagtgcgctaaacggtaacatcacagg

SEQ ID NO: 547732 - DNA, 173 bp, Homo sapiens
tctgagctggctcctattccaacctgtgtgtccacgttgcacaatatgcggtttacttggacctcgtgcctcatctttcttcttttgcgcttcagccgtgcgcattcgcttcttcctccagcttggctctcatggctgcagaggtttccaaaaaaatggcgctaaggccgaga

SEQ ID NO: 547733 - DNA, 669 bp, Homo sapiens
gcaatctgttagggtttgtgtctgtcgtgtggaagctctgttcattcggcttttgcaataaatcttgctacttctcagtctttgggtccacactgcttttatgagctgtagcagtcaccacgaaggtctgcagctgcacgcctgaggctagcgagaccacgaacccaccgggaggagcgaacgactccagacgcgctgacttaagagctgtaacagcttaccgctaaggtctgcagcttcactcctgagccagagagaccaggaacccacctagaaggaacaaactccggacatgccgcctttaagagctgtaacactcaccgccagggtccgcagctgcattcttgaagtcagtgagaccaagaacccacccattccagacacactgtcatcagtgggatatctttttaaacagagataacattgcacaatcttggaagtggaaatagacctcagctggggtttagtcctgttttcttcttagagcagaagtcctgggatgccgcttctggactgattgtcagttttcttctcctgcccttgagctattctaatggcagacatttgtggctttacacaagcaggctttcagttagaagaccttgttagctcacgtcaactgctgttctgagcacggcctcccatgtggggagactctggccctggcct

SEQ ID NO: 547734 - DNA, 396 bp, Homo sapiens
  misc_feature (1)..(1): n is a, c, g, or t
  misc_feature (76)..(76): n is a, c, g, or t
  misc_feature (87)..(87): n is a, c, g, or t
  misc_feature (90)..(90): n is a, c, g, or t
ngcccgcctgcattcgactctagaggatccccagtggtgttggtggtgatgaccgaagaaaaactgcaccagctgnaacaggacatnggngcaaaccgaagcgcaacttgacgaactgatgcagcaactgagtgccacaatgcggcagttcgaacaacccttcagtgaagcccagagcgcactcgaccaagctgatgcccgatccagcgaattgcatcaacaacttgggacggagttcgaacaacacgagcaggcgcataaggatgccctcgcggcgttaccaggctgcatgcgcttctcgccacacgcaaaagcaccgctctctctggcagaagctcttgagtctgttcaggaagatgcccgaagaaatcgagctgaacaaggtcaccgcatcaa

SEQ ID NO: 547735 - DNA, 141 bp, Homo sapiens
cttagtaccgacgtttgcagccagacgggtagggaatgcaagagagtgtaaaataaccaatctgaataaacagccatctcccaggtgcataatgcgcaggtcagctatttccaggtgaagtgcttgtgcttaaggaactct

SEQ ID NO: 547736 - DNA, 221 bp, Homo sapiens
gtccataaccataaccatatcgatattcagacaccgacatcggaataggagactgtagacgtatcccatccaaatgcaaatgcaatatcatggtctaggtattataattatgaaaatgataataatgctaagtctgtgtgtgcgccaactcaaaattcaggaagctgtttgaatcattagtgttgctttcttctaaatgaacacccttctgtcgtcttctc

SEQ ID NO: 547737 - DNA, 86 bp, Homo sapiens
gggacgcaagcgggaactcaaggtggggcagccgctggggagggtctgacagagcctcagttaaacacgtggcccagcaaccccac

SEQ ID NO: 547738 - DNA, 192 bp, Homo sapiens
  misc_feature (29)..(29): n is a, c, g, or t
  misc_feature (121)..(121): n is a, c, g, or t
  misc_feature (127)..(127): n is a, c, g, or t
  misc_feature (167)..(167): n is a, c, g, or t
  misc_feature (176)..(176): n is a, c, g, or t
ttataagtcttgtacttcttttgtaaaanttattcctaagtattttgttctttttgatgctaatgtaaatggaattgttttcttaatttcattttttaaatgttcattgctagtgtatagngatacnattgatttttataacaggtttttgagatgtaattcacatnccatacagntcattcattacaactg

SEQ ID NO: 547739 - DNA, 1229 bp, Homo sapiens
  misc_feature (103)..(103): n is a, c, g, or t
  misc_feature (139)..(139): n is a, c, g, or t
  misc_feature (142)..(142): n is a, c, g, or t
  misc_feature (144)..(144): n is a, c, g, or t
  misc_feature (206)..(206): n is a, c, g, or t
  misc_feature (385)..(385): n is a, c, g, or t
  misc_feature (555)..(555): n is a, c, g, or t
  misc_feature (573)..(573): n is a, c, g, or t
  misc_feature (612)..(612): n is a, c, g, or t
  misc_feature (647)..(647): n is a, c, g, or t
  misc_feature (668)..(669): n is a, c, g, or t
  misc_feature (961)..(961): n is a, c, g, or t
  misc_feature (1053)..(1053): n is a, c, g, or t
  misc_feature (1225)..(1225): n is a, c, g, or t
gactgtgctgtcagctgatatgcatgaatactgacctagtactctgcacagaaaactcggcatccgtacgtgtgctacaccctcaatttcttggacttgtagntggaggttcgtgcttcaagctcgtgtgtaactactncgngnagactgcgactatatctcggtatgccataagacggagtcggattctaaacaggtaacccggncctgtgtcaccgcaacccaccatgactggcgcttactgtggactctctcaggggtgttgtgtattctcgtgtatggcctggcagtgttgcgtggtgtaggccttgacagtgaattgcctagctgcgtcacctacaagggttacttacctacactaaaactgaaatgtttgtacctccgncaagcagactgatgcttcgtagagtgccaacaatagcagagaactacaacatttgggtgtatttctctaatgggtcagttgacttccgataccgacacactgtgtctgacacattctatccgtcccagggaccgggagactgagtaaacagacactctctcagggccagngtcactgacagtctcttncgggttgtgactcaggctctatctgtgttaatatgtatncgcggctaggagctaacacttagaccgaccaagtncgttgacttagtgagtgccanncacagggactctctttgtatcacactctcactctctgtagctgactcagtttttgactcatagatcggctgtataagtatgagggatacagtcaacacacatagtgaagtcttaaaaagcgatatttgacagtcttgggagattatacactcaaaacacttaatttggtgagttggaaattcacttaagtgaatagacatcatttctaggggcttcaccggtatagattgatttgatgctagaggccctattaaggaaaatcagtggtttctacattctgagaatctggtancaatgactcaggtgtagtaaccacctttcttttaaggatctagccaggaacaccgtggaattattttgacgctggtgtccctgcatggttgnattcattcctctttacctcacagaccactgaagggagaattcaaggagatcgtcgtttggtcgaacagacagcgagattcctcgccaacaacagagcgcaatcctcgtgtcaacaggagccactcctctccaacaacattgtgtaatctattacacccggaagaccgccctntagg

SEQ ID NO: 547740 - DNA, 414 bp, Homo sapiens
gtcgtatgtgaataccgcattttgtgagtcccgcattttgtgtgtgcgttcatcccttgatggacacggttgctcccaccttctggcttctgtgaacagtgctgctgtgaacgtgggtgtgcagatacctcaagtccttgctttccattccttgggcgcacacagcagatgcggtttgctcggccctctctgagcccaccgagtaggctgtgtctgtattttcaccaggactccttgggatgctgagctacagctagcgtggcagagggcaaggaaggcacttagacagctcagttgcctctgatcacgtccaccgtcactccaacctgccctcggggtctgacgcgcacacacagcagcagagacagagatgggagcatgagagctgcctgcaaggggacaatcctcaggccc

SEQ ID NO: 547741 - DNA, 111 bp, Homo sapiens
tgtactgagaagcatgacaaccttctacatgggaccaacaaagaaaaaggagaagatggtgagtgcagcattcatgaagaggtacatccatgtggccaaaatcatcaagcc

SEQ ID NO: 547742 - DNA, 208 bp, Homo sapiens
aaaaaagaaaaaagaattacgtgaacaaagaattagctcctttcatcgttagggatgtgaagacattaaggaagatttccctgaggaaaggcatatgacaatacccagctccgtatcaccttataattaaaaagcagcacctaccattctccgagctcatggtcctgtgcaatgtgctacacacattccagtatccgatctaactctc

SEQ ID NO: 547743 - DNA, 131 bp, Homo sapiens
agcgtgtgccgaatcgggcactgtgtggagccctggagctgagatcaggatgttccgcttcatgagggacgtggagcctgaggatcccatgttcctgatggatccctttgctattcaccatcagcctctgt

SEQ ID NO: 547744 - DNA, 788 bp, Homo sapiens
agcggaatagagatgcagcaccgtgatacgctatgatcatcgccgtcaaacgattcatccgtggcttggcggcgctgcgaatgacttaagctgcggcgtctgactctcgtctaactcggaaacgatcatcacttcctgacagaaaaacaaagatttatacctctgaccgtaccttgtcgtaccacagctatgtcgtcaagacgaacaagcatgattgtttcctcctttgaccaagttggaaacctctaagcatcacgaattcgaggttgaattcaagcgtaaattaaacgacacgagtcgtcattccccggtagacatttgtacaacatgaccgttgaatagaaacgtacgtcggaagtatggcaaggattgttactcaagaactataaagaatgtagcatgaggtccatcacccaatggagcttgtagatttactttgggaagacaagggctacatatctggtgatcatattaacttcggtgagctcatcattgtcatcatttcctattcttcaacgttcttctgaagagaaaattctttactcagacaggttgagcctagaaagacaaaagctgaccgtatgtcctatcatcaatgggggaagaccaccttcgtttgttgaacgtttcaacagaattttataagctcgagatacgaaatatttctaagtctacagaagttaatatcgttggatttatatgataaccagattgaagaaattagtgggctttcgaatctgagatgttcttcgtgtccttctgttggggaaaaaaagaatcgagaaaat

SEQ ID NO: 547745 - DNA, 340 bp, Homo sapiens
gatgtcatagcaaatggggtggaaagtagagttcatcatttactccgcccgactcatgtataaactctcccactatcagcatcctccaccagagtgtacatttgttacaatcagtgaacttatattgacacttcattatcaccccaaatccacagtttatatcaagcttcactcttggtgtacattcaatgggttttggcaaaagtataatgacatgtacccaccattacaatatcatacagaggagtttcactgctttaaaattcccctgtgctctgcctattcctccctctcttccccctaaccactgatctctgctattgaaacttctaaaactagg

SEQ ID NO: 547746 - DNA, 278 bp, Homo sapiens
ctgcctcagccatgcttcatttttattggatgacagacattgtgaattttacattgctggttgctagcttttgttgtattctacaaaatagtatggaagtttattctgatgcaaaattaagacactcagaatcggctggatccttttgtggcttgctttccaactttttttaggggatcccgagcagcttttagtctagggctgaattagccccattactaaaacatggtacccttctgaagattccactcaacaatccatgtattacgaggtctttt

SEQ ID NO: 547747 - DNA, 289 bp, Homo sapiens
taaattcgcggccgcgtcgaccaaaaaataaattggctgggggcgtggtggcatgcgcctgtggtcccggctgctcgggaggctgaggcgggagaatggcatgaacccaagaggcggaggttgcagtgagctgagatcacgccgctgcactctagcctggctacagagtgagactccatctcagaaaaacacacacacacacacacacatacagaaaagggtagaatcgccctgttgaatggaaagtggggggtctacgcacttggttatgctttataaacttcttctg

SEQ ID NO: 547748 - DNA, 548 bp, Homo sapiens
  misc_feature (166)..(166): n is a, c, g, or t
  misc_feature (255)..(255): n is a, c, g, or t
  misc_feature (370)..(370): n is a, c, g, or t
  misc_feature (397)..(397): n is a, c, g, or t
atttaatattataatctatttaatatatttatgtatgtacatatcttcctaaggagcaatagttcatcttttgctaattcaatgtttgctgtatgttttttagaacataactattatacagtaaataatgacaattgactgcgtgttactttgagaaaagtactanacctttctgaatttgtttccttaagtgtaaaatttgtgaatctctatctccctgtgtaggagctggcacctacagaatttgtctttgtntttctatgacaaagtcttccctaggctgagttggatattggactgaatgcgtcaggttagagcccagaggtttgactggagttggcagggctgcttgggtctgctggaagttctngggtcctcgtcctgggaaacctggccnttcacattcctcctcctgggggttttggctccttgccgggggtccaagtcccatcctaacccctccctaacaaccccttggccaaaaaattggtttcccctttggaatttcaacatccccctggtgtggttaaccggtttataaaatacct

SEQ ID NO: 547749 - DNA, 555 bp, Homo sapiens
tcgcccaaattagtaggatgcattctattcttataggctgagatggtacccattctgtatatgtccacattttctttatccattcatctgctgatgaacacttaggttgcttccaaagcttagctattgtgaacagtgctgcaacaaacacaggattgcagatatctcttcaatatcctgatttcccttcttttgggtagataccagcagtgggattgctggatcatgtggtagctcagtttttatttttgaggaactgccaaactgttctccatagtggttgtactaatatacattctcaccaacagtgttcaagggttcccttttctccacatccttgccagcgtttgttactgccttttagatataagcgattataactgcagtgaggtaatatctcactgtagttttgatttgcatttctctgatgatcattgatgaacactttttgatatgcctgtttgccatctgtatgttgcctttcgagaaatgtctgttcaaatcttttgcccatttttaattttgattactacacctattcctaatattctggtt

SEQ ID NO: 547750 - DNA, 525 bp, Homo sapiens
tcacagtggttggtaataagtaaaataccctattgtaaacttacaaccttggttttggttttatgtgggggtaaaggaaagcagaaagggaaatttaatcctcctcctttccgaaaagggcgtgggagatatttgagaaatcccccaaggtcccttgggacctactgatgagaagatagtttaatgtatggggagaagaaatgggatacttttaaaacctttttggggcagttcaagagggttgtaaatttaaaaatttggtatagggtatttcataacaaaaatatggtatttctttttgggtggtaattttatcttggaaaccggggtaacattatttatatgttattgggtggcaagaaaaaacaatgtctctacaaatgtaatttggtgtttatattttggtacccatcccatcttggtgggctcttaactggtaatctctggtggtcatggtccaatcatgttggtaaaccaatgggcattctttggaagcagtggtagatggagaattaggaatggtgg

SEQ ID NO: 547751 - DNA, 412 bp, Homo sapiens
  misc_feature (1)..(1): n is a, c, g, or t
  misc_feature (10)..(10): n is a, c, g, or t
  misc_feature (86)..(86): n is a, c, g, or t
  misc_feature (110)..(110): n is a, c, g, or t
  misc_feature (308)..(308): n is a, c, g, or t
  misc_feature (333)..(333): n is a, c, g, or t
  misc_feature (342)..(342): n is a, c, g, or t
nccgccgaanccacccgggcaggtctcagccacccgctctcctccggagagtcggctctgcggttccggcgcgcccatggtcggcnatgcggaccgggaggccggcccgngtgatgcggcgtgctgagaggccggcgtggagaccatgccgaccccgcgcggctgctccgggccttgccacttcctggctccggcttcgtgttgttgttgctgcccgctctgagcgttcctggggcggtaccgtcgatggtggtcagggaggtgcaggagtccaagtctcccaagcccgggccgcacacgctgtcgcngcttcctccgggccccaccgcggcncaagccttnggggccaagctcagtcttgatgctgccgggcttgccaggcgcggagagcgcaaattgacagcattcccgg

SEQ ID NO: 547752 - DNA, 397 bp, Homo sapiens
tctgtctcagcaacttccgtagtttacagactttggagagcccaagctaactatgggcagaagtggtacacccacacagcacagctgctttataaaagtgtggctagactgcttctttaagcagatccctgatcccactcttcctgactgggtgacacctcccaaccagtgtctccagccaccacctaccacctggttgtttgggccagcaaccaggtctgtacccctctgggacagagctcccagaggaaggggcaggctgccatctttgcagttttgcagccttcactggtgataccctcaggtactggaaaacctaaggcgactagggactagagcagatgcccagcaaaccacagcagccctgtgaaaagtggccagactgtaaaaaggaaaa

SEQ ID NO: 547753 - DNA, 166 bp, Homo sapiens
gtagagatgaggtcttgctatgttgcttgggctggtcttgaactcctatcctcaagcagttctcccaccttggcctcccaaagtgctgggattacaggcgcaagccaccatgcccagccagtctgtttccttctttccacccagtggtcccttctgtcgtcttctc

SEQ ID NO: 547754 - DNA, 759 bp, Homo sapiens
ttatactttgaagctttgaggaacaggatctgttatcttatagaggcccaggttacttggaaatagataaattaagaagttttgggtatctcatcaaacctaactttctgttagtcacaatatgaattccaattaagtcaatatatatagggtatattataagtacataaggaaattaagtcagacgaaagataatacactaaggcaactgataatgtagatatgataatgaatatagataaatctgaattattaaggtgtatattagaataattatgatatatgctatgatcttttataaaaacttatatgattattacagattatttatttaaagatgcataacgtatattaaggtacacatttaatgaattattattaagaagttaagaaccattcatgatatacgataatgaacgttcatattatttattaacaacttgtttctacatcatacaatatacataaaaatattgaccacttatgacataaaaggaaatgatgttaactaattttcaaaaatctgttgatcataataaattaatttcaattaaaattataaggaactatctgttggaatatctatttagggaatcatatgttacaatgaatttaaatactcttgtataaatacaatttacagctaatatgtcaatactatgagataaaactgatagtaatatattcttagattatatctgtgtgacttctcatatcgtgtatactgaataaataattaaattaatataaccagatgca

SEQ ID NO: 547755 - DNA, 270 bp, Homo sapiens
  misc_feature (43)..(43): n is a, c, g, or t
  misc_feature (107)..(107): n is a, c, g, or t
  misc_feature (114)..(114): n is a, c, g, or t
  misc_feature (130)..(130): n is a, c, g, or t
  misc_feature (152)..(152): n is a, c, g, or t
  misc_feature (180)..(180): n is a, c, g, or t
  misc_feature (257)..(257): n is a, c, g, or t
caagttcggatggatccgagccgggctcccgcgctccggggangtcaggcgccagtgactggagtcctgggtggcgcggggctctcggcgcattttgtgtggggcgngctcggnggcggggcagcgggcnttccaggcttgcttgttttttncaccctgactcgttaccccagacatctncgcagatgttagttcacagtttttcagccatggacccgtcacgacgcaccagcaacgggacggcacggttgcccagntgggacgtgtagg

SEQ ID NO: 547756 - DNA, 163 bp, Homo sapiens
cgcccctcctacctcttcatgtttacaaaaacccagtatctttgcccaaaccaggggttgggggagggtctctggctttatttttttgctgggcaaaatcctattttatattttttaaagccagtttaggtaataaactttattatgaaagttttttttttta

SEQ ID NO: 547757 - DNA, 133 bp, Homo sapiens
acctgtagtgagtagagatcatgccattgcactccagcctaggcacaagagtgaaatctatctcagaaaaaaaaaacaaaaggtgtctatggcaagcaaatacagattttcaagtgatattttacataattac

SEQ ID NO: 547758 - DNA, 335 bp, Homo sapiens
cccccgtttttttggtttttaaaaccttaaaccccggccccctttccttttgggggaataaattatccccccccaaaccctagggggggggggggaaaattaacggggctgtttttttcaaaaaggcccctttaaaaattcccccccccaagggggccccccggggggggtgggttttggaaaaatttttttggggccccttaatccaaaaaaaaggggggattttggggaaaagcctttttttcccggaatttttttaaaaaaaatttaacctcccgggacgggcccggtcctttttgttggtaaaccccctttaacccttttcccagggttta

SEQ ID NO: 547759 - DNA, 584 bp, Homo sapiens
gcacgagtacaggtaaggaatcaaaacagtgggtatacccaggttgtatatctagaaagtgatagagctgggattttaaactttataatctgattccagaatctctacctttaaacactatgttaccacttacttctcttcaaattttattgagcattagatgtttccagtatttagaagtcaaatgcttcgtttttaataggaacttacacagtcttttatgtttttttatagccctcaatgtcactgatgtggattctcccaaactcgatactttgtttgtttttatgtccccataataagtctttaagaaaacagggcaagtgagctcaaaatcaaaagaaaacccaccaacagtgaatgcattcagggctatttccaggtctttcttttgaagaaagataagactcagtccagagagcacatctgtgacacaccgtgcctcttgcctttggtgcgtggcagtcatctttggctcatgctgtacattattctacattagaaaactcactgtatgttgctaaataattttttgaaaacaggcagattaataaatggacatcttaatatttgaaacaaaaaaa

SEQ ID NO: 547760 - DNA, 257 bp, Homo sapiens
ggtacggaaaaaagccagctgatgctgacacttaatatggaaggagaggatggaaaatatcctgaagatacgggctagaaggaaaggacaggtgggacagtggcgcgatagagtaagtccacgcaaaagtgctacccaatgagggccacgtgtgtatgaattggaacaccgaacatgtgatgcaatgactacccgcaatgagtatactatcaatgtgccccgaaatgctttaatgatgacatgtgtgcatatgtgtg

SEQ ID NO: 547761 - DNA, 105 bp, Homo sapiens
tcccgtggcggagaggctggagttccttcagaggaagaaagcattcctgcggctatgtgaggaggagacaccgcgatgagccaccccaagcgccaccccagttag

SEQ ID NO: 547762 - DNA, 178 bp, Homo sapiens
aaaatctaggcagctgaacaagctcttcatccctggcccaggaaatagcctattaaaaaatgctgtccaggccaggcacagtggctcacacctgtaatcccaggacttcgggaggctgaggctggaggattgcttgagttcaagaccagcctgagcaacacagtgaaaacccatctca

SEQ ID NO: 547763 - DNA, 89 bp, Homo sapiens
  misc_feature (47)..(47): n is a, c, g, or t
  misc_feature (55)..(55): n is a, c, g, or t
cacatgccctgtttcctttagctgctgtactttctgcagatttccantcacctgntagcgcaggaacgcaccgccggaccagagaacag

SEQ ID NO: 547764 - DNA, 114 bp, Homo sapiens
ccttttctataacttggtagtatccttgagtacctcagtggtgtagtcattgagaataaaagatcataatgtatgggaaagtgctttataaacctttaagcatctttatcaaga

SEQ ID NO: 547765 - DNA, 116 bp, Homo sapiens
caggccatccgcagacgctcacagcacttcttgattcctgggcagtcagtatctttcaagcagcggttggagctgcctctctcatccactttccaataaagagttccttctgctat

SEQ ID NO: 547766 - DNA, 335 bp, Homo sapiens
tacaggatcttcttggaggggacacagagactcgtagacacagcctacacgtcacgtgcatgcttggacccggtattgtatacgtgtctgtgtgggtggagaaagacggagtaactagctctgtggggactgtcactactggcacagctccccaacccagttgagggaaacccttgaagagctggagggctcaggaccaaacaagctccgatcggccctggaccctggggagggttcccccccggaacggggcccccaagaaccccacagaactccacctacggttgagtacctgagatggtgcagacgctcccaagccaggggtccggctcaat

SEQ ID NO: 547767 - DNA, 353 bp, Homo sapiens
tctgatttgctttccaaagaactttccctgcttctgcctcggttgcctgtgcttccgaggtcttacgcaaaaaaatctttgcccagactaatgtcctggagcatttctcctatgctttctttctttctttctttttttttaaagccattcttctgcctcaacctcccgagtggctgggactacaggcgcccaccatcatgccccgctaattttttttttgttttttgtatttttggtagagacggagattcaccgtgttagccagggtggtctcgatctcctgaccttgtgatccgcccgccttggccacccaaagtgctcagattacagacaagagccaccgcgcccgacct

SEQ ID NO: 547768 - DNA, 328 bp, Homo sapiens
  misc_feature (322)..(324): n is a, c, g, or t
  misc_feature (327)..(328): n is a, c, g, or t
ccggctcaaagtgatccctcccccatcctcggccctccctgagtagcctggaacctacaggcacatgcccacccatgccctagcctaattttttatatttttagaagagacaggtttcgtccatgttagtcaggctggtcctcaaactcgtgggctcaagtgatccacccaccttggcctccgaaagtgccgggattacaggcataagccactgtgcccagccaatcaaatgagaaaagggcagtctcttcaacaaatggtgttgggaaaattgaatatccacattcaaaagaatgaaattagatgcttaccttaaactgtnnnggnn

SEQ ID NO: 547769 - DNA, 161 bp, Homo sapiens
gatctaaggatcccgagatatttggaggtgggtttgattagtcattgttgtgtatgttatcatttgttttaaggttagtttgattagtcattgttgggtggtgattggtcggttgttgatgagatatttggaggtggggatcaatgaccaacaatttattg

SEQ ID NO: 547770 - DNA, 522 bp, Homo sapiens
  misc_feature (283)..(283): n is a, c, g, or t
  misc_feature (289)..(289): n is a, c, g, or t
agctaaatattaactatctcaagaatattcccagaagtgactgctaaatttaaatccctgctcacaatgaaatactgtacagcaggggttctcaaactttttggtcttaggacccttacagccttaaaaattattgagaactccaaagaactttcaattatgtgggtcataactactgatacttactgtattataacttgaaactgaaaaaatttttaaatatttataaacatttaaaaataataaacccattgtaagctaatgtaaatagcatgtttttatnaaaaancactttgttttccaaagcaaaaaatgtagtgagaagagaggccttcttttacattttaatatctggcttatgagaaaatagctgagtttctcatttctgcttctccatttaatctgttggtgtatattttatttaaagtacagttaacccttgaagaacgtgggtctgaactgtgcaggtccacttatacatggatttttttctaataaaagttgcaaatatgaaaaaaaaaa

SEQ ID NO: 547771 - DNA, 100 bp, Homo sapiens
gcgctgacgtgtcagtgcgctgattaagaatcacttaaactccatctcatctccgtgcctggtagctcaatggcgcatcctgatacttcttatcaccagt

SEQ ID NO: 547772 - DNA, 207 bp, Homo sapiens
  misc_feature (114)..(114): n is a, c, g, or t
agcgatctagaggaccgtcatcaaccttggctacagtagaaaaaacctcagaatcttatggcttgtgttagggttcgatgactcatcgaaacctattagtgtgtgaacatcaancgcttggtgaattctgcttcacaatgataggcagagcgacatcgaaggatcaaaaagcgacgggtgtaccggaggctcgaaatttccggtaaa

SEQ ID NO: 547773 - DNA, 504 bp, Homo sapiens
  misc_feature (105)..(105): n is a, c, g, or t
  misc_feature (107)..(107): n is a, c, g, or t
catggccacttcttagagggaagagcaaacaccatagaggaaagtgctcacagctggaggacatgggtgcccgccggggctcagccccaaggggggcacaagctnanagtaggcagggcccaggcttctgcccccatccgctggtggggaggttctgtggctcagaggaggtgggtttggaggacagctggactaggtgggttctggcccactggggcacaggattggccgctgtcttggttgcgggtgtgatgtagggagctgtggtggctgggcccatggtggtttgagagctgggcaggctggggtgggcactgctgcttggtagcccggctctgacctgctcacaatcttggcatcttagtgggtgtcaggtgggtctgaggcctgagcctgggcctgcacagtggtaggaagcacaggcagggcagaggggatggctggcaagtgggggtgcggtcaagttgggggtcttggtggccaagtaaagacagtgcttccgga

SEQ ID NO: 547774 - DNA, 299 bp, Homo sapiens
  misc_feature (4)..(4): n is a, c, g, or t
acgnatggttggcagaaggatgtccacatgcctttagcacccggagctggcagacaagaatgtgcccaacctttcatgtcatgaaggccatgcagtctctcaagttcccgaggctacgtgaactgaacagtttgcctggcggacatttctactcggtacgcttaccaaattatgggtatccaagtatctcctgtgattaccattcatctgcccccggttgattgtgcctgccacccgtacgccgtcatccgtccagacgactggacaggcctcgagcctaataggtcttggagggtgag

SEQ ID NO: 547775 - DNA, 705 bp, Homo sapiens
tcccaccccctttgaataatcatgtaagactctcataaagggagtctccctagttccagtcttgccatctcacccttaaaagcagcccacccgaaattctcacaatctcatggtgtactgtctgttctaactttcaaaatttcttttgcaataaattactctatgctgcatcttctttgctgtgtgtctcttgtttaaattcttttaaactaagaagaatcaaggtgtcacaacagccatcaacactatgtaatatatgtgaattgttccatttaatactcatcacatcctgtgaacgggttcattcctcattttacataggagagggatgaagtccagagacgttaaacggcttatgtttggtgttgtgtggtcagcaggtggtatggctggatttggctccggggtctgggcgctcaacattacacaacgggcagggatatcgaagaggtagaatttagcacttacctgcgaggcagggatgtgaatgatgaagagctcagatatgactcctaggattctggattggcaccctggttcatgataatgcttgtttctgggtcagaggaatacagaacgaggaacatgtttggaaagttgagagagtgacaaattagtctggatatttgaattgaagtaccttgaggcacatggtaaagaagtccatcaattttgtggatctggagtccggaggactcgggcaat

SEQ ID NO: 547776 - DNA, 109 bp, Homo sapiens
ccgactagcccgacagcattgggagagggactcaatcagccgcgggtagcctctggcgggagatgtgggtacaaggcagcttccttcagccctgttgggctagtcggga

SEQ ID NO: 547777 - DNA, 344 bp, Homo sapiens
agctcgcatgtactcgctaagttcatgtacatttggtggccaattgatttgatggtaaaggacgggatcgttgacctcgtctgttatgtaaaggatgcgtagggatgggaaggcgactgaggactaggatgatgcgcgggcaggatagttcagacggctcttctattccctgagcgtctgacatgtcagtattagttgttttgtcgtgagtgtaaggacccgggcgtacaggactaggaagcagataaggaaaatgattatgagggcgtgatcatgaaaggtgataagctcttctatgataggggaagtagcgtcttgtagacctacttgcgctgcatgtgcca

SEQ ID NO: 547778 - DNA, 421 bp, Homo sapiens
ctatgtggcccaggctgggctctagcaattctcctgcctcggcctcccaagtagctgggattataggaatgagccaccacgcctggccaaaactgattttttctttaagccgttttaggtttatagaaaaacttagcagaggccgggcgcggtggctcactcctgtaatcccagtactttgggaggccaaggcaggcagatcacttgaggtcaggagttcgagaccagcctgaccaacatggtgaaacctcatctctactaaaaatacaaaaattagctgggcgtgggggtgagtgcctgtaatcccagctactcaggaggccgaggcaggagaattgcttgaacccaggaggtggaggttgcagtaagctgagatcatgccactgcactccagcctgagtgacagagtgagactccgcct

SEQ ID NO: 547779 - DNA, 325 bp, Homo sapiens
  misc_feature (5)..(5): n is a, c, g, or t
  misc_feature (76)..(76): n is a, c, g, or t
gttcncctcccctaagaagtgccttaagaattgtgaggaagtataaaaatagtcaaagctggctgggccgcgggtntcacgcctgtaatccccagcactttgggaggctgaggcgggcggatcacgaggttaggagatggagaccatccctggctaacacagtgaaaccctgtctgtactaaagatacaaaaaactggccgggcgtggtggtgggtgcctgtagtcccagctacttgggaactcgggaggctgaggcaggagaatgacctgagcccgggaggcggagcttgcagtgagcagagattgcgccattgcactccagcc

SEQ ID NO: 547780 - DNA, 400 bp, Homo sapiens
cccgattacgcgtcctatacggccagtgcgactactgcacaggctcatgtgagcccatccgcctgcaggtccccgtggaggtcgtgaacatgtaccatgcctctgtacctggtagccaccaccagcccccctcagctgctggcctgtggtcccaccgtgcaccagacttgcagtgagaacacgtatgtgaaagggctctgcttcctgtttggatccaacctacggcagcagccccagaagttcccagaggccctccgagggtgtcctcaagaggatagtgacattgccttcttgattgatggctctggtagcatcatcccacatggctttcggcggatgaaggagtttgtctcaactgtgatggagcaattaaaaaagtccaaaaccttgttctctttga

SEQ ID NO: 547781 - DNA, 165 bp, Homo sapiens
  misc_feature (165)..(165): n is a, c, g, or t
ggtcaggcactgaagcctggtcaggcactgaagcctgtggagacggggtttcgccatgttggccaggccagtctcgaactcctgacctcaagtggtccgcccgcctcagacttccagagtgctggaattgcaggcgtgagcaaccacaccaggcctaaaatagtn

SEQ ID NO: 547782 - DNA, 232 bp, Homo sapiens
ctcccagattcacgtgattcatcctgcctctactctcccgagatagctgggactgcaggtgcatgccaccatacctgggttaatatattgtgttttcagtaaagacaagatttcaccacgttagccaggatggtctcgatttcctgacctcgtgatccgcccaccatggcctcccaaagtgctgggattacaggcatgagccaccacgccaggctggtagcagtctttccta

SEQ ID NO: 547783 - DNA, 233 bp, Homo sapiens
tactactactaaattcgcggccgcgtcgacagctgggtgtggtggcgggtgcctatagtcccagctactctggagtgcagtggcatgatcttggctcactgcaacctctgcctcccaggttcaatcgattctcctgcctcagcctcccgagtagctggggttacaggcgcctgccaccatgcctgactaatttttgtatttttagtagagacggggtcgacgcggccgccaat

SEQ ID NO: 547784 - DNA, 358 bp, Homo sapiens
  misc_feature (8)..(8): n is a, c, g, or t
  misc_feature (15)..(15): n is a, c, g, or t
  misc_feature (135)..(135): n is a, c, g, or t
  misc_feature (168)..(168): n is a, c, g, or t
  misc_feature (195)..(195): n is a, c, g, or t
  misc_feature (228)..(228): n is a, c, g, or t
  misc_feature (285)..(286): n is a, c, g, or t
  misc_feature (341)..(341): n is a, c, g, or t
actctgtnacagaangtattgtgatgtatcactggcctgacacctaggtgaaggtactgcttctcctgcctgggcctgcataaattggtattttgcatgtcactgggttcaacacatgggtgattcaactctctnacatggccttgagcatggggtattaggacattnattttggtcatctcagtgatatgactnctttcctccctgaaccctgcaaaaaggattgtncatatcacttaaccagactaagtgatagactctctgctagcaccctatttgggatgnncatttactggccaacactatggaggtctgctagcctgcacattattgcatgattnatcatcataacatggaa

SEQ ID NO: 547785 - DNA, 196 bp, Homo sapiens
agcaccacttcgaggactgttcatgaggacatcttggactggtcaacataacgagctgcggagaccagttcaggcgccgccagcagtgtccgggacagaaagagctcgcgagtatgatgacgcagtgaaactgggaattaggaggtaacacaaggagcgtcctccatgctcttaagctctgtgatgcccagacgat

SEQ ID NO: 547786 - DNA, 820 bp, Homo sapiens
  misc_feature (429)..(429): n is a, c, g, or t
ctcagggtattcctttataggcaaacacagactggagggtacaactctggtctggtggcagagaacaggttggatatgtactgggttaaattttggacagggatcgcttggggtatgtaacacggtctcccttgggtccttcttcccttttgggaagccacagctggacttcacgaaggagcaaatggttctggccgtcctccagaggttatggtaagtccggcctacttcgggagaatccacgctgaatggggccaagcttccgtctcacacaaccacacagtaaaacgtgaatactttgggcttcccatcctttactccatattttcagaactgggaacaaaacgggatggctatattatttgggcatccccatcccaaacagccaagcaacaccccaaccttaacatggcgggcacatctataccnattaatggccattgggactcctatgcttcttggacaggcagggaatcaggctctctcttctcaaccttcactattccctagagtaagggtggcctagagcacaataggtaaatggctcacattttctatcctaacattcgggcacgagggggtctggtcttaatttttctaaacctggaaattcccggaaaaatattccctggtggcccccattatgtttttttcctctggaatgttaagtttgggcgtgtgctgttgggattatctcttagtaatacctccatttttttcggccccgaacttcttcaagtttcctgtctaggagtcaggctgactctcagctgggctttagacctaagattaatacgtttatcctgattttcctcctact

SEQ ID NO: 547787 - DNA, 128 bp, Homo sapiens
  misc_feature (68)..(68): n is a, c, g, or t
ctcaaatcggctgattctgcatctggaaactgccttcatcttgaaagaaaagctaccggtcccttctncagccacccagccccaagatggtgatgctgctgctgctgctttccgcactggctggctct

SEQ ID NO: 547788 - DNA, 659 bp, Homo sapiens
agacgtgattgtaaatcacccctctgaagattttatcatgtgctcgcgcccatatcattggggagagggtggaacctccttgaggaggaaaaagtttttttttttgtagtgcgcctgccccagcgttttgcagcattgagaatcctcggcaacgattgggcaatgactttaactaagaatacttacgagaactattgagatctcaaaccgtggagcaggtggattttggtaacgcaggtctgaacactttcacataggtattggccctagcaaaccgacttggagtgttgttattaactatcgaggggtggagaccatgttttgccttgagcccctattctgaattcatcgagccgacatgagttattaacgtgtcctcattgcaaaacaatagaacaccgcgggggaccattaattaatgggcctggttttctgacaggggaaacttaccatactgggaccggataggaaacttatcttatgggttttcaggaacggcggaacccgggttttggtcagccatatgggaaaatcaaaaacacaatttaggcgcggggaaatttaacttccgatctttcaccggggccaaataaaacctttttttgggtggaaaaaagaaatttctacatcttcttttatatcaaggagaggtaccaacc

SEQ ID NO: 547789 - DNA, 156 bp, Homo sapiens
tctgtgtatcagggtgcctgtatccccatcgttccaggtgtacaaggcatgagggccgggacagctttcctctcagtcatagttcaccccacttgaaaattcagacaaggtatagccgagagacaaggtagagccgagagacaaggtagagccgag

SEQ ID NO: 547790 - DNA, 757 bp, Homo sapiens
gcctgcagtgaccgtaggcagccatggcgcccagcctggaatggcatggtcttgaagccccacttccacaatggactggcagctggcgctgtggccacgtggttcaaccatgcctgtgccctgtaatgatcctgcagacgtaagtgccctggcaatgccaattgctgctgcctgcatctgcccctgctgcccctgctgtctgtggtcccatcctggcccatctgttgctgcttgccccactgtgttctggtacctacactgaatgtgtgctgctgcctgtgcctgctgtgcttcatgccttggtgatgtgatgctcatgtggtgtgcctggcattcacaatgaatgtgttggccctgtgagccatctgtgcactttacttagttgtgactcctgatgtgatgtgctgtgacacaattgtccactgtgatgtcccttgcatgtgccagacgttgcaatgctgtgctttgaatgtgaggtacctgctccaaaaactcatcctcttccccagtgaatgccctctgtgcccccaatgaagtggtgacatgttcttgcttgaatggaacttgaaacttgggccacccagcttgacctggacccgtgtcattgccctgtcctggaacgttctatcagagtgtgaggaaatgcctctgagtcatcactttgatgaaacgagaagaaatttcaaatgccttcgctaagtctccagtattggccctgtcccaactgccctggttcttcggcatacgtggcaactgg

SEQ ID NO: 547791 - DNA, 130 bp, Homo sapiens
atgagctggcaccagataagatgaatatagcagcagtgaaactactggtgaaagccagagcagaacgatgatgacaccataaaatctcaggaggaagatcagccaataattattaaaaggaaaagaggaa

SEQ ID NO: 547792 - DNA, 109 bp, Homo sapiens
ccctggacgctaattatgagggaggcgtgtagcttcttatcattgtaactatgttatttagaaataaaacgggaggcaggtttgcctaattcccaagaaagaaagaaaa

SEQ ID NO: 547793 - DNA, 949 bp, Homo sapiens
tttgtttcgagtactgggtaaaagatcggccgggaacctcgtataatggctcatgtggtggaggcgagtaccagtcactacgaccgaaaatttcacggtaccatattaggcaatctttcgacccaaccatgaaccaattcagctcattctccttttcatgttatacgtctgaatcctcgccttttgaacctttgggatactcgttgaatgtactatacagtagatcagtgagtttctgcaatccgatattctccgactggttttcgttaggttatagtacgtttaagataacatatttagagcgagatttccggcttttttattcgcgagctgtgcctgagtatcagtggtgggcagtggattttagatgcgtcgcagccgtttcctcggtgcctaagatcgttgattggatggacaactttaagcttgtgggtttgttgaacaattatagatatgcttcgcttacgtctaacttctttggaaggctctcaacttttcaggacggatgcctgatccgcatgcggtatcggcttgctcgtcgagtctcgcaaaactatagtacgacgattagcgggactacgaagttgattgtacaaccgaacgcccgcaagtacgagtctttgttccaaccctgttcgtggaggtccgattgtgtcagtctttagctttgcatgagagttgtcaagcgaatccgtaccttcaaaacgccgtaagaccgatgtgttattgttcccttctgaatgagcaccgacgttgggatgatcgagttttaataaagtgtgtaccaatgcgaaacccctttaatactcccctagagagtcacgtatcgaactcatacccaatgggaaaagattgtgaagcctgtggaaagtttcagctccccgagttgggggaaaaccgctaaactggcagattaggatttttaaaataaagattggattataactct

SEQ ID NO: 547794 - DNA, 381 bp, Homo sapiens
cgggacagtcagtaggatcattttcataaagcaaggacatcatatgtttctagaaattacaagcatataactttagcctacaatcttttattaaaaatttttaacaaaattgtattacaaatgcatttcatcagaactcaaatttaaatggtgtttgttttgggtttttatttataatgctgaagttattccatacaagcctcaagttaaacacaattcattttgattggtaactatgtgagttttcaaaatcttgtgacccagttaagagataaatcaagcagtgatgcatccctatttattgcaccctttaaagtgtgagatcattttttagaatcttggggccacgaataaagttatattctgattttaaaaaacaaa

SEQ ID NO: 547795 - DNA, 703 bp, Homo sapiens
  misc_feature (556)..(556): n is a, c, g, or t
ggacaagtctgtggctcgctgagtcgtgtgtgcgtcctgagcctctgatctgtgcagtgtattaacgtttcaaggctgaatgctactggtcatttcgtctacaacgctggacagggacacttcttacgtggtcccgttcttgcggggtcctggcagaggtctaggaaacgttcatgggcgctatgagcttatgcttctaaccttgttcttaggctcgaagtctcttggctaagatacatgcgtgcgttctgtcatgttgctatcgaaggtaggaaccggatttgcgtaataggccgttctcacatgggggttccattccttcaaaattagtgtagaggctaagagccctgtgactccacatgtgcttgattcattgtgcatacgaaggagtgatcacaccagaactcttcccgtgtctctctacgtgacttgatttgacttgttgatgcaatccattttacgtgcctcctcgaggggacatctacctgcttcattctcgctggttaatacgaggaggaggaaactacgagatacgtttgacttgcctcgcaacagnctcatacacagaaacaccaagaccttactgagagaggcacacgcggccacgatccaggacaagggagaacgaaccccgagagaacggggcgattggcccacaaccaaggttggtgggacggcttgtggaaagcggttgcgcgcggcg

SEQ ID NO: 547796 - DNA, 467 bp, Homo sapiens
tctgctatgactgtggaaagattacatctggggatacagttatgactatatgacctattagcactgagtaatacagttatgacctatgtcatcgcgcgtgacgacgtgagtccctttatacagtacaaaacaagtgttggaattggggcattttagcacaaagtaatctcatttacaacttggaacaacacttggggcataatctttatacaaccttacatttccaaccaccaaatttctaatggtctactctgatttctcttattattgtgtatgttctcattgtgacatcatctagcaagagtagttacaaattgttgtcactagaccagcaagaattagcatcaccttgggaacttgttcacaaatgaaagattcccatgctgtaagcactcattgaatcagaaagtctgggcgtgaggcccagccacatggatgcacaaccccggaaggggctcctctagact

SEQ ID NO: 547797 - DNA, 299 bp, Homo sapiens
atatctttcttagaaacatgactaagaggaagatttataacgtgagggagttttgtatacaaattccttttacaagatagcatttataaaaaactctatttgttcttttaagaaacttggaaaatacctagttgtttataggtattcaatattcactcacaccaaaacatatgcccagagatgcaagttggatatgaactagaaagagctattcgtcaaaacgatggaccaggaatcccctctctgagggaggatcatgtaaagatcacaccatattaaatatgtactataacacatct

SEQ ID NO: 547798 - DNA, 121 bp, Homo sapiens
actctagcaggatcccccctccacatacacaggcttcccatctaaagtcatgcttaacttaacagggaaaaaaaagtgaaccaatgcaataatgtatattgacgtatccgtgacatttgca

SEQ ID NO: 547799 - DNA, 478 bp, Homo sapiens
acctggaggtaagcttgtgtgtgcaggagatgccctcttagctgaggcttaaagaacagcagcaagacagggaaagggaaatccatgtgaggtcataagaccagcatttgaaggttcatttacgtgggccctgactaacccaactagagtggagacgctgagctgggaagcagtaagacatgaggacaaacaggactaaggaggagtaaggaggagtaagaaggcaaggtctgaatgccagatgaaaacagtctcaatccaaccaaagaccaattcagaaccgatttaaggcactgggtatggagaaaaaggcctgagaagtctctgaatagggtttggaatataaatacaaaggaatcaccaagtgcggtggctcacacctgtaatcccaacactttgggaagctgaggcaggtggatcacttgaggccaggagttcaagaccagcctggctaacatggcaaaaccccatctctacc

SEQ ID NO: 547800 - DNA, 401 bp, Homo sapiens
  misc_feature (41)..(41): n is a, c, g, or t
  misc_feature (53)..(53): n is a, c, g, or t
  misc_feature (59)..(59): n is a, c, g, or t
  misc_feature (61)..(61): n is a, c, g, or t
  misc_feature (64)..(64): n is a, c, g, or t
  misc_feature (89)..(89): n is a, c, g, or t
  misc_feature (95)..(95): n is a, c, g, or t
  misc_feature (99)..(99): n is a, c, g, or t
  misc_feature (123)..(123): n is a, c, g, or t
  misc_feature (160)..(160): n is a, c, g, or t
  misc_feature (166)..(167): n is a, c, g, or t
  misc_feature (170)..(170): n is a, c, g, or t
  misc_feature (173)..(173): n is a, c, g, or t
  misc_feature (202)..(202): n is a, c, g, or t
  misc_feature (230)..(230): n is a, c, g, or t
  misc_feature (257)..(257): n is a, c, g, or t
  misc_feature (291)..(291): n is a, c, g, or t
  misc_feature (316)..(316): n is a, c, g, or t
  misc_feature (391)..(391): n is a, c, g, or t
  misc_feature (393)..(393): n is a, c, g, or t
cctcccccctgccttcagtaggatctggctccgtggctggnggaccaaccccnatagtnanatncagagcttaacgtgtactgcttgtntgtgtncgtnagtgtgtgtgtgtgtatgagtgtntgttccggctcccaccctctccccatctgctctgggnattttnngtnttngtttagttttaggtttacaacagagagtnattaatttatcagcagcctaaaactggngtgtttttcttatggtttaaaaaacgncatgtcatttataactccctttctcccttccctnctcccggtctgctgatcactctttnatgcctgtgtattcagggtgctctgtttcccaccgttccaggtgtacgaggcagagggccgggacagctttcctntnagttcatt

SEQ ID NO: 547801 - DNA, 754 bp, Homo sapiens
tttggttttcccctactgtgatgtgatgtgtgtgtgtgagatgatgtaattttggataacatagtgatgtaagtttggaagccgccctcattcttaatagctaccttatctatctaaaggaatcaactgctaatcccatcagtaaattactcttagtaaagacaaagggttagggctgggcaccgtggctcatgcctataatcccagcactttgggaggccaaggtgggtggatcacctgaggtcaggagtttgagaccagcctggccagcatggcgaaaccccatctctactaaaaaaaatacaaaaaaaaaattagcagggcatggtggtgtgcaactataatcctagctactcaggaggctgaggcaggagaatcacttgaactgtgggaggcggaggttgaagtgagccaagatcatgccattgcactccagcctgggcaacaagagtgaaactccatctcaaaaccaacgaacattttccccggattataagagtgccctcctcctctattactataaccagatagagagtcaaaagcttgtgtgtccacccgagtttctacaaagcaagacacgtttgcggggcttctcaattgccggcaaaaggtgtggccctatcagggggggccagttcggggacgaggctcttccaggagaaagtcagagtcagacatcaactgtcattataaccggggcgtagcgcttggacacacgttgcatgtacgaaattctcccctatggcgcgacttc

SEQ ID NO: 547802 - DNA, 820 bp, Homo sapiens
ccacagtcaggaagcagagagaggcagccgccgctgctgctccgcttacttcctcctttttattcaggagaggagcttatcccgtggaaggctaccacatttagggtaggtctccttggctgatttactcagaggtttgtcttctaggcagttctcgatcctgtcacaggacatccctcaccccgctgtgtggctctgtgggcagcgttggggatgccataggtggcatcagcacttgccttggtgaggggagcctagatgagaatggtgggctctctgacagggagggggcattgggacggtagctttggcttttcaagtaaggggtatcgtgctgagggttggaagggtggcagacctccatcttcacatccaggagggaagtgaggccaacatggccaacagccagtcagccttacatgctctcagaagctgctgtgaaggtggagaactaactattagacctaacctcaccgttcatcccagttcctttttcatgtccgttttctaattagaagcagcaaaaggatgcatcaaactgaccccagggcgacccagcttgagctctagcctctcctctgaagatgactcaaacgtggggaaggcaggtgctggcctgtgctaaagacaccaagagaggcttgaggcctgagggcatggtcttgcgggcatcggttggtggtggtgattgtggtcttgggtagagagacgggacctgcgagatcagtagtgcaggtggtcagtccatgttcacgatgctgtaatacgtgtgtgtgtttgtggtgtgtgttttacttttaggtttatgttgtgccctttc

SEQ ID NO: 547803 - DNA, 435 bp, Homo sapiens
tcctacacaatacaacagaccactctgcgcatccactccccctcaatataggacgggctgatggatgctttggtaacggaagacttaaagtatacagggttggcaccgtgctggtcaatgtgggtatgcaggtacacgaacacagcaaagtgagtggaagtgcgtccctgtgtcctacaagctttgagcgggcgcacctgtttgccgggggagccataactaagtgtctcccaggtgtgtgtgtggctgtgccttcctctcatctctctctgatctctgacccttctggacctccgacactgtgtctgtgtgtgtgtgtgtgtgtgttatgtgtgtgcacagcagtgtgtgccgtgcaacgtgtgtgtgtagcagagcaatgtgtgtgcgtgtatgtgcacatgtgtgtatctctttccctctcttgcagcaaag

SEQ ID NO: 547804 - DNA, 1694 bp, Homo sapiens
  misc_feature (995)..(995): n is a, c, g, or t
  misc_feature (1000)..(1000): n is a, c, g, or t
  misc_feature (1027)..(1027): n is a, c, g, or t
  misc_feature (1664)..(1664): n is a, c, g, or t
ggaggcaggtcagccgtcccccggctgcagctgcactcacatgtggccactgctcaccatgcacataacccagctcaaccgggagtgcctgctgcacctcttctccttcctagacaaggacagcaggaagagccttgccaggacctgctcccagctccacgacgtgtttgaggaccccgcactctggtccctgctgcacttccgttccctcactgaactccagaaggacaacttcctcctgggcccggcactccgcagcctctccatctgctggcactccagccgcgtgcaggtgtgcagcattgaggactggctcaagagtgccttccagagaagcatctgcagccggcacgagagcctggtcaatgatttcctcctccgggtgtgcgacagggtaagaggattaaatgacacagtggcacctggcacatagtaggctttctgctgtgcgctccccacggaggcgggaggcgcctgcaccgtcctcggggactccgatcgccgttggaccgaaatcacctcggtggggaggacctgaccactcggagttcgccgacttgcgctcgggggtgacgggggccagggctgccgcgcgcaggggtctggggagcctccgggcggagcgacccagcgagaccccgccggctcccggagtgtcctggggaccgccacctccaggagccccggtggtgatctcggtgaagcaggaggaggggaagcaggggcgcacgggcagaaggagccaccgagccgctcctccttgcggttttgcccgcacgcgcgtctgcccgcccacctttcctggggcggatgcgttcccgcagtgaccgcactcgcgattgtagaaaattcgctcccaattgttgaatgcttacataaactgcatagttacccatattttctactgttctcataagggaaaaagaaatgatttggaagaaaaaaaaagcctcaaactaaacaaaaacaaaaccagcagccctggctaagctttngatantggaaccattataagctgacaagctanattttcacctgtggatttgctggacatgagcacaagcctaggcttccaatttgaatttcagggctgtagtcactgatgtgtcacatttagtgaaggctctcggccccccggcagccgcctggtcctgggtcactggggagaattctgggtgggtggaagaggcgaggagcactgtgatgggcgctgttcacactccggctccacccagcgccagctgcgacaaagccctttacccctcccaggccaggtgtttcttctgtgtgaaagaggagcttgatccctactcacaggttccttaattcattgctcaaatagggaaacggcaaggaaaaagacaaattctgttctcatgaagcttaccttctagtgggggaagagacaacaggtaactggtatataagagggtagaagggccaggtgcggtggctcaatgcctgtaatcccagcactttaggaggccaagatgggcgattcacgaggtcaggagatcgagaccatcctggctaacaaggtgaaacccccgtctgtactaaaaaaaaatacaaaaaattagccgggcgtggtggcgggcacctgtagtcccagctactcaggaggctgaggcaggagaatggcgtgaacccgggaggcggagctngcagtgagccaagaacggccacggcacccc

SEQ ID NO: 547805 - DNA, 1282 bp, Homo sapiens
  misc_feature (847)..(847): n is a, c, g, or t
agcattggggacaagggtggtcagtccggtcgacattgcagcgttgtacatccataagtggctttcaacatgagtagctaactggttgcggagtgacaactttccatggcacagagttaattggattggtagcgaccaggacagcaagtatgctagggattgagctgtattgagcatatatctaacatggtcctttgaataagcatatcagaacatgaccgagcaagtgacatgcaactattgatacagtgctaggcagcaaaggacgacttgcgcaggaaaaaggtcagctgagcccagtacgattctaaccagaggcgtgtaccacatgtgcaagtaggcatgccgtgaagattgcctggtggattatccatggggtagggaagggtaagtcgtgcacattcacacataccttgagttgggattggcctgtactcgtacaaggagggacgctctagcacaagtatagaatacggaaggctttgggaatgtcagacgccacaagactcaaaagttggtaataaattgtaaagcattatgtgacccaaccacaaattataaaagaagccacttggaaagggtccctagaattatccgttaaaggcaaagatcactgtgctgagacacgatttctctaatactaaaagttccagaagctcgcccttactatgtcagaggtttactggggaccattacttcagataactatggaaattagtgtggaccacgattagttgccaccaagggaggaattggtagcgatcaatcgagtaaggcatcgtcttcactataaaacaacttgcttcattggttaaaccctgttgactatatgactgatgatcctttntagagataaatagactccatttgagaatatacgggcgaccactgacctacacattcataccaatataaggtggacgagtacagggtccaactaagatatattgccctacagacggggagttccccaagactattcttgtggctctgcccaattgttcattctgacactaaaattattgcggcataatttaacgcgggaatggttctaagaattttgcaattgcgtaaaacggaggtttgagaactgcgttcggacttgactaagattggttggctgtagctgcggaactccagtggaataagtttctgaggatgcttaagggagaagagaggagcgcaaatatagttcgagggggtggagtagagcgatagatgtggacacaggaattaccttggcggagaggaattgtagaggtttgaaagaggtaaattctta

SEQ ID NO: 547806 - DNA, 580 bp, Homo sapiens
ggaggcaggtcagccgtcccccggctgcagctgcactcacatgtggccactgctcaccatgcacataacccagctcaaccgggagtgcctgctgcacctcttctccttcctagacaaggacagcaggaagagccttgccaggacctgctcccagctccacgacgtgtttgaggaccccgcactctggtccctgctgcacttccgttccctcactgaactccagaaggacaacttcctcctgggcccggcactccgcagcctctccatctgctggcactccagccgcgtgcaggtgtgcagcattgaggactggctcaagagtgccttccagagaagcatctgcagccggcacgagagcctggtcaatgatttcctcctccgggtgtgcgacaggtaggccaccttgcctcctgagcagtgctggccccgctagctctggcttccctcttggggggcagggaagagcaaattacgagaccaagatggctccaccttcggggcgcctcaaactaggcccaaggcagacatccagaccgcccaaagcagggtccccaggagacaataaaatcatgagggaaac

SEQ ID NO: 547807 - DNA, 168 bp, Homo sapiens
cttgtcggcatttggtaggggttttttattgaccaaatatgttcccacaacctagttttttgtgactactaatatagtagagtttaaattttatcatcaaatctatagacaatttttgatgaaatagactcatctctatgtcctgcttttctcctcttattaatacat

SEQ ID NO: 547808 - DNA, 190 bp, Homo sapiens
actctagaggaccccgatgagaatatcaagatcacactggttgactcaaggacatcagaagtcaaagagctccggtcttctcgttgtcttcagttccgtagtattgctgcaacccatgcagcgtcaacttcgtctcatcatccacgaagatctccattggatcttgcatgaacttgcggcagactggacg

SEQ ID NO: 547809 - DNA, 1403 bp, Homo sapiens
ccattccattccattccattcaattccattccatgccatcccattcgggttgattccattccattccattccattccattccattcctttccattccattccattccattccactctggttaattccattccattccacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaa

SEQ ID NO: 547810 - DNA, 105 bp, Homo sapiens
ttcactgtcagggctttcatgccctacaagttcacgccagctcacacacatgcccacatggaaatggaaaagggtggaagcaggcatgaagggcctcgacatgaa

SEQ ID NO: 547811 - DNA, 226 bp, Homo sapiens
gaggaaagaaggccgatttgccgggccgaacttggcaactccttctcggggcggcccccttggccccttttcctttcccttccctttatacaagccccttccttcccggcccttccttaagcccggaagggccccttccccttggaggccccccaaagaaattaaaccccctttttccaaccttacaaacaaattttctttaacggccttgttcaatttttccaca

SEQ ID NO: 547812 - DNA, 389 bp, Homo sapiens
cccctatgggtccctgccgcatccacacagtccgtgtgtggggaggttacaagaaataccgtgccctgtaggttgtacgtggcggaatttctcctggggctctagaatgttagtactcgtaacaacaacggcatcatcgattttgtctacgatgcatctcataacgagctggttcgtaccaagatcctggtgaagaattgcatcgtgctcatcgatagcacaccgtaccgactgtggtacgattcccactatgcgctgccctgggccgcaataagggagccaagctgactcctgagcaagaagagattttatacaataaacgatctagaatacttcagaagaaatatgatcaaaggaaacaagaatgccctaatcagcagtctcctgga

SEQ ID NO: 547813 - DNA, 1325 bp, Homo sapiens
agaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaa

SEQ ID NO: 547814 - DNA, 415 bp, Homo sapiens
ccgtataccctattgtccctcagtataatagcacatgtgtaaacttacttctacagaggaaatgactttgtctattcaaggtataaaggtaagtggtatttctggtaagaaggctatataaggagaagtattggtagacacaaaaaatctgtatggtacattcttgtcctaaagtaaaatgactggtggtttaaaaagagggatgtttaggacaagtaaaaaagtccaagcatgttgtaggtggtctgtgtaagtggttaaaaaaagattggtgaaagggaatttatgaaagaactactacacaattttaaaggttactatgccatctaaatgcttcacaaactgccactatagctcttaacagtacaaattccctgctttaaagctaggtaaggccttggaacatacagagtta

SEQ ID NO: 547815 - DNA, 1603 bp, Homo sapiens
agaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgagtgttgaattttgagttatgaagcaatttcaatgggaaagtgcttgactgctaagaccatgtctataactttacactatgtgaactgttctgtatttttctctaggattttcagtaaaagctaaaccccttacagaatgaatgcataaggtatgcatggaagaatgattgatagggcagctaaaatgttatttactgaactgatagtagtatcaaactttgactgaaaggtaaattaggtgttcacaatctttgaccgcatctctgtcctccaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaa

SEQ ID NO: 547816 - DNA, 1681 bp, Homo sapiens
catcaggaaaccattttatcagaattatccagatgaattatcattaatagtaaaaccaacacaattgatcatcaccagatgtcaggcatgatgccaggtgctctacacattatttctcttccttataatagttcttcaaagtaggtattattttttgtctccagtttgcaattgagaaaggttaacttttctaaggtcgtatagctaataaagctgagattttaaacctgggtcttttttctacagtacattgcctctacaaaaggcatcttgttttaatgctgccaaaatcaatttgtttagattgtcttcgcagttttaccgacttagaagaacttgatgagacagagttatatatgtgccataaatgcaaaaagaaacaaaagtccacaaaaaagttttggattcaaaaactacccaaggtgagtgttgaattttgagttatgaagcaatttcaatgggaaagtgcttgactgctaagaccatgtctataactttacactatgtgaactgttctgtatttttctctaggattttcagtaaaagctaaaccccttacagaatgaatgcataaggtatgcatggaagaatgattgatagggcagctaaaatgttatttactgaactgatagtagtatcaaactttgactgaaaggtaaattaggtgttcacaatctttgaccgcatctctgtcctccaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaa

SEQ ID NO: 547817 - DNA, 870 bp, Homo sapiens
ctgtggtatgcgccgtgccccatgttacctggtcccgtcggcggttgggcccctattctacatatatgttctggcgtgcgaatcggacgccttcgcggtccaaactgcatgatctggggattttccgccgttttgtgcatctcccagggcccacccaccctgaggcgggcccgcgccctgggtttgcccacacggtgtccacagaagtgcccaatcttgggcaaattgggacccctctgggattcaaaagccctgggcggtaaccctcaagaaggaggggttcacgcaccacaacggatgtgggccgattccccagcaagggtggcccaaagttccccaaaaaggcgttttaatagtggggcccaaaaaatccccaattttgggcgaacacccgctttgtaatttgggccctaaaaggggccggttccccaggaaggggcgttcccaccccggcccccgcaatccttgtgtcgccaaatcaaacccctcctcccgtgtggggggaagcgggcaaccccggaccctccggggaatcaaaggaatgctccaagaaagagccgcaaattaatttttcatagagcaccaagaaacctgagtggtgtccccgccaaatagagaaaatggcgtataaatcacccgtgatttgtttaaaaaatatcattgggtgttcccgttttcccaattagggagacctggacttgagccccacagtatgtgaagttatatctgctcgattatatgggaacattcttttgttttgggaagtccctcacctgtaagacctgatggaagtcccacgattatttccggggcccattttcccctaaaggtttttaaaaaaaaaaaatttttttaaaaattttaaaaaaa

SEQ ID NO: 547818 - DNA, 1518 bp, Homo sapiens
tctcaataaaagattggatttattcaaggttggtgaaaactttctaacaagggaaactcttattagatgcgtgcagtgtacgggggctagtggaccacgcacatacagccagtgcggtttcagaaagacttgaaaggccatggatagttataaaaactctacacccgagggagaatcgaggaagacaatttaaggttccatctggaatccagaggtggcttcaatattaatatggaacggctcccatctggggcaaataataagctggtgaaacttgggagggttatccaagaagaaatgggttgggtggatgggataaattcagaatatggtccttccccaaagggtggggtgggtgtttataaaaaaggtgttcagggtgcaacaaccgcttgggcaagacaaaccacctggatgcgccacaagaaacacctgagattccgcgggtccaggggaaacccaggggttcttcccaaagttccccaaggggcgcctggggtgtctcccccaaacgagatgcaagtgtctcacgggtgcgcgtggtgaactccaagagagggggctccttggaggaacgtggagaatagcgggagaacgccaccttgtggaggacgctgtgtgaccacccaaatacgaggtgccaatacatgcggagctggggcacgtggctaacaaagagtgactccaaatgtgacctatgtgtaacacaggggcacacaacgagggtcaataaaaccctttccctctcggggagcctccccaggtgtgccaccccaatatttctttccctcattcaatctggcaaggcaacatgcggcgcgagaaaatcaaaagacggtgcaacagagggaattaccctaggaatttggaatcaccaggacgcagaaactcttgagagaaaggggccccctgaaagggcacttggggttggccccccaagcaacccaggggatagtgcgcaccactaggaaaggggcatagacacaccttaaggagcatcaagacacaaatccacaaacacaacacaacaagataccaagaagaaaacaaagggggccttcccccgtgggatattccccaaagaaacccccgggtaaagggtgagaaagcaagcccccaaaaaggagaacccccacgcggacaccacacgcacagtgatcctggtcggcgacccacggtaataagctaaccaccttataaaaaaaaaaacacccaattaaacaccaacaggagagggagggaggacgtccaggagaggcaactactacaagagggcaagaaactaagtgaggcgccgcaggttagacacacgagggtcagaagaggacgaccaccaacacgagggccagacaggagacaaacacacacggcgaggacccgcgcagcactgagagcgacggaacacaaaaagcaacgtcagacaaccaccgcagctacacgagcaacacagccgccggagcgaggccccaccaacaagagagccaacgcaagagagaagaagaagcacacaagagcacg

SEQ ID NO: 547819 - DNA, 123 bp, Homo sapiens
aagcttttaccgcaggtcatcgaatagcaggaaaaaaagagtgctcccttataccgaagtgagtcgaagatctattcttaaattgactttgctatttatattccgtaatcagtctaaaagcat

SEQ ID NO: 547820 - DNA, 2187 bp, Homo sapiens
  misc_feature (1154)..(1154): n is a, c, g, or t
ttttttaatggagtcttactctgtccctcaggctggagtgcagtgtggcatgatcacagctcactgtagcctcaacctcccaggctcaagcgatcctcccacttcagcctcgaagtagctggcaccaccacacccagctaatttttaatatttttactagagatggggtttcaccacgttgcccaggctggtcttgcactcctgggctcaagtgatccacccaccttggcttcccaaggtgctagcattacaggcatgagccaccacgcccagcctgttctattaaaaacatcttgaccttttttttttttttttaagtttatgatataaaaacagtctggtggctttccctcaggttggatatctgaagttgtgggagcagatgtagctccatttccattttaatattaactggataaatcccacatcttcccagaacacatctgctaaacactttaacatgacaaggagcaaattacaattatgtgtaaacttatatcatccagtacaatggcccctagccacatgtgactgaaatttaaattagaaactcagtgccttcagtcacactagccacatttcaagtgctcagcacccacatacggcgtaggacaatgctggtctaaattttcactccaaagaataaaactttgccatcatgtttaggtcttacaactttgagtcctaaaagataatagggagatgtgtgcttaaattaatttacaatgctaaattatattaggttaaactgtatgaaaccctgctatttgatgagttctgatctacaaaaatgacagctccacctgatctgatgtatcacacattaacatcacatctaattcaacctgaaatgtgagtctcctttgatcttgcaaagtatctcctatgaatccgggctcttttgcttagaaggtagacagctgtaacctctaacattgatacttcgatcttcagtctctctgaatgggcagctgttaaacagtaaaggcctgggcagagttgatggtgaaaaaaagctgtatttttataccaaatggaactttagcaacacgttggactactttgtcgggcagagtggtcttcagacaggtgatgctgttggcttaagagatgaacacgtcttctctctgaatttgtttttattggttggtttnacttgaacagaaacgtttgaatggtgtgaagattctttagaaaagtgattggatccatctcaattgtgcacttgaacagcagtgatgtaaatgtgcttatttgtgttttcatttttaactgtgcagccttaccacacctattttgaaagctgatcttttgtcctcttcagggcttttcccttgtgccatgttgtctccagcaatatatgtggcttctggctcagagcttctgctgaggcagggcctcgcgctgagtcacatggctccttggaacaagaaaactttctcagaagtccccacacgggtgggtgacagaaacagtttgtggcaacacaaatctctctccatggtggagaaacctttgcttatccactgtattctactcagtgtatagtgatgacagatgtactagaattaaaccagtcaagtgtactggcccagggtgagtgttaaatgtgtatctcgcctgtggaacctactcagcagcttggtttctggggttgggggcatatttatttcttaaagccaaacctctccttcattggtttagtgtacataagtctatttacatacacttatcccactttaatctccaccagcccctaaactctctcctgtaccctctgttgctgaagtggcctcttcacctgggccctggaaaagccgatggaaaaagtctgttcctgcagccaaggcctgggtcccaggtgactaggagtagccataggaaggtgaggaaggagaagtgggcatgtggtgtcatctgtagtccaaggtctctgcgtctcgtcagtgggtgcagtgccttccccctcaggtgtgagcgtgatggactctagactgccttccatgagtgttggtcatgctatgatgtcatcatttgccattaaaacccagtttgtatgatgccaagaggattaattgtgcaagtgactgattcatttaaattgtaatcacatcccttttctgcttcaccaacctgaactgtttttaaaaatatcattaaaagtctgttctctttccttttgaaaaa

SEQ ID NO: 547821 - DNA, 409 bp, Homo sapiens
gcatcagtgcagcccaataatgtgatcagatgggcttgtgggtcctgatgggtctcaaggcttcgaacagtcgaacagataaatgctggcaatgaaaagatgccgccgtggctgccgtgcaccgtcctcctgggtcgtccggccaacgggttgcactgccgtggtggacagctggacttgagcagagggagcgacctgacttacttgacgctgtgatccctcccttgtgccgttccacacctggtgtagaccttgaatcgccgcgcattgacacgtgtggactcgtccacccacttctcggcctcattttccactgtcgtatttggcacatcgacaaagggctgtcaccaaagtctgtgcgagcacgggaatgggggagcggcttaagctcagggtgagtccagccacc

SEQ ID NO: 547822 - DNA, 2289 bp, Homo sapiens
  misc_feature (2032)..(2032): n is a, c, g, or t
  misc_feature (2232)..(2232): n is a, c, g, or t
ccattccattccattccattcaattccattccatgccatcccattcgggttgattccattccattccattccattccattccattcctttccattccattccattccattccactctggttaattccattccattccacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaatacaagaattactctctttgttggtttttttggttttggggcatacttgtttgcggggaggtaagatgggagtaaagaccaaatacatgtaatgtttaaaaaaaatgctgtgactcactgacatggtataggtgttaccagtgaggtaaagccatggcgtctgcctccttttgaatcagtatctcattcccccttagttgtaccactggaagtcacgacatgtccattatagacttacttactgcttgtgtttggcatctgagtctgaggtgtgaccctctgggatttacttggatcatcacccgcacttcagtttatcactggggggtgtgcttccacaggaggaaatttagaatcttcgctgctctgggttttaacacctctctctggcctatcctgattgataggacaagttgaaaatactgttggagtaagtaagtggagttttcgttttgttttttgggggtttttggagacaagagtctctctctgttgcccaggctggagtgcagtggcacgatctcagctcattgcaacctcggcctcccgagtagcaattctcctgcctcaacctcctgagtagctgggattacaggtgcccaccactacacctggctaatttttttttngtatttttagtaaagacgggggtttaccatgttggctagggtggtctcaacctccctcctgacctcaggtgatccgcctgcctcagcctcccaaagtgctgagattacaggcgtgagccatcacgcccagacagtttggtttttaaaaaacagatttaactcaaagattcaaatctggaaccagaatcccatttaaaganagcagttgtggttctacaagtgttctaagacagtcctgtggtggttttttttttctt

SEQ ID NO: 547823 - DNA, 376 bp, Homo sapiens
  misc_feature (1)..(1): n is a, c, g, or t
natatagagtgtaaaattgagacatgagtaataatttgtttacttaatatgtctttcttgtctaaatctgaagatacccttaagttctatcaaatggaaaccatgtcactacacccttcccatacaaaacttttgcaaaagaggaaggccaggaagcatgggcaccatatttctacagccatgattgcccatcacatactattcagttaaatgcagcctttaagctaatccagtctgaaaagctcatcgtgcaacctgtgcatatctaacgagcacatgtgtgaagaagactcaaaatactctatatatgctatgtatgcatcctgtgcattaatccgcgtttccgcgtgccgtattcgtacagcccgggggatcc

SEQ ID NO: 547824 - DNA, 3335 bp, Homo sapiens
  misc_feature (1549)..(1549): n is a, c, g, or t
  misc_feature (2636)..(2636): n is a, c, g, or t
  misc_feature (2641)..(2641): n is a, c, g, or t
  misc_feature (2668)..(2668): n is a, c, g, or t
  misc_feature (3305)..(3305): n is a, c, g, or t
ccattccattccattccattcaattccattccatgccatcccattcgggttgattccattccattccattccattccattccattcctttccattccattccattccattccactctggttaattccattccattccacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgctcaactcgtgggcctcctcagtcaacaggtagcaagctcttacagaatccccacgatttggagctgcagtacctgggccaggatgaagtgacctcgcagggcccgagtcctcctcggtaaatgagtccactcggtcccatggggcggttgggtagctttaacaagccagtgagccccgggtcaccgcactctcctcacaggtgccccaacctggcgtccgtcacgctctcgggctgcggccacgttaccgacgactgcctggcgcgcctntgcgctgctgcccacgcctgcgcgcactgcgcctggagaactgcgcgcgcgtcaccaaccgcacgttggctgccgtggcggcggacgggcgcgcgctgcagacattgcacgtggacttctgccgcaacgtgagcgcggccggcctgcgccgcctgcgcgccgcgtgcccgcgcctggccctgcgggcagagcacagcgccgccatgctgcccgaccagcccccgcgcccgcgcgcgcccgccgcggccctcggcaagctgctgcagcgctagacgccgccccgccgctgcccccggggaaggagcgcagccccagaccgtcctggcttcgaacccagctcttccaccttcagaccaccaccgcatattctgagcctcattttccccgtctgcacagtggggataagaaagcctacctcacgttacgattttatacataggataaacgcaagattaaatggatatttggaaaacactcggctggttctcactcaacaccaccgcctttcccctcttgcttccgccccaggctttctgctgtgcgctccccacggaggcgggaggcgcctgcaccgtcctcggggactccgatcgccgttggaccgaaatcacctcggtggggaggacctgaccactcggagttcgccgacttgcgctcgggggtgacgggggccagggctgccgcgcgcaggggtctggggagcctccgggcggagcgacccagcgagaccccgccggctcccggagtgtcctggggaccgccacctccaggagccccggtggtgatctcggtgaagcaggaggaggggaagcaggggcgcacgggcagaaggagccaccgagccgctcctccttgcggttttgcccgcacgcgcgtctgcccgcccacctttcctggggcggatgcgttcccgcagtgaccgcactcgcgattgtagaaaattcgctcccaattgttgaatgcttacataaactgcatagttacccatattttctactgttctcataagggaaaaagaaatgatttggaagaaaaaaaaagcctcaaactaaacaaaaacaaaaccagcagccctggctaagctttngatantggaaccattataagctgacaagctanattttcacctgtggatttgctggacatgagcacaagcctaggcttccaatttgaatttcagggctgtagtcactgatgtgtcacatttagtgaaggctctcggccccccggcagccgcctggtcctgggtcactggggagaattctgggtgggtggaagaggcgaggagcactgtgatgggcgctgttcacactccggctccacccagcgccagctgcgacaaagccctttacccctcccaggccaggtgtttcttctgtgtgaaagaggagcttgatccctactcacaggttccttaattcattgctcaaatagggaaacggcaaggaaaaagacaaattctgttctcatgaagcttaccttctagtgggggaagagacaacaggtaactggtatataagagggtagaagggccaggtgcggtggctcaatgcctgtaatcccagcactttaggaggccaagatgggcgattcacgaggtcaggagatcgagaccatcctggctaacaaggtgaaacccccgtctgtactaaaaaaaaatacaaaaaattagccgggcgtggtggcgggcacctgtagtcccagctactcaggaggctgaggcaggagaatggcgtgaacccgggaggcggagctngcagtgagccaagaacggccacggcacccc

SEQ ID NO: 547825 - DNA, 316 bp, Homo sapiens
gaagaatccgggtggtgatagctgcattatctagcacccgatgtgtttttttaactataaccaggtttcattctttttccacggaagggtgacatttggttagtacatttcagggtagtcattcatttctagctgtacataggatgaaggagagatcagatacatgaacatgtcttacaggggtggcggtatttagaattataaacatttttcattatggggaaagggtaacgggggaccttctggcatacctggtttacgaaccataaaccacatgcaccaccagggaatccttccggggtaccggagctcgaat

SEQ ID NO: 547826 - DNA, 1401 bp, Homo sapiens
ccattccattccattccattcaattccattccatgccatcccattcgggttgattccattccattccattccattccattccattcctttccattccattccattccattccactctggttaattccattccattccacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagtacaactgaaccaacaaatttatttagttagtgctgataaagacagcagccttgagagacaagcagtaattacctggtctacttaatgatgccctttgtcgatc

SEQ ID NO: 547827 - DNA, 188 bp, Homo sapiens
atccttagtagctagtaatgatatgcaaagctgatggccttttaattatagcagttccgtgtggggagaaataggagaactattataataaggagacacagtaagcaaaagaacacctttgaatgggcattttcttgctggggtaaaggtaacatggggggttggggggcgataccccacagggttcc

SEQ ID NO: 547828 - DNA, 166 bp, Homo sapiens
  misc_feature (43)..(43): n is a, c, g, or t
aggagatcaagcttttggcaatgagatctaaaccagacaaagncctccttatggaagaagatgacatggccttggaaatgtagtcatgcaggaggctcagaagaggctcatctcacaagttcagagagagggtttcatagaaaatattatccccttatcatctccc

SEQ ID NO: 547829 - DNA, 191 bp, Homo sapiens
gatctgtgctcttgtctgtctcaagtggacgattaatttctagtggttatgtaggagaaatatccttctttaatagatcacaaaatcttccttagttttacatcaaagctactctattttgggccatccaaatcctgcactttttttgttctggtttttttccctggtatttttcccacggctccgtttat

SEQ ID NO: 547830 - DNA, 342 bp, Homo sapiens
tgtattggtggtgctggctttgggcttctattgatcccattacctagacagtgaacatagtacccaataggaaggtttttcagcccttgactgcctccctctcttcctccttttcaagtccctagtgtctgttgttccagtctttctgtccgtgtgtccctaagttgatctacccttttctaagtgttgaagacaaaatttgaaaaccagtactatattaactaaccagtaactctactgtaataatatagattaattgcaacacattctacagctatgtctgtctgaaaactgtgggtgagaactgctatttttggaagcaccaccaatacagggtaccga

SEQ ID NO: 547831 - DNA, 480 bp, Homo sapiens
agaatttttacaaagacatttcttaccgccaagatggccggaacatgtctaccaggggcgcgtgtcttgtcatgacacgctcatgagctacacacttatcaccctatccatccactatgcactcaccaaactcttttcctagaccggaaccgatcaaaacatctcacacaatcggaggctagacaccccgagaacttcctcttatcacatatgtaacccccctgaatacctactctgctatatcttctagaggcacagaattcccatgagccacttttccccttattagatcaacctatactcccaaacatttgattatatactatgtctagactcaacaccatcactgcaccgtacatcctcacaaatgtaatcaatcataccctccaacacccccctttgatacacttaactattactcctcttcacacccttactcctttgctctacccttgcacccattctttttccttcctctct

SEQ ID NO: 547832 - DNA, 851 bp, Homo sapiens
gtgatatgaagggagagaagaaagaaaagtgcatagccattctgtaacaatattgtgtaaacctatagtttgaaggaatgcaaggagaaggatttctgtgttttactcattttaggctgttcagaagatgcttcaaaaattgtcctgttagaatttccatcatggaaggtggtatggaagaaggtatggaaatactttgtattctaaaaactcactgacgtggtcagttagacatacgttggtttccaggatggaggcccatatatcctggggagctttggtctattagtttgtgacaatattcaaaggccaaaacactactcagacactttcctgggaagagcaactaaaaatgtaaaattggttaaaaataaaatctgaaaagtatgtatctcacattgaactaaaatccactgtctcataagttcatggaatgaaatggctttctgcctccattttaatcatgcataaaatgaattagatggctttgagtggattttcacaatggctcaagactatatgaaattataaaaaaaaagttgccctggggtttctgcatcaattagaatatcattaatttctttgtaaccaagtgaaaaactatactttttggaaattatgaatttgtcctaggtttgtttgagatttgaaattatacatcatgcttctcattttttaaactatgttctttaaatcaacactggaaactctgtattatatacaagtgtaatacatgcatataatagaaaaaaaacatggaatttcaaatatactaactagattatccccagtagattaatgttgtgactattcagaaaaggtgaataaaattgggatataaaatggaaaaa

SEQ ID NO: 547833 - DNA, 509 bp, Homo sapiens
aatgcttgagcgtgggagggggaggtgtagtgagctgagattgcgccattgccctccaccctgggcagcaagagtgaaactctgtctcaaaaataaaataaggtaaaataaaataaaagcattattgtatgtgctgcattgaatggaacgtttatattagaattatcaaaaaagtttgcgtcatagcaatttatcctcattgaaaaccttgcagcatcctttgatttgggaatatcctctcaccagtcataccaccaggacatgactgtataacaataaaatattctcttgcattaaatgggggatatctattcaataaaagacaataaagaaaatgtaggaagtgtacttagagctgttactttctaagtgcccaacaccgtggacaattcaagcatcgtaatctctgtaaataacaataacaaaaaaaattttggtcctgctgttaaaatccatcattatagacaaaactggtgaggatggattagacagattcatctaacactgat

SEQ ID NO: 547834 - DNA, 448 bp, Homo sapiens
  misc_feature (58)..(58): n is a, c, g, or t
gcaacccggccattacgggcggggcgggcgcgggctaacccgcttaattttagcgccncgggagaccgagggagagagagggggcatgaggtcaagggacagcccccccacatacggggggcgcgtggcccccaataaacaagagggcgcggcggggccgtggctcaacacccaaaaacaaacagcggcgaggggcacggccgcaccatcccccggccaggagttcgaaaacagacacacgcacaaggggaaaccccggtgcgagtaaagaaaccaaaccccagcgggccgcgggggcacgcccacagagacccactcaccgggacggctgaggcaggaggaccaccagaccccgaagccggaggccgcaccgagcccagaccccaccaacgacccgcagcccgggccagaacacgactcacgggccaacatgcccggcgggggctcg

SEQ ID NO: 547835 - DNA, 1040 bp, Homo sapiens
gatgtcgtgtgttacaatgatgtgctggatcttgtagtaagttacctgctgtgcgtgcgggatgagcaatgcgagccctgtgtggtggcaaacgagactgtggcagatgttgtggttgtattgctgcaggagttgaatgttgacgatgtgtaactggtggccatcctgtggctgtgcagagtgccctcagttgtgctccttgtcaacccctttctcagctggcttgaaccattttgagatgccactggtgacattcagtggccttctcctgaaagcctgcctgcctgcctgccacctgacactaccttgcctttacctgtcatcctaatgagttgacgggatgctgctggaacagatgtggtcacatcgctgatggcacggcgagcatgccttgtgatgctggttgcgatgcacatgccagctcaaccatagtccgtgactaaccgctggctgtgctgacgtcgcaaggtgtctcataaccccttgaaactgaatgcaccgtgcaaatgggcgaactgaacctggaagtgcaccccggggccacggttctcctttcacaactctaacgtcgcggatagagcagactccaactcggcgcgcatagttcagcctgctctgggtcctccgcgagacaacgaacgttccccgcaacggtgcaattcaactctaacatccttctggcgcaacttccacacagcgcactacacacttccccgaacaattaacctgggaccataattcccaagaactaaccacaccccagtggcaccggctcaagttctcggctctacctcctctctcaacatctcttggaaccagtacacccttccaattccttggtgcaactcaaaccatggactaacggtacttgcacactccttgaaccaacaaaaggggccgtacacaccacaagcccttttccctgtgaacccaatggcaccacgccaataccactgtgttgcggagctaacaaccaaagtagacatccagcgtgctggttacatctcatcaaatggtaacgcctcaaaccacgtttatac

SEQ ID NO: 547836 - DNA, 135 bp, Homo sapiens
cccttcccccaagtgagcagtattgatctgagaattgagaatcactatttctttagtcagtctatagtttctgcatgccttctgtgtgtctctttgaactgagggatactctagtgtgtgtacgtgcgtgtgtgt

SEQ ID NO: 547837 - DNA, 320 bp, Homo sapiens
  misc_feature (42)..(42): n is a, c, g, or t
  misc_feature (59)..(59): n is a, c, g, or t
  misc_feature (71)..(71): n is a, c, g, or t
gctaaactctgtctcacaaaaaaaaaatttgtgggtgccaanactcaagaccatggganctggtcgggcanagtggctgacgtctgtaatctcagcactttgggaggccgaggcgggtggatcgcctgaggtcgggtgttcgggaccagcctggccaacatggcaaaaccccgtttctgctaaaaacacaaaaattggccaggcgtggtggttcatgtctgtagtcccagctgcttggaggctggggcgggagaatcgcttgaacccgggaggcatcggctgcggtgagtcaagatcgagacactgccctccagcctggg

SEQ ID NO: 547838 - DNA, 243 bp, Homo sapiens
  misc_feature (68)..(68): n is a, c, g, or t
  misc_feature (120)..(120): n is a, c, g, or t
catgctttcattcatctgagacattcctgtctattccattccataacatacgatttgatcattctgtnctattccattcaattctttttcattccattcgaatcctttctatagcagtcnattccattcgagtccattccaatcccttccattccattccattacaggccattccaatagattccattcctttgccttccattcgaatccattccattctagtccattccatttgagtcaatt

SEQ ID NO: 547839 - DNA, 339 bp, Homo sapiens
cgaggggcagctgacatcctgcagatacagaagatggggctcgaaggactcgttatgttaatcacaggatccacaggcgtgctggctggtaacaacaactctaccagttcactctagtgcaggatcactgcctgaatgaagggtccttatagaattcctccagttgagtgctttcataatatgtttgaagattatttcattataaaattttcatctatacatgagagacagaaggaactacagtctacagattttcaagtcaggtttcaaactcaattctcccactaagtaactatatgaccttggataaatcactttctctcattgggcgtacgggga

SEQ ID NO: 547840 - DNA, 108 bp, Homo sapiens
ggtcgtagctcagtgcgtgactgtctgcagcgggctgcagaataagagctgtaacatggagctgaggaccggacccagaacattatcatggccatggagtaatttgca

SEQ ID NO: 547841 - DNA, 809 bp, Homo sapiens
aactagtctccacacctaagctaactacagaaccagttgggctaaggacttaaccttggtaggggcactattattacctttgtattttaaggacacattcagttgctggctgaaagtattatcttccccatcaatctccggctaataatttgttttggaggggcagggggctcactgggaagaggcttctggttgtatatttaaaatttatatacctattttttattacatgaacaggctatacctaaaataaattcacgtaatttcaatggcagattactatttttactaattactcattactattagagattattatctctaatagaattaaatttgggagggggtaaatctggacattccgaaatttaccaattccaatgggatttcttatagaaatcctatagaatagaattcacccactggaagaagttgaagatttttatagaagcaaatgagtatttaatttggtggttttgtggtagggagattgagggcttaacttggtattatgatgaatagaatatacattacaggagggtttcggttttcagggaacggtcttggtccaaccaggagaattaaccaaaccaaatggatttgggggacacctttcaggcaactccgaattccatttccctgccttcagaagtcggattattggcagatacggccaggtttacccaagtaagagacttttggaattctgtttgatgtccagaacacctgttttgtctttgtccgaccgtaggccgaagcacagttgggggccatttaacaatgggccccctgggctgtccccgtggggc

SEQ ID NO: 547842 - DNA, 168 bp, Homo sapiens
agaaactctgtacccgattataaaatcatagtccatttccctctttccccacctcttggtaaccacttttatgcttttgctctccattgagccaccgtgcctggcctcacttagcatgttttaaacgatgcaatcatgtctaacatgcacatcaggtggatccgtcta

SEQ ID NO: 547843 - DNA, 380 bp, Homo sapiens
tagtagagacgggttttcaccatatgggtgaggctggtctcgaattcttgaccttgtgatccacccacttctacttcccaaagtgctggaattacaggcgtgagccaccgtgcctggccataagcttggattttttggtgcactcacttggtgtgctaggggcaggctacccagaaattatcattgtgtctgatgaacccagtttgaatttattaaaaggaaattttgtgtgtgtttaatctcctataattgactgattatcagggctttatttcattttatagtcagccgtgttgttgtcttgtgttcctttcattaggtttgactactacctttttagttgttcaaaacagcatttatttgttcaccacagcattttg

SEQ ID NO: 547844 - DNA, 445 bp, Homo sapiens
cggcgtcgacttcaggccgcgcatgaactgcgaataggtcaggccctcggcccggacaccggcgttgatgcgctggatccacagaccacggaaggtccgcttcttaaccttgcggtcgcgatacgcatattgaccggccttttcgacggcctggcgcgcgatgcggatggtgttcttgcgacggccataatagcccttcgcctgttccaaaatccgcttatgcttcgccttggtggtcgtgccccgcttgacgcgtgccatatctttctacccttccagaaatcagttcaggccgtaaggcgcccaggccttcacggtcttggtgtcggcatcggacaggaccgaggtgccgcggttctggcggatatacttgccgttatggctgatcaggcggtggcgcttgccggccacaccgtgcttgagcttgccggtcgcgggtcgacgc

SEQ ID NO: 547845 - DNA, 117 bp, Homo sapiens
ccggtcctttatttccttctttattgaaatacaagaaatcagccaggcgtgtcggcatgcgctatatagtcccagctacttgggaggctgagacaggagaatcacttgaacctggga

SEQ ID NO: 547846 - DNA, 748 bp, Homo sapiens
gccaggtgcagatacggggatgctcttattgctcataagaggggcttcgctggcagctactagaacggcaagccttgacgtcaggaccccttaattaagtatcctcaacttggctggaggcggcacgatcctcgcgtagtagggcaacgcggctaaccaatatcgcttcgcgctgggtgacgcggctacagctgcccaagggcgttcgtaacgggaatgccgaagccgtggcgaaaaacgggagcggtggcggcaagacggcggcatgagctcaggacagagcccagaggccaagaagagtaagcacgcgccgcaaagaaaaatgacaaagaggcagcacggagtagggcccagccctgtatgaggaccccccagatcagaaaacctcacccagtggcaaacactgccacactcaagatctgctcttggaatgtggatgggcttcgagtcctggcattacgaaggaacaggattacatcgcggtacatcgacacgaagccccagatataactgtgccttcaagagaccaagatgtcccgagaacaaactaccaggctgaaacttccgcgagctgccttggccctctctcatcatactggtcacctccttcgtcacattggcagcggttccgtgccgtggccctgccttcccgccagcttgccactcaaccggtccttccgcgcctacgcgcggcggacttgcccccgaaggcggctgtctgtgcctgcttcgaccgcctgtgttcgcc

SEQ ID NO: 547847 - DNA, 443 bp, Homo sapiens
tgcggggtgcccctgtgggagactgactgtctattgctcgataccctcttcatcttgctcatcctccacttgtctccatacctcattcttcctggtcgcagaacaagaactcaggacctgtcgaatggtggggctagaagagctgtagcacaaacagggctgagacatgccccctgctcgccacactgtgggtgaagagaaggagagaacagctgtagcccttcagggagcccagacctgggagctcccggagctaggcctgtgactccatctttgggaccctgtggttcctggtatctccaaacttccaggagctaccatgttcctcagtgtcaaccatggaagctgcttgcagtgtgtctggtctggccgcagcctcacagagagcccgcccatgctggcacctggagctgcccaccctgctgcagcacccagcgtgcctg

SEQ ID NO: 547848 - DNA, 859 bp, Homo sapiens
  misc_feature (3)..(3): n is a, c, g, or t
  misc_feature (81)..(81): n is a, c, g, or t
  misc_feature (83)..(83): n is a, c, g, or t
  misc_feature (92)..(92): n is a, c, g, or t
  misc_feature (114)..(114): n is a, c, g, or t
  misc_feature (126)..(127): n is a, c, g, or t
  misc_feature (131)..(132): n is a, c, g, or t
  misc_feature (134)..(134): n is a, c, g, or t
  misc_feature (156)..(157): n is a, c, g, or t
  misc_feature (160)..(160): n is a, c, g, or t
  misc_feature (178)..(178): n is a, c, g, or t
  misc_feature (182)..(182): n is a, c, g, or t
  misc_feature (191)..(191): n is a, c, g, or t
  misc_feature (193)..(193): n is a, c, g, or t
  misc_feature (199)..(199): n is a, c, g, or t
  misc_feature (207)..(207): n is a, c, g, or t
  misc_feature (209)..(209): n is a, c, g, or t
  misc_feature (214)..(214): n is a, c, g, or t
  misc_feature (218)..(218): n is a, c, g, or t
  misc_feature (221)..(221): n is a, c, g, or t
  misc_feature (225)..(225): n is a, c, g, or t
  misc_feature (242)..(242): n is a, c, g, or t
  misc_feature (291)..(291): n is a, c, g, or t
  misc_feature (308)..(308): n is a, c, g, or t
  misc_feature (330)..(331): n is a, c, g, or t
  misc_feature (338)..(338): n is a, c, g, or t
  misc_feature (347)..(348): n is a, c, g, or t
  misc_feature (350)..(350): n is a, c, g, or t
  misc_feature (361)..(361): n is a, c, g, or t
  misc_feature (377)..(377): n is a, c, g, or t
  misc_feature (380)..(380): n is a, c, g, or t
  misc_feature (445)..(445): n is a, c, g, or t
  misc_feature (626)..(626): n is a, c, g, or t
  misc_feature (788)..(788): n is a, c, g, or t
  misc_feature (798)..(798): n is a, c, g, or t
  misc_feature (811)..(811): n is a, c, g, or t
agntcttcctctgatggcgctgcctccatgccatgccctctgccagttctatgtggtgaacagtggagctgtcctgccagntnaaccagagntcgggagactggggctacgtancgctttacaacnncgcnnancacgcccgtcacacgaacaagnnganacacaacacggaccgaangccngtgaatttnanacacanttgggcgngncactntttnacngatncactccggccacgaaantcgctcgcggaacccgaccttcccaagccgggttctcgaaagtggaaantgtgactcaagcgaganttcgttgagggtacaatccgcnnccaactnttaaaatgnnanatggctgtttngggtgctttcaagggnctngaaggatattgtcagtctttaggggttgggctggatgccgaggtaaaagttctttttgctctaanagacaaaggaactaggtcaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtnctcttagccaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatntagagtgtgnttatgaactttanagttatagcttcttttatatgttgctataataaagacgtgttctgcaa

SEQ ID NO: 547849 - DNA, 1358 bp, Homo sapiens
ggggacgagggggtcaggcttgggccgacatcgcggggacagtgtgtggccatagcggcggcggccggggagtgaggaggcggaggaggaggcggctcgggagtcagagctgcccagcccaggcggcaggggcctagcagctctagagcagcctgccagagaggagctagctagctgctacatctaagctcctacctaggacatagcagggccctcgggcactgtctagagaccatgagtagtagccgactggcatgcgagcgcttacaccagctgcgcatctgctactggcgccggatagcccgggcctcgactcaactccggacttcacgcggcatcggcaaccgacctagatgaccagtgtacccagtagacggaacgagatgcaaggtgtctcaggacactgcgagactgcgggacgcctgccgcagcagcgggcatatcgtgctgcacacgtgcgacacgactggcagctccaccactgccctgcgccgccagccctcagaccgcgcatgacaaacagaagaaacaatactcaggcacagagacaaagaaacacaccagggagacccaacacaagaaaccagaaccagacaggacagacaagagaggaaactacagcaggcgccacactaggagcaggcacaaaaaggacataggagacaatgcagacggacacgcagaacggcaccaagcagcagcagcgacgacacccaaacccacgacacccaaccagcaaacagacggacacagacagaacgaaacaggacaacagcaagcacgccaaacacaaacagaatcgaccaccagcacaccacaccagagagaacccacacggccagccgccacagacccgaagacccgaacaagtcagcgcaacgacaacgcccaacgaacggcaacagcacagtgaacaggatgacatgaaggaaggaagagacggcaccacggagaaagaaaaacagcagcgcaagcgcacgaggtgaacaagaccacaccagataactacgacaagagacacagagcaacgaccacgcaacacaggcacgcaaccaaaagcacacgtaagcccaaacaccatatgatcaacccacgacgcaacacaacgtcaaccgcacaactaagtgacaatatattacaatatcatagtcgcaaaataaaacagaggagcagcaacacaaagcgacagacctatgaatagtcctcagcgatatgaaatccaccagatatcgacaacaacgcagaaaatcgaggcaactaaccacgatcgtgaacgctcagagaagccaacacgcagaccacaacaataaatcaacccagtcaagattgaactacccttatccgtgctaagcaaatag

SEQ ID NO: 547850 - DNA, 807 bp, Homo sapiens
  misc_feature (278)..(279): n is a, c, g, or t
  misc_feature (286)..(286): n is a, c, g, or t
  misc_feature (295)..(296): n is a, c, g, or t
  misc_feature (298)..(298): n is a, c, g, or t
  misc_feature (309)..(309): n is a, c, g, or t
  misc_feature (325)..(325): n is a, c, g, or t
  misc_feature (328)..(328): n is a, c, g, or t
  misc_feature (393)..(393): n is a, c, g, or t
  misc_feature (574)..(574): n is a, c, g, or t
  misc_feature (736)..(736): n is a, c, g, or t
  misc_feature (746)..(746): n is a, c, g, or t
  misc_feature (759)..(759): n is a, c, g, or t
gcgcgacatgggcctcggtgtgccttttctacatcgccatctacgccctgctcacgtacattgattgcgcacattcacgggcctgaagccaggtgactttatacacatctttgggagatgcacatatttacctgaatcatcatcgagcctgctgaaaattcagcttcagtcgtagaacccaggacctttcccttagtctcaggattcttcgtaaaagtttgagaatagttgatgacttcaaaggctgaagactttcagattgaagggtacaatccgcnnccaactnttaaaatgnnanatggctgtttngggtgctttcaagggnctngaaggatattgtcagtctttaggggttgggctggatgccgaggtaaaagttctttttgctctaanagacaaaggaactaggtcaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtnctcttagccaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatntagagtgtgnttatgaactttanagttatagcttcttttatatgttgctataataaagacgtgttctgcaa

SEQ ID NO: 547851 - DNA, 259 bp, Homo sapiens
  misc_feature (22)..(22): n is a, c, g, or t
  misc_feature (42)..(42): n is a, c, g, or t
  misc_feature (94)..(94): n is a, c, g, or t
tgtccttcccgctgcccagggnatggccaggccggagctcgngtgtgccgttgggaccaggcctgggaacccctctggcttgtttccccttttnagttacacaaatactttatgatcacttctgaaaatttaggaattttaggaatgaacaaggaagatagctttagagttatatacattttcttttacttgccattagagtcttcctagaccctgttttttaaagatgcctgactctccacgcccggctgtgaccaag

SEQ ID NO: 547852 - DNA, 415 bp, Homo sapiens
tacctattgggtactatgcttaatatgtgggtgacaaaatatgtgggtgacaaaataatctgtacaccaaacccctgtgacatgtttaactatacaataaacctgcacatgtacccttgaacctaaaataaacgtgttaaaaaaaaaagagagagagacagagacagggtctggctctgctggagtggctcgatcatagtgctctgtacccttgaacctccagcaatgctcccacctcagcctcaggagtagctgggactacaggcacaagccacaacacccagctggaactttataacataatggagaatataatataaagggcacttgagttaggggagataaatcttgaagtacaacattaatcgggcattttggcacaatgtacaaaatagattaattgaggactgggaga

SEQ ID NO: 547853 - DNA, 334 bp, Homo sapiens
gtcgaccccgggccgcgctgaattgaacggcattgccacggactgctgggcccgctatgaaacagagcctctttgaaagccgccatcagcccgagtggcaacgttttgcccaatggctcgagcagatggagcgcggcaaggcgaaacgaccgacttgcgcgaattcccagcccattaccgccgcctgtgccaacaactggccctgacccaggaacgcggctacagcagccatctggtcgatgccctgcaacagctggccttgcgtgggcaccagcagctctatcggcatcgcagccacctcggcgcctcggtgctggggttcgtcttcgtcgac

SEQ ID NO: 547854 - DNA, 135 bp, Homo sapiens
cccccttggccaaaaacccaattcccattgaaagggggggttgtttgaagtttttgtatcccagggttacccgggactttttcctgcaaccccaccccccaaaggtttttttatttcattccaggatcaatggta

SEQ ID NO: 547855 - DNA, 1460 bp, Homo sapiens
  misc_feature (569)..(569): n is a, c, g, or t
  misc_feature (711)..(711): n is a, c, g, or t
tatcgcacaagggattatttgttggagggtacagagtgacactgaacagatcacaaagcagcgaaaaactattagttctctccctctccccgaggcgttctcctttcgtcctcccgggtgtttctccgagtgttccacagaaggtgagaatgtgtcccataagtaacgtgcatgtgactcagaaggtgcgtgctcttatataagaacttcttcatctcaggggttatctccaattctcagcaatgtgtgctttcatctcaaatgtgcgcggtttgtgtgccgaggcttacggggcctgtttctcaggaagaagtttataaaactctctccattagtctataaaaaactgtgagaaaacatttatagtgtgccacgaacccaagaaccaaattgtgcggtgtggtgtataggcctgtggcatttctctttctcttataccatatatttctacacagatgtgtcttctcgctgtgggataagcccctgtgagcgtggagaagttctgcgaccacccaggtggggtgtgtggtgatgtgagtgtgaggtctctccccgagaaatgatgctcnacactctctcgacgaaaaagaaaaatatatcccttatataaaatatatatctctcttcctatagatcatacaagagacactgtggagacacaaattctatacgtgtggcgcgaagaacccctataaacagcggcccgcccgncttggtgtgtgggcgtgacgagcaccatgtgtgtctctctaatgaggtagatctcccccgttggaaaacgtctcttcccaagacatatatatgtgggggggagaagtatcacctcaacacaccccaaaacatttcgaagtgggagcggggcggggaaaaattttcgccccgtgtgtggcgcaactccagtgtgcgacaattaacacgtggggtgcgtgggggcccagaacaagaaatatgtggcccccacgtgtgtggagcgctctgcacgcgaacaaacgccaacgacccttttggagcgcctttcaaccccaaggagagggggggcgggggggacaacaacctccaaccctggtgaggagaaatcagcagcgggttgtggggaaccccggtggcgttgcatccctcccccccaatattatgtgggccacgaacaaactcccacacgcggccccccgaggttgcaccaaacagaattcccccccaaccgacgtggggtgccctttaggaaaacccacgcgaccacacgaacacggggtctctctgtcagcacgcgccgctgtgggcgaaaccacacatcaccacgccccagacggggctcccttaaacgcccaagtgtgtgtccgtcgggaacacacacacaacgctccccgtggaaaaaacaccctggggagcacgcgtttggagcagaacatcatttccgggggccccaacaaaaaggcgcggcgggcgcacccatccgtgggagc

SEQ ID NO: 547856 - DNA, 849 bp, Homo sapiens
ctctctcaggacaggacgtggggaccggcgtggaacctgaggcagaatgctatctctctccttgctaaattacggacctagaatagcaagcagataaaccattgatacccctctgggtgagacattgtcgatactgatatatggaatcgagtcacctagaatatcaaacagagtctttatagagatgacaagctgatggaaacatcaagatgggttctactcaccgtggttgtatggtagaatgttacatgtatcgagagtaattcatggaagcaaattatccaggagtaccaccaattcgatatacgtattgtatgtatttcaaagaatcaacaagagcaaaagtttctatgggatcagagggaatccatcatagctttatgtactcacctgcaacaattgataagaactattgaagacctagatgaaaatcagctgaaagatagagtgtgtaaactatctgcagatctcactgtggcgaaataagtgtgatgctgtctctctcaggtgggaaagtagttctcagaatacccaatgtactaaattcattggaagagctaaaaacctattccagtgacacttgaaagtgactaatggagacaatctttgtgggtccattgcatttagacaattttgccagggaaacccaatgaagagagaaagcttctggcataccttaggagctggtatactaggttctccgcactaagtttctggcactctgtgaggccggattaccaggcattttcacatcaatgttggccgaacatcttggtagtgccatctgaaaattggcataactggaggattacacatatgtagtaggaacgacacccaagtccagggaga

SEQ ID NO: 547857 - DNA, 490 bp, Homo sapiens
ctcctaccccgagaagagacagcgctgagtgtgcctgggcatctgcgtccatgcccatggatgtgagtagacagaaccctacttttgagaaaacgcctatccagcccactttgtaagaaccccctttttctaaactatgacaaaaggcggctttgcactttctgatcaaacaacactgtcttttgtctcctgcttaacttttaagactattctgtgaccgacatttgtagatttttttgttgttgttgttaatattttgcctggaaaaatgtgactctctccttgggaggtttagtagactaataaaaattatacatgaaggtggttgctattttgaggctaaaggtttttctaagaatcgccctcgtatcctgaccgtgaaggcttttcaggataccttttatagacgatcagatgcattcgagctgtgtttcctacatgatttctgttttgttttatgaaggacacgccatgtttaaatctctcattg

SEQ ID NO: 547858 - DNA, 330 bp, Homo sapiens
gtggtacctgtgggtagcacaacctagggtcagttttgcagagtggtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtttctaacaattgttcatacaataattgttcattattgttctcaacttggggctctccccaacctggggacccttcctta

SEQ ID NO: 547859 - DNA, 348 bp, Homo sapiens
aggatccccggtgcagtgctgcattgttccatcatgatgggagttgatgccagctgagtacgtgtgttttggagacttcctagcctggctgtttgtagaacttgtgttctgaggacacatagaaacccctggaagggttcatacttatggaacttctattaaatcacagttaaatgatttaggtgccgagaagttggcaaactttgttcatagaagagtttcactgtaaagactaggaagttacacatgtaattgcaaattgatggctatgttttctttaagtgtacaactggcagaattttagcatcctagatattcttgtataatcttagaacatatgtttacaac

SEQ ID NO: 547860 - DNA, 171 bp, Homo sapiens
cagaatcacactcaaaatagatgttcaaatacatgcctcacaatagcctttgtaaactgtattccagatgtttgatacaaaaattaaatgggtggctttatatttaacagtacgtgctcatttagcacccactattatttaaaggggtctacccaaagttttccagcaaaa

SEQ ID NO: 547861 - DNA, 214 bp, Homo sapiens
cagcatgttgttagtgcaatctggtaataccctgagtaacctctgaggactgagatgctaaacatgcatatctgtgtgctaacctgactcctggctatattacttttctacccttattattccctttaacaagttatcacctatggttactttatatttgctatctattggtcgtagctccatttcccgtaaagtacctctgacatctccgtta

SEQ ID NO: 547862 - DNA, 1225 bp, Homo sapiens
agcggtgcgaggtaccgacaatacgtctggtggttggcatcttccgtcaacctcaacttgtcttcccggcagcgtctgggagccgacgtgcgtaaggagggaacctggtggctaacctgtggggaaggccaggtaggacatgccgcctgggttccgtggccgcaccgagcacggcgccgtcgcgtgtccgctgtgccgcagtcccggcgcggccatcaggcatcgcgatgcgtaagcgggtacctcgtgacgcagagcgatggcaggggggcgggctgcacacgtctgctggagtagtccatgctggccccctctgagcctgggactcctcctagcctgggccctgtgcacgggggcctgagagtaggcgtcggattgcctcgcaccattccgacgtcgcctgtgttctctcggtcaggacctgggctggatgcacgctatcgaggtgccaggagaggcgctcgtcgtaagagcgtgacgggcggggagcccagacctcgcttgcttgagtttccccataatacttggtccctacaggtggctgggaaagaactcttcggcgtggaattccaggcgtgccaagcgaaaggtctacgagaggcctgagggtggtttactccttggggggtgggaactgcgaaagaaagccgctttcggcaaagaaggatcgactcctttatggcattacaacacgagggatctacagtagtacttgaaacaacgttgggtgcggatcgaaagcaacgccgtaattccgaagaggtgaagtggtttggcgttgtgtttggtggacgcaagactgtattaatgttgggtaaaggtgcgtacgttattgggttggttttgaaccacaccgttaaatgaatttcgacacgggaataactttatttcagaaaggcaatttcacattttaaggttttgggccaagagtattgatagcggagtttgctaaagacgatagttagcattttgccataagttaaaacttctttggtatcagaaatttggcgtgcggtggatttacaaagtttacacacactcgattggtagaccatgggaagttttttagatacaacggggacccatgagggaggagtaaaaacgtataatagagtgcgaattagatagaacgtgtgagcctattatgagataggtactttatcccgaaaaagggggtcttggactggaagaagtgaattattaattgcgcaacatgtaatcaagt

SEQ ID NO: 547863 - DNA, 664 bp, Homo sapiens
gtacccactttgtgtgggaggacccagcctcactcgtgaaggagagagcggcaagcaagagtccatggtggaccacgcagctgagcacagagtccgctccgaaacacacaggccattccgtagtagtttacaaaaaagaccacccggatggacagcggtgacacagcgagacactagccagactaccctactcacctgatttacgcgttgctgtagcatgtggtactctatgttctacgtgatagtctcctccaccacaaacctgggatccgtcgcacgttaacaccttaacaacggtactatgcagataccctactaacaagcgtctaggaggccgtaaggggactgtctaggccgggaagtttgttgtgatagcccgggccttgcaaaggttttaggcgactacaggggtggtgcagatatcgagtgctcatcctccaccgtcgacactactataggtattaaggcctcttggacaccacctagggtgtaaggctgtttgctcttttggttatacctattaccttagttagtctgccaaggacactggtgcttgcaaagagaaaagtacctcttaaaacaactataaaaccttctgtagtaataaaggtcctcccaccacaaacgtgggatccgtgcacgttaacgataccaggacatagag

SEQ ID NO: 547864 - DNA, 222 bp, Homo sapiens
  misc_feature (142)..(142): n is a, c, g, or t
gtgaacattcctcctttggcctacaggtcagattgcggcagttgagcatcgtcattcttcaggattgccctactggccctacctcacagctgaaactttaaaaaacaggatgggccaccagccacctcctccaactcaacancattctataattgataactccctgagcctcaagacacctcccgagtgtctttcactcccgttccaccctcagctctacct

SEQ ID NO: 547865 - DNA, 843 bp, Homo sapiens
  misc_feature (538)..(538): n is a, c, g, or t
ggatcccttgcgttactgtggagaccctactctcttcgctgagaacggtcgtctagcggggactgaaggccgggagcccactcccgacccggggctaacgtgccgtccctagagtcgagtcggtgggcaatgggagccagatggtccgccgacgggggaccgggaaacttttctgggctcctgggcgcttgccctgatatgccgcagtctcctatgctccggctatgcaggtccagacaatcccagtcgctcctgcccgcatgactggtcagcctcgcctgacatcctgcgagtcaaggcgcgccaattgccactgtcgtcgtctccgtggtggtctgtacgtgactgcctagccgagcacggaggctccaggtaagcctgagctggtggagcagcctgcttgtcgttgctgtgtagcgcgtcaacatcgggatcagcccacatcgctacgctaacaaatcattccatcatgagcttggcagctaaggatgcatctggcggcccatagggccagtagcctagactcactccaaaggtngtaaattcggatagctaactcgttgattgcattgcccactagttgtaagccgactggtttattattgtcgtaaaatctgagactcagcgtcctgcttctactatggacttcattgataccgtcagaaactgaaattccccagatcacccatggcttggctggactctcttgcaagcacgacagacgatcttgccaaccaaacagagcccgaaacactctgaccacataccaattgatgctgtctaagactgtcattacgagggctgcgagtcttctcctccagtaagccccggcagacggtacta

SEQ ID NO: 547866 - DNA, 388 bp, Homo sapiens
  misc_feature (103)..(103): n is a, c, g, or t
ttcatgcgcgcaagaaacccccgcacgcgcgaagaatgcgtgggctccggcgccgtgaagatcatgtacgcgtaggccgcgagcaccggccagatcacgaagngccagtcgaacggcggcgtggacagcgcgcccaagagcccgagcgcgagcacgacccagatgcgataccgaggagcgatcgtcacgggcgcgcagcctaaatcagcgagcatgattctcgtccgagaatcatgcccagctgagtttggttcctctgcacgaggccggaaaagagagcgtcagctcagaaataaaacgtgatgccggcggtgaggaggccgccgcccgacgcgttggtcgtctggccggtgctgtccgtgaactcggggtggttcgtggagtcccg

SEQ ID NO: 547867 - DNA, 314 bp, Homo sapiens
  misc_feature (47)..(47): n is a, c, g, or t
  misc_feature (60)..(60): n is a, c, g, or t
  misc_feature (63)..(63): n is a, c, g, or t
  misc_feature (118)..(118): n is a, c, g, or t
  misc_feature (177)..(177): n is a, c, g, or t
  misc_feature (235)..(235): n is a, c, g, or t
cactcttctcaaccagcgtgtcgacgtttcacaatcatccttaatgncaaccagcgtgtngangtttcacaatcatccttaatctcaaccaccgtgtcgaggtttcacaatcaccctnaatgtcaaccagcgtgtagacgtttcacaatcatccttaatgtcaaccagcgtgtcgangtttcacaatcatccttaatgtcaaccagcgtgtcgacgtttcacaatcatcctaatncaaccaccgtgtcgaggtttcacaatcatcctaaatgtcaaccagcgtgtcgacgtttcacaatcatccttaatctcaa

SEQ ID NO: 547868 - DNA, 778 bp, Homo sapiens
  misc_feature (16)..(16): n is a, c, g, or t
  misc_feature (63)..(63): n is a, c, g, or t
  misc_feature (89)..(89): n is a, c, g, or t
  misc_feature (94)..(94): n is a, c, g, or t
  misc_feature (102)..(102): n is a, c, g, or t
  misc_feature (124)..(124): n is a, c, g, or t
  misc_feature (146)..(146): n is a, c, g, or t
  misc_feature (148)..(148): n is a, c, g, or t
  misc_feature (151)..(152): n is a, c, g, or t
  misc_feature (154)..(156): n is a, c, g, or t
  misc_feature (160)..(160): n is a, c, g, or t
  misc_feature (167)..(167): n is a, c, g, or t
  misc_feature (184)..(184): n is a, c, g, or t
  misc_feature (204)..(204): n is a, c, g, or t
  misc_feature (207)..(207): n is a, c, g, or t
  misc_feature (216)..(216): n is a, c, g, or t
  misc_feature (227)..(227): n is a, c, g, or t
  misc_feature (231)..(231): n is a, c, g, or t
  misc_feature (236)..(236): n is a, c, g, or t
  misc_feature (243)..(244): n is a, c, g, or t
  misc_feature (249)..(249): n is a, c, g, or t
  misc_feature (251)..(251): n is a, c, g, or t
  misc_feature (256)..(256): n is a, c, g, or t
  misc_feature (261)..(261): n is a, c, g, or t
  misc_feature (271)..(271): n is a, c, g, or t
  misc_feature (275)..(275): n is a, c, g, or t
  misc_feature (287)..(287): n is a, c, g, or t
  misc_feature (293)..(293): n is a, c, g, or t
  misc_feature (305)..(305): n is a, c, g, or t
  misc_feature (322)..(322): n is a, c, g, or t
  misc_feature (328)..(328): n is a, c, g, or t
  misc_feature (330)..(331): n is a, c, g, or t
  misc_feature (335)..(336): n is a, c, g, or t
  misc_feature (345)..(347): n is a, c, g, or t
  misc_feature (353)..(354): n is a, c, g, or t
  misc_feature (357)..(358): n is a, c, g, or t
  misc_feature (370)..(371): n is a, c, g, or t
  misc_feature (381)..(381): n is a, c, g, or t
  misc_feature (383)..(383): n is a, c, g, or t
  misc_feature (386)..(386): n is a, c, g, or t
  misc_feature (390)..(390): n is a, c, g, or t
  misc_feature (412)..(412): n is a, c, g, or t
  misc_feature (529)..(529): n is a, c, g, or t
  misc_feature (610)..(610): n is a, c, g, or t
  misc_feature (765)..(765): n is a, c, g, or t
gcctcggcagggggcnggggggccaggagggggggggggggcgcggcgggcggccggggaatnggggggggggggcggggggggcgagnagggngacagggnggggtctaggggagggggagcnggggggggccccggggccgggngnagnngnnnatgnaggatgnggggcaccagggtgggnacccagagaacaaaagggcnggntaataaagnagaaaatgggngggnagatnagaaggnnacagntnatganaatgnctttgagggntacnttactgggcagngaaatnagggaggggagngtggaaacaaacaatgngggggnannagtnncttacatgnnntaacgnntgnntttgaaaacagnntaaaacacgngnggntggncaggtccagtgtgtggtcccgngggggggttgagtgttgcatctttgcctttcttgtcgttgatttttgcccagatggatctgcatttatttgtactttttctatgtattataatcctgtagaagtcactaataaaggngtattttttttgtcagcttatcaatcagactgatctaatgtgaaatgtaagtatccttaaaaacaaagcatctattttggnagaaattgtgttcttaaattcagtcatttgatattctgtgagacttcatatttctcatccctttattgctttttagcaaacataagaaaccatgagtcattttgtcatttagagtattctgataaaatctcttgaaaatactgaaatcaaaaggntaatgattttttg

SEQ ID NO: 547869 - DNA, 89 bp, Homo sapiens
caacaggatcgcaacggaagtgaggccacgcatcaaagagtctatatcgcgaggtcgacgcggccgcgaatttagtagtagtagtagta

SEQ ID NO: 547870 - DNA, 439 bp, Homo sapiens
  misc_feature (3)..(3): n is a, c, g, or t
  misc_feature (81)..(81): n is a, c, g, or t
  misc_feature (100)..(100): n is a, c, g, or t
  misc_feature (132)..(132): n is a, c, g, or t
cgncgtcgagcctgttactgaatctgataattataggttctgatctacatggccaatggacatcatcgtggcagctgcctnacgagcgctccttgatggncctggactggaaggatcccggatacagaggcngaaaaaaagggaagatctttaatctgacgtgaagtggctggttacatccggcagcgggtgacttcctcaggtattattcgaggtggaggactaaccctatgaccgcctctgagagcttttgacatgattaatcgattcatttatggaaaaggatgggatccttatgttggataaactaccttcccaaaagagaacatcagaggttttcattgctgaaaagaaatcgtaaaaacagaaaatgtcataggaataaaaaaattatcttttcatatctgcaagatttttttcatcaataaaaattatcctc

SEQ ID NO: 547871 - DNA, 187 bp, Homo sapiens
aaaaacatctcctagctagaaccctaaccggggctgggcgcaggtgctcacacctgtaatcccagcaattggggaggccagcctgagcaacacagtcacacctcatctctaaaaaaattttaaaaagagaaataaaaataaagaatgggccgggcacagtggctcacgcctgtaatctcagcacttg

SEQ ID NO: 547872 - DNA, 191 bp, Homo sapiens
aattttaatttttgattgtttattggtaaaataaaaaaaagcaattggtttttgaaattgactttggaccccgcccctgaaataaactcactttcagttttaacaggttatttgcagattttttagggttttttgaaaaaagacaaaattgtttgtgaaaaaacaaaaatttatgtttccctttccagtca

SEQ ID NO: 547873 - DNA, 312 bp, Homo sapiens
cggtcccctttttgcctgcggatggtaaccgtggtaactgcttcattaaacatctgcccatatgcacttacatatcaggtagcctcacatttaagaagcctctgcaatgcttttactgttatacattgaaagaaatgagagcgaagcgtcgtagctgagtgtactctaaaggaaagtgcagctctcacccagattctaggcagaagggtaagtcatggcggaggggtataaatgtttatggtaaccgtggaactgcttcatttaaaatctgcccaaatgcacttacatatcaggtagtccgcaaggcgcaaa

SEQ ID NO: 547874 - DNA, 966 bp, Homo sapiens
  misc_feature (489)..(489): n is a, c, g, or t
  misc_feature (576)..(576): n is a, c, g, or t
ggacactcctgacacgcactccttccataccctatgctttgcaggtctatccccagagctccgctgcttgttgcatgcggggcactgggggccatgtgtcccctactatcagtgacattcttggtcctccgtgcaccactatacgtgtgctcacacaaaaggaagcatgtgacctgtgtatccctaggtccccctacccaggcaggagctggctcctggagccaaccccgtccacgcctgtctcctgaatcgctcgcgtgttttccagatgttggtgacgctgggagcatcatgccgccatagggtatggatagcctatcacgcaactcatcaggtgcctctgttcggcggagagctttcctgatgcatgcttgcgaaagtgcctcaacattcagatctggcgcttacctcactatactcccgcaaggccagttccgagactgtacgcatctcccggtgtcagctcccgttgcaagcttcctgcaacantgcacgagaactgacgtgattgttatctgcactttccaaggccaaatgaaccgtctgactccttctggtctacctggcgaaccaggntctcgagttgcccagcagccaacccacttggtctgcactgcccactactgcgtggaattctcgcggatggaacttgtgatcctcgtctgggcacagcgcagctcccagaagtccgctactggaggtagcagaagtgggccatggccctaggacactgccagctcctcacccactccagtccaccgagatcacgtcagagtaagagcctgtggccatgtggccgctgtcaggagccccacagtgcaagggtgaggatagcccaaggaagggctgggcatctgcccagacaggcctcccagagaaggctggtgaccaggtcccaggcgggcaagactcagccttggtggggcctgaggacagaggaggccaggagcatcggggaggcacgtg

SEQ ID NO: 547875 - DNA, 331 bp, Homo sapiens
tggcgggcagaaaactgaagtaattatccagaatagttagataaaaaaaaaaaaaaagcccacttcagcccccaagactaaactaggaagaagtcgaatccccgaatagaccaataacaagttctaaaactgtggtagtaattaatagcctaccaaccaaaaaaaaaaaaaaaaaaaaaaaaagcccaggacgagatggattcacagccgtattctaacagaggtacaaagaaagaggagctggtaccattccttctgaaactattccaaacaatagaaaaagaagggctcctctctaactcattttatcacatcagcatcatcctgatac

SEQ ID NO: 547876 - DNA, 152 bp, Homo sapiens
tattcccctattttgagcccataaaagacccagactcagctgcagtgaggagagaaatcaccctgctgtgggggttggggaccactccctgcatcccctttccactgagagctgtttttttggtcaataaaatttttttctacccatcctca

SEQ ID NO: 547877 - DNA, 140 bp, Homo sapiens
tcctgtaaagaaacatctcaatgtggcaggagagctcatgtatgggtaaactccgaccatgtagctctgtaggctccggcaggcgcattcttaggctgcttgagtccactgtggcatatgctcaactgaccatgagaatc

SEQ ID NO: 547878 - DNA, 370 bp, Homo sapiens
  misc_feature (42)..(42): n is a, c, g, or t
  misc_feature (114)..(114): n is a, c, g, or t
  misc_feature (171)..(171): n is a, c, g, or t
  misc_feature (217)..(217): n is a, c, g, or t
acacgtaaacgtctggattataaagactgatatggtagtgtnggaaatgtggggcactggatgcttatcattgctgtggtaacaactgcttgaaatattgcactttctttcttnttctttttcttttttcttttctttttgagacaggtctcactttgtcacccaggctgnagtgcagtagcatgatcttggctcactgcaacctccacctccaggnctcaagaggtcctcctgcctcagcttcccgagtagctgggactacaggcgcgtgccaccatgcttggctaatttttttgtatttttggtagagactgggttttgccatgttcccaggctgatctcaaactcctgggcacaagcagtcctctcg

SEQ ID NO: 547879 - DNA, 132 bp, Homo sapiens
cactcgtcactgttgccaccgcctccgacttactgactgggtcttacctactgaccgacacgacttacttaccacacactgcctgggactgtgaccgactaaccgcttgtacgactagtggatcggttaccc

SEQ ID NO: 547880 - DNA, 393 bp, Homo sapiens
  misc_feature (326)..(326): n is a, c, g, or t
  misc_feature (363)..(363): n is a, c, g, or t
ggcacgaggtgaaagtcaccaaaactcgaaccatacaagaatccccatcttcctttgaaactttgctgaaactctttagttttctggctttgctcatagctgtcttcttgattttcctgtaagtgaaagatctaactggcttttcaaatgtatggagtataacgttccaactcctctaatgtaacaactttgtcttcataatcataaaccatatccaaagaatgaaaccctaccccctcccctttccggttcacctcactggcagcttggtattgctgggtctcttgcagctccattaggtttaatgccagaagataaggtccagnacttttggttcacttaaaatgttggaaggatccaggnccttttcaggaagaagctgcccccagagaa

SEQ ID NO: 547881 - DNA, 1014 bp, Homo sapiens
ggtagagtgagccccgggggggcaggtgggatgaggatgagcagtggtcggtggtggtggagtgcgaggactgtgaactgatcccggcggaccatgtgattgtgaccgtgtcgctaggtgtgctaaagaggcagtacaccagctttcttccggaccagggctgcgccatcagagaaggtggctggcatccaccggctggggcatgaggcaccatcgacctagatctttctggaattcgaggagcccttctggggccctgagtgcaacagcctacagtttgtgtgggagaggacgaagcggagaagtcacaccctcaactacccacctgagctctggtaccgcaagatctgcggctgtgatgtcctctaaccgctgagcgctacggtcatgtgctgaggcggttggatctgcgcgtggatggatggccctcgttcatgagatgaatgatgttgattggggatggcccatgatgagccagatgatctggacggagatgctagcgtcagtttcaccagggaaccccaggattccagaaacctcgtggaatcttgacgctcgagtcttggagggcagcagacccttacttccgtggctccctatttcttatcacgcgggtgggcttcagtggcgcggatgtggacgaagcttgtcaaggccccctgccgtacaccggggaagctctaaagtactgggcccgatgcaggtgctggatcgcggtgagggcaacccatcgtgtgtgcctaatccaccaaccaagggctcaggtgtccggcaagcgggaaggttggccgctcattgagaattgtacgagacctctccagcaggggactgaggagtctacgcgcaagaaaagcataatcgggactcagctggccctgtgcggttgccgctctgacccggaaaggaatgacgtaaagacacgaagtaaaggggaattacaaggggagaaagggaacaaaaagacgcaccaaacaagcgaaggaaacgaaagcccaaagggacgcacaacaaaag

SEQ ID NO: 547882 - DNA, 712 bp, Homo sapiens
tcaaaaacgattgatttaaaaacagccctcccatcttagcaatgtcccggggtggttggagccaggggtcatttctttggtcctggtccaaaatctgtcggtagcgctccaacattgcaagttcattcacttgaagcttcctgtgcttcgatacctcctttccttcgatgtggaagctgagccctcacgcttccggcatgcctttggccgcggcgcctccttcatgagaagacagggttggtccaaaattcttagtgggcattcgccagacatgtgtgccggtggcctcccttgatagcgggatttggtggattgggtggagccactccgtgtttcaaccaagcaagcacggggaaagagctcgtgctataagcctttggcggtgcacaccgaagtgtgtagttgaagcgcccgtgcttgctttgtcgagctctcgcccaggaggatattgtttgcaggcgcgcggagttgcagggtccggggtggccctttcacgggtgcctctgcctttcagccggccaagcaggcttgcccacggccgccatattcctttcttttaagagcccccgagtgtggcaccgtggagtgtggttcagtacaggcccgtggctttgcaaccaacttttcccagaaacctttgggattttctcagaaccgccagcaacaggagcctgggggctggtccaggagggtcttcgggaaaagctccctc

SEQ ID NO: 547883 - DNA, 276 bp, Homo sapiens
  misc_feature (17)..(17): n is a, c, g, or t
  misc_feature (19)..(19): n is a, c, g, or t
  misc_feature (28)..(28): n is a, c, g, or t
  misc_feature (60)..(60): n is a, c, g, or t
  misc_feature (213)..(213): n is a, c, g, or t
  misc_feature (271)..(271): n is a, c, g, or t
ccctcaggaattacttngnatttttccncatgaccttaacctgtgtgggctgacagaggnacccagatcttcaggtttctgcgatgcagcaccagaacagtgctgggaactgaacagagactggggtggaggccggctgcagcctccgccatctctgtgggcccgcaccctgctggtctttgaagtgcagcagcccttcctcttcgtgctctnggaccagcagcacaagttccctgtcttcatggggcgagtatatgaccccaggggcctnagaac

SEQ ID NO: 547884 - DNA, 345 bp, Homo sapiens
ttcccaggctggtagttgaactcctgagctctagtgaccaccacctgcctcgtgtctccctaaaatgctgggattacgtggcattagccatagctctttccttgtgtataagagactttaacccttcttgtttcctcagtgttcattggacctagttttctttttcttttttatttttttctaacagagacaggtctcactattgttgcccaggctggagtgcagtggctatacacagacatgatcatagtaccctgtggccttgaagtcctggattcaagtgatccttttgcctcttgattatctgggactgcaggcatgcttgtgcctgactcaggtggtgtg

SEQ ID NO: 547885 - DNA, 253 bp, Homo sapiens
cagaggtagcttcgctcatgtacaaggagacttggggaccgttgatttctttgactgatgaatggaggtaattccccttcattaggccccattcccctgtaaagccgtcaagggcaatgttgttgtaatggtcaggacttagaagtcctcgaagtggcccaacgtcgctcccttggttgaaccttgcgtctgggactcacccttcaacccttcaaggcattccatgttctaacttttaaaacccattggctgt

SEQ ID NO: 547886 - DNA, 190 bp, Homo sapiens
aacccgcgacctcctttggaaattcagagatcacccatcttctgtgtcgcttacgctgggagctgtagactggagctattcctatttggccatcttggaacctccccccagttacttatttatttttacctctaaatactttattatttcattcatagacacatcattatgtattgcctaaggatgttct

SEQ ID NO: 547887 - DNA, 664 bp, Homo sapiens
acaaactagtctcgacgttttctctcttctttcttaggaactactacaaattttaatcttttactacgagctactcttaacaaatccttatcaagtaagatattaactttacctttataaatctttgtgtgacacatgaaaaaaaaatcaaggctataacaaatttcattgtgtatctacatttttaaataccatcctttggtctccggttaaaagattttcatccatttattcaaaaaccttttaagttcaacgtgtccaatttaagacagagtgaagacattttttgagtatctgaactaaggcattgtcttgattggaaacgaagtaaaggaactacaatggagaagtcctatgtagggcctacctcagtacatagccttataccgtgaatataagggagactatacatatctataggtaggggtacataccacgcctggctaatagttctaaatatgtggcccatcttaaggcatagatgttaacgaatatttcttatcacaggaatagctggccagcgtggtacctatgcttcctggcagatactgttatatttcccaatggttggtataacattcagcaagtctggtcaattctagcaacctggtctaggtgataaatgttcgaagagaggcttcctccagacagggtcccctgtttc

SEQ ID NO: 547888 - DNA, 282 bp, Homo sapiens
acgagagctagcagacgcacataagatgcttatagctcttccagctggaggaggaggtggtggtgtacttaatggtggaactgccgactccaacagagctgaggccacccccaatggctctgccaatgatggaactgaagccaactccaaagccaagaccactgacataggagtagctgcttcctccaaccaggcctaagccactgacgacatcactggaaccgccaaagccacatggagacggtggactgcaccacagagatatagccttacggagaaaag

SEQ ID NO: 547889 - DNA, 352 bp, Homo sapiens
  misc_feature (15)..(15): n is a, c, g, or t
  misc_feature (73)..(73): n is a, c, g, or t
  misc_feature (75)..(75): n is a, c, g, or t
ctaagcgcactgctntccagtactggtcggcctattgcgtttgtcagaaaaattccttggaccgcggcagagntngagctgagagaacattttgcacagtttggccatgtaagaaggtgcactgtaccttttgacaaagagactggctttcacagaggcatgggttgggttcagttttcctctcaggaagaacttcagaatgcactacaacaagaacatcatattattgatggagtaaaaatccacgttcaagctcaaagagcaaaggctttgcacggagctcaaacatctgatgaagaaagatttctgagatgatcagtgtaccgtccactaaataaacagaattgagaca

SEQ ID NO: 547890 - DNA, 907 bp, Homo sapiens
  misc_feature (102)..(102): n is a, c, g, or t
  misc_feature (107)..(108): n is a, c, g, or t
  misc_feature (117)..(120): n is a, c, g, or t
  misc_feature (122)..(122): n is a, c, g, or t
  misc_feature (125)..(125): n is a, c, g, or t
  misc_feature (158)..(159): n is a, c, g, or t
  misc_feature (161)..(161): n is a, c, g, or t
  misc_feature (224)..(224): n is a, c, g, or t
  misc_feature (228)..(228): n is a, c, g, or t
  misc_feature (269)..(269): n is a, c, g, or t
attctagaggccgaggctgccagatcgcttgaggtcaggggttcgagaccagcctggccaacatggtaaaacccgtctctatctactaaaaatacaaaacgnagctnnccgggtggnnnncngantcacttgaacccgagagtggaggttgcagtganncnagattgcaccattgcactccagcctgggtgacagagcaagactccatctcaaaaaaacaaacnaatnataagaaaacaataataaaacaaaataaataaatgtatatnaccatgtaactactaccacaatctagttacaggacaatttcattcccccaaattccctcttgcctcaccccatccactggcaaccactgacttgatttctgtctcttaagtaaacatagaatattattgattcataaaatcatgattttgaaaattaatgacatgaaaaatatgcacaatatatttcagaaagcaaaatgtataatttcatttaaaaaatgcatagcatggtcccatctttgtgtgtattctgtgccaataaagctcacagcaaggaaatattacttttctgcacgtgatgaatgtacatcctttgtacatttttccaaatgtctacaatgagcctgtagttctctcatgctcagaaaatatgaatgcctttttctaaaaggaacaaggtcattatagctacttatttggacttttttttcctttaaaaacttagatattacatacagtaaatttactcttgcaatttatgatgcagggagtttgataacgtgtgttttaacgaatgggcatgtggtgactcaggctataatccaaacagtggggaggccgagtgcaaatggttgaggcaggatccggatcggcggcaaaatggtgaactcatttataaatcaaatttgcaggggagg
